United States Patent 10,570,408 (TRANSGENIC PLANTS WITH ENHANCED AGRONOMIC TRAITS) - sequence listing, part 5

SEQ ID NO: 17737 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQLAGDKAEFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 17738 - protein, 223 aa, Coccidioides immitis
MARRPARCYRYCKNKPYPKSRFNRGVPDPKIKIFDLGRKKANTDDFPLCVHMVSNEYEQLSSEALEAARICANKYLVKICGKEGFHLRVRAHPFHVVRINKMLSCAGADRLQTGMRGAFGKPYGVVARVNIGQILLSVRTRDSNRAAAIEALRRSMYKFPGRQKIIVSKNWGFTPLRREEYVQLRKEGKVKIDGAYVQFLRNKGNIEENMRRFPDAYENLSQA

SEQ ID NO: 17739 - protein, 431 aa, Arabidopsis thaliana
MCNNNNTSCVNISSMLQPEDIFSRRCIWVNGPVIVGAGPSGLAVAADLKRQEVPFVILERANCIASLWQNRTYDRLKLHLPKQFCQLPNLPFPEDIPEYPTKYQFIEYLESYATHFDLRPKFNETVQSAKYDKRFGLWRVQTVLRSELLGYCEFEYICRWLVVATGENAEKVVPEFEGLEDFGGDVLHAGDYKSGERYRGKRVLVVGCGNSGMEVSLDLCNHDASPSMVVRSSVHVLPREVLGKSTFELSVTMMKWMPVWLVDKTLLVLTRLLLGNTDKYGLKRPEIGPLELKNTAGKTPVLDIGAISMIKSGKIKIVAGIAKFGPGKVELVDGRVLQIDSVILATGYRSNVPSWLKENDLGEIGIEKNPFPKGWKGKAGLYAVGFTGRGLSGASFDAMSVAHDIANSWKEETKQQIKTVATRHRRCISHF

SEQ ID NO: 17740 - protein, 72 aa, Fulvimarina pelagi
MAKEEVLEFPGEVVELLPNATFRVKLENEHEIIAHTAGRMRKNRIRVLTGDKVLVEMTPYDLTKGRITYRFK

SEQ ID NO: 17741 - protein, 488 aa, Mycobacterium smegmatis
MTASSTPSSTTGTAQIGVTGLAVMGSNIARNFARHGYTVALHNRSIAKTDALLAEHGSEGKFVRSETIAEFIDALEKPRKVLIMVKAGEATDAVIDELADAMEPGDIIIDGGNALYTDTIRREAAIRARGLHFVGAGISGGEEGALNGPSIMPGGPAESYESLGPLLEEISAHVDGVPCCTHIGPDGAGHFVKMVHNGIEYSDMQLIGEAYQLLRDGLGMSAGEIADVFEEWNRGDLDSFLVEITAKVLRQTDAKTGKPLVDVIVDEAEQKGTGRWTVKSALDLGVPVTGIAEAVFARALSGSVPQRKATVGLASGALGATPSDAADFIEAVRRALYASKIVAYAQGFNQIQAGSAEYNWNLTPGDLATIWRGGCIIRAKFLNRIKDAYDAEPDLPTLLAAPYFRDAVEAGIDSWRRVVVTATQLGIPVPGFASALSYYDALRTERLPAALIQGLRDYFGAHTYGRIDAEPGKKFHTLWSGDHSEVEA

SEQ ID NO: 17742 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGQNLSNEELASTFTEWNNGELSSYLIDITKDIFTKKDEDGNYLVDVILDEAANKGTGKWTSQSALDLGEPLSLITESVFARYISSLKAQRVAASKVLSGPKKHPAGDKAEFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 17743 - protein, 732 aa, Mycobacterium avium
MSSNEPASAAGGGTHQPEVPTVWPGSPYPLGASYDGAGTNFSLFSEIAEKVELCLIDSRGAETRIPLDEVDGYVWHAYLPNINPGQRYGFRVYGPFEPSAGHRCDPSKLLLDPYGKAFHGDFTYGQALFSYDLKAVAAGGDDADPGIPPMVDSLGHTMTSVVSNPFFDWGSDRAPLTPYHETVIYEAHVKGMTQTHPSVPEQLRGTYAGLAHPAIIDHLKSLNVTAIELMPVHQFMHDSRLLDLGLRNYWGYNTFGFFAPHNQYAANRNSSVAEFKSMVRSFHEAGIEVILDVVYNHTAEGNHLGPTINFRGIDNAAYYRLVDTDLRRYKDYTGTGNSLNPRHPHVLQLIMDSLRYWVTEMHVDGFRFDLAATLARELHDVDRLSAFFDLVQQDPIVSQVKLIAEPWDVGEGGYQVGNFPGLWTEWNGKYRDTVRDYWRGEPATLGEFASRLTGSSDLYEATGRRPSASINFVTAHDGFTLNDLVSYNEKHNMANGEDNRDGESHNRSWNCGVEGPTDDPDITELRYRQMRNFWATLMVSQGTPMIAHGDEFGRTQNGNNNVYCQDSELSWMDWSLVDKNSDLLAFARRATTLRTKHPVFRRRRFFEGEPIRSGDEVRDIAWLTPGGREMTHEDWGQSFHKCVAVFLNGDAITAPNARGERVVDDSFLLCFNAGEQPVQFVMPGGDYAKEWTVELDTNEPTGRKEGAEPLVVHAEEELTLPSRSLLILRKTL

SEQ ID NO: 17744 - protein, 832 aa, Thermobifida fusca
MKAVVMAGGEGTRLRPMTANQPKPLLPVVNRPIMEHVLRLLKRHGFEDTVVTVQFLATLIRNYFGDGEELGMSLRYVAEEVPLGTAGSVKNAEEHLRGEPFIVISGDALTDIDLTDMVRFHRENGALVTIGLKRVANPLEFGIIIVDDNGRIQRFLEKPTWGQVFSDTVNTGIYIMEPEVLDHVAPGENVDWSGDVFPKLLKAGAPLYGYIADGYWEDVGTHESYLRAQADVLSGKVDVEIDGFEVSPGIWVAEGAEVDPEAVLKGPLYIGDYAKVEPGAELREFTVLGSNVVVRSEAFLHRAVVHDNVYVGTRANLRGCVVGKNTDIMAGVRIEEGTVVGEECVLESEAYLANNIKVYPFKTIEAGAVVNTNVIWESKGQRSLFGPRGVSGLINVEITPELAVRLASAYATTLKKGAVVTTARDASRAARTLKRAVISALTAAAINVQDLEATPLPLARFHTSQPGLSGGIALRTTPGDPQSVDIVFLDSSGADLSPAAQRKLERVFSRQEYRRAFPGEIAELSFPSRSVEAYTRELLQSIDLSGVAEANLKVVVDCAGGTGSLILPALLSQIDADVLTVNNRLDEASPTDTPAKRTRDLQRLGELVASARADFGVRFDPVGERIQLVDGSGTLVDDERALLVVLDLVAAERQGGRVALPVTTTRVAEQVANRHGVDVQWTPTSLDALTKAALADDIIFAADGRGGFILPEFSRTCDGIAAFVRLIGLVARTKMSLSQIDQRIPQAHLLRRSVPTPWAVKGSVMREVVEAAQGREIDTTDGVRVIEPDGSWALVLPDTAEAVTHLWAEGPDDETAQRLLEEWSAVVERAEG

SEQ ID NO: 17745 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTKWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASGEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 17746 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTKWNNGELSSYLIDITKDIFTKKDEDGNYLVDVILDEAANKGTGKWTSQSALDLGEPLSLITESVFARYISSLKAQRVAASKVLSGPKAQLAGDKAEFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 17747 - protein, 488 aa, Rickettsiella grylli
MLIFELSQTGRVAKSQIRAFDSKDTTFNTQLTSIPENYLRKTKLCLPEVSELQVVRHFTRLSQKNFSIDTHFYPLGSCTMKYNPRGVHRLASLPAFLHQHPLLPETSCQATLRCLYEFQEILKDITGMSGVSLTPMAGAQGEFAGVAMIKAYHASRGDTARTEFLIPDAAHGTNPASAAMCGYSVREIPTNPAGDIDLDALYSAVGSHTAGIMLTNPSTLGVFEQHIEQIASIIHQAGGLLYYDGANLNAILGKVRPKDMGFDVMHLNLHKTFATPHGGGGPGAGPVAVGERLLPFLPIPIVAFEKNRYRWLHLQDRPQSIGRLSTFMGNTGILLRAYFYACLLGREGLKRVSEFATLNANYLLKQLQRIGYIPAFPQRRASHEFILTLKNLSKQANVTAMDVSKRLLDFGFHAPTTYFPLLIPECLLIEPTETESKQELDQFISAMEKILIEAKKNPTHLNNAPHHLRLKRLDDVKAVRELDLTWEN

SEQ ID NO: 17748 - protein, 1174 aa, Streptococcus pyogenes
MNVILNGGLMKKKVNQGSKRYQYLLKKWGIGFVIAATGTVMLGCTPSILTHQVAAKTIVGLARDEAQQGDGNAKSGDGFQSSSKEAKPVLDSSSANPASIAEHHLRMHFKTLPAGESLGSLGLWVWGDVDQPSKDWPNGAITMTKAKKDDYGYYLDVPLAAKHRQQVSYLINNKAGENLSKDQHISLLTPRMNEVWIDENYHAHAYRPLKKGYLRINYHNQSGHYDNLAVWTFKDVKTPTTDWPNGLDLSHKGPYGAYVDVPLKEGANEIGFLILDKSKTGDAIKVQPKDYLFKELDNHTQVFVKDTDPKVYNNPYYIDQVSLKGAEQTTPNEIKAIFTTLDGLDEDAVKQNIKITDKAGKTVAIDELTLDKDKSVMTLKGDFKAQGAVYTVTFGEVSQVARQSWQLKDKLYAYDGELGATLAKDGSVDLALWSPSADTVKVVVYDKQDQTKVLGQANLTKSDKGVWRAHLTSDSIKGISDYTGYYYLYEITRGQEKVMVLDPYAKSLAAWNDATATDDIKTAKAAFIDPSKLGPTGLDFAKINNFKKREDAIIYEAHVRDFTSDKALEGKLTYPFGTFSAFVEQLDYLKDLGVTHVQLLPVLSYFYANELDKSRSTAYTSSDNNYNWGYDPQHYFALSGMYSANPNDPALRIAELKNLVNEIHKRGMGVIFDVVYNHTARTYLFEDLEPNYYHFMNADGTARESFGGGRLGTTHAMSRRILVDSITYLTREFKVDGFRFDMMGDHDAAAIEQAFKAAKAINPNTIMIGEGWRTYQGDEGKKEIAADQDWMKATNTVGVFSDDIRNTLKSGFPNEGTAAFITGGAKNLEGLFKTIKAQPSNFEADAPGDVVQYIAAHDNLTLHDVIAKSINKDPKVAEEEIHKRIRLGNTMILTAQGTAFIHSGQEYGRTKQLLNPDYKTKVSDDKVPNKATLIDAVAKYPYFIHDSYDSSDAVNHFDWAKATDSIAHPISNQTKAYTQGLIALRRSTDAFTKATKAEVDRDVTLITQAGQDGIQQEDLIMGYQTVASNGDRYAVFVNADNKTRKVVLPQAYRYLPGAQVLADAEQAGVTAIAKPKGVQFTKEGLTIDGLTALVLKVSSKTANPSQQKSQTGNHQTKTPDGSKDLDKSLMTRPKRAKTNQKLPKTGEASSKGLLAAGVALLLLAISLLMKRQKD

SEQ ID NO: 17749 - protein, 507 aa, Wolinella succinogenes
MTKFKLLLAGSLVAIVSMGLLASNINEREKERVALNKTAHSQGIEGKAMSEEWARYYPRQFDSWKKTKESDNITDMLKEKPALVVAWAGYPFSKDYNAPRGHYYALQDNINTLRTGAPVDGKTGPLPSACWTCKSPDVPRIIEQDGELEYFTGKWAKYGDEIVNTIGCYNCHDDKSAELKSKVPYLDRGLSAAGFKTFAESTHQEKRSLVCAQCHVEYYFKKTEWKDDKGVDKTAMVVTLPWSKGISTEQMEAYYDEINFADWTHGISKTPMLKAQHPDWELYKTGIHGQKGVSCADCHMPYTQEGAVKYSDHKVGNPLDNMDKSCMNCHRESEQKLKDIVKQKFERKEFLQDIAFDNIGKAHLETGKAMELGATDAELKEIRTHIRHAQWRADMAIAGHGSFFHAPEEVLRLLASGNEEAQKARIKLVKVLAKYGAIDYVAPDFETKEKAQKLAKVDMEAFIAEKLKFKQTLEQEWKKQAIAKGRLNPESLKGVDEKSSYYDKTKK

SEQ ID NO: 17750 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENAGIANLLLAPYFKKIADEYQQALRDVVSYAVQNGIPVPTFSAAVAYYDSYRAAVLPANLIQAQRDYFGAHTYKRT

SEQ ID NO: 17751 - protein, 544 aa, Streptococcus pyogenes
MINRRRIMKKHWWHKATIYQIYPRSFKDTNGNGIGDLKGITSQLDYLQKLGITAIWLSPVYQSPMDDNGYDISDYEAIADVFGDMADMDELLAAANERGIKIIMDLVVNHTSDEHAWFVEARENPNSPERDFYIWRDEPNDLTSIFSGSAWEYDNASGQYYLHLFSKRQPDLNWENEALRHKIYDMMNFWIAKGIGGFRMDVIDLIGKVPDLEITGNGPRLHDYLKEMNQATFGNHDVMTVGETWGATPEIARQYSRPENKELSMVFQFEHVGLQHKPDAPKWDYAEELDVPALKAIFSKWQTELKLGEGWNSLFWNNHDLPRVLSIWGNDSTYREKSAKALAILLHLMRGTPYIYQGEEIGMTNYPFKDLTEVNDIESLNYAKEAMGNGVSAARVMDSIRKVGRDNARTPMQWSKDTHAGFSKAQETWLPVNPNYQDINVADALADPDSIFYTYQKLIALRKEQDWLVEADYHLLPTADKVFAYQRQLGEETYVIVVNVSDEEQVFAKDLAGAQVIIANTDVDTVLETKHLQPWDAFCLKLKA

SEQ ID NO: 17752 - protein, 218 aa, Solanum lycopersicum
MAGYRGDDEYDYLFKLVLIGDSGVGKSNLLSRFTKNEFNLESKSTIGVEFATKSLNIDGKVIKAQIWDTAGQERYRAITIAYYRGAVGALLVYDVTRHVTFENVNRWLKELRDHTDPNIVVMLLGNKSDLRHLVAVSTEEAKSLAEREALYFMETSALEATNVENAFTEALTQIYRIVSKKAVEAGDEGATSTAPPKGQTINIKDEGSAWKKFGCCSS

SEQ ID NO: 17753 - protein, 527 aa, Shewanella oneidensis
MLDANLKNQLQTYLQNLKRPVELVVSADESKKSQELKSLVNDIVSLSTFVSLKEAQGQRTPAMTVVNPALNTQISFAGLPMGHEFTSLVLALLHSGGHPIKLSDDIIEQIRNLPGKYEFETYVSLTCQNCPDVVQALNMMAAINPNITNVMIDGALFQDEVASRNIMAVPSVYLNGEVFAAGRISIGEILNKLDTGAASRKAEELSQKAPYEVLVVGGGPAGAAAAIYAARKGLRTGIVADKFGGQVAETVGIENFISVKATEGPKLVANLEAHVRDYEVDIMDNQKAVKLASDGLFELELASGAKLRSRTVLLATGARWREMNVPGEKEYRGKGVAYCPHCDGPLFKGKRVAVIGGGNSGIEAAIDLANIVEHVTVLEFDSKLRADDVLQRKAASMGNIKIITQAMTTEVTGDGTRVNGLNYTDRATGESHHIALAGIFVQIGLVPNAEWLKGTVDLTPRGEIIVDERGQTSVPGVFAAGDVTNSPYKQIIIAMGSGANASLGAFDYLIRHSDDSTETKTTDTKAA

SEQ ID NO: 17754 - protein, 182 aa, Bdellovibrio bacteriovorus
MSTLNHIEFNTADGKKATLADYSGKVLLVVNVASECGLTPQYEGLEKIHQKYESQGLRVLAFPANEFGAQEPGSNEQIQEFCRTQFGVKFPVFAKMVVKGEGQHPLYQQLTTLQPAAQQVPGGKLKSVLEEHGLLSGGPSDIMWNFEKFLIGKSGNVVARFAPDMTPEDPTIVKAIEAELAR

SEQ ID NO: 17755 - protein, 479 aa, Glycine max
MNSDQFQKNSMFVETPEDGGKNFDDDGRVRRTGTWITASAHIITAVIGSGVLSLAWAIAQMGWVAGPAVLFAFSFITYFTSTLLADCYRSPDPVHGKRNYTYSDVVRSVLGGRKFQLCGLAQYINLVGVTIGYTITASISMVAVKRSNCFHKHGHHVKCYTSNNPFMILFACIQIVLSQIPNFHKLWWLSIVAAVMSFAYSSIGLGLSVAKVAGGGEPVRTTLTGVQVGVDVTGSEKVWRTFQAIGDIAFAYAYSNVLIEIQDTLKSSPPENKVMKRASLIGILTTTLFYVLCGCLGYAAFGNDAPGNFLTGFGFYEPFWLIDFANICIAVHLVGAYQVFCQPIFGFVENWGKERWPNSQFVNGEHALNFPLCGTFPVNFFRVVWRTTYVIITALIAMMFPFFNDFLGLIGSLSFWPLTVYFPIEMYIKQSKMQRFSFTWTWLKILSWACLIVSIISAAGSIQGLAQDLKKYQPFKAQQ

SEQ ID NO: 17756 - protein, 486 aa, Unknown
  Candidatus Kuenenia stuttgartiensis
MKKMMLINPHKPGRHGEESITVIVQMPLNLAYIKALTPGDWEFDVIDENIELAIDDNGELTFAPVDLVCITSVTYQSPRAYKIATACKRKGMTVIMGGIHASVMPEEASKYVDTVFIGEAEEVWPRVIKDFEAGKLKKVYDGGLPPLNLMKRVFPDREFLRKKYNYKFSSIVTTKGCPNYCDFCSVPTFQGRKFRERPYEDVLEELAATDYKGLMLAEDNFYGHGKRSNERARNLFKGMVERNLQKDWLGFTALNISQDKETLDYMAKSGCFGMLMGIESTNETVLEKMNKQVNLKLGTESYYDCIQKIHDAGLVTWGSVVFGADGDGKDSFKRMTDFILENNIDILTFGINCPFPKTQLYKRLDSEKRIFRKNYPDDWEYYDTAHVVHRLVDMTLEDFIEGMQYVYDHIYAGDNLRKRFRNSIKTTNNPRNSMFAFRVGSDWQQVFDQVLENLRLLYDSGDYYKDYYKSNSVSVSKKPLVESITT

SEQ ID NO: 17757 - protein, 353 aa, Solanum sessiliflorum
DAWDTSVAIEVKVGDSIEIVRFFHCYKRGVDRVFVDHPMFLEKVWGKTGSKIYGPKAGQDYLDNELRFSLLCQAALEAPRVLNLNCSKYFSGPYGEDVLFIANDWHTALIPCYLKSLYQSRGIYLNAKVAFCIHNIAYQGRFAFSDFPLLNLPDEFRGSFDFIDGHEKPVKGRKINWMKAGILESDRVVTVSPYYAQELVSAVDKGVELDNVLRKTSITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEELYPNKAKGVAKFNVPLAHMITAGADFMLVPSR

SEQ ID NO: 17758 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLTGPKAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 17759 - protein, 105 aa, Glycine max
  misc_feature (76)..(76): Xaa can be any naturally occurring amino acid
MASGSLKNMLSVAMNQGVVEARARIFGHQLNPTGMKTPHKLLRMKLFGEKVAQWYPHDIKKDDPLVMARQEQEAVXRLSKLEMLKRRGKGPPKKGQGRRAAKRNK

SEQ ID NO: 17760 - protein, 444 aa, Bacteroides fragilis
MNAAKVLEDLKRRFPNEPEYHQAVEEVLSTIEEEYNKHPEFDKANLIERLCIPDRVYQFRVTWVDDKGNVQTNMGYRVQHNNAIGPYKGGIRFHASVNLGILKFLAFEQTFKNSLTTLPMGGGKGGSDFSPRGKSNAEVMRFTQAFMLELWRHIGPETDVPAGDIGVGGREVGFMFGMYKKLSHEFTGTFTGKGREFGGSLIRPEATGYGNIYFLMEMLKTKETDLKGKVCLISGSGNVAQYTAEKVLELGGKVVTMSDSDGYIYDPDGIDRAKLDYIMELKNLYRGRIREYAETYGCKYVEGARPWGEKGDIALPSATQNELNGDDARKLVANGVIAVSEGANMPSTPEAIKVFQDAKILYAPGKAANAGGVSVSGLEMTQNSIKLSWSSEEVDEKLKSIMKNIHEACVQYGTEPDGYVNYVKGANVAGFMKVAKAMMAQGIV

SEQ ID NO: 17761 - protein, 241 aa, Burkholderia thailandensis
MTVYFIGAGPGDPELITVKGQRLVRNCPVILYAGSLVPAAVLDGHRAELVVNTAELDLDAIVALLVQAHGKGQDVARVHSGDPSLYGAIGEQIRRLAALGIPYEIVPGVTATAACAAALGVELTLPGVAQTVILTRYAGKTTMPEGESLASLAAHRATLAIHLGVRHLARIVEDVLPHYGADCPIAVIYRASWPDEARVTGTLADIVDKVAGTRIERTALILIGRVLDAEGFDESTLYAKG

SEQ ID NO: 17762 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGLNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKDEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 17763 - protein, 530 aa, Gibberella zeae
MSGAVARLAHLNLGAPQQQHTSSTSPLSSNANQNATNADNAPSADLGLIGLAVMGQNLILNMADNGFTICAFNRTVSKVDRFLENEAKGKSIVGAHSVEEFVSKLKSPRRIMLLVQAGKAVDEWIEKILPLLDAGDIIIDGGNSHFPDSNRRTKYLAEKSIRFVGSGVSGGEEGARYGPSIMPGGNEEAWPYIKDILQSISAKSDGDACCEWVGDEGAGHYVKMVHNGIEYGDMQLICEAYDIMKRGLGLSSKEIGDVFAEWNKGVLDSFLIEITRDIMYYNDDDDTALVEKILDKAGQKGTGKWTAVNALDLGMPVTLIAESVLSRCLSAIKDERATASTKLEFVSRTTKFEGDKKQFIDDLEQALYASKIISYAQGFMLMQEAAREYGWKLNKPSIALMWRGGCIIRSVFLKDITHAYRSQPDLQNLLFDDFFNKAIHKAQPGWRDVIAKAALLGIPTPAFSTALSWFDGYRTKDLPANLLQAQRDYFGAHTFRIKPEHASEKYPNGQDIHVNWTGRGGNVSASTYQA

SEQ ID NO: 17764 - protein, 445 aa, Escherichia coli
AVMGRNLARNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILSKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKGEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 17765 - protein, 353 aa, Solanum tenuispinum
DAWDTSVAIEVKVGDSIEIVRFFHCYKRGVDRVFVDHPMFLEKVWGKTGSKIYGPKAGQDYLDNELRFSLLCQAALKAPRVLNLNCSKYFSGPYGEDVLFIANDWHTALIPCYLKSMYQSRGIYLNAKVAFCIHNIAYQGRFAFSDFPLLNLPDEFRGSFDFIDGHEKPVKGRKINWMKAGILESDRVVTVSPYYAQELVSAVDKGVELDNVLRKTSITGIVNGMDTQEWNPATDKYTDVKYDITTVMDAKPLLKEALQAAVGLPVDRRIPLIGFIGRLEEQKGSDILVAAIHQFIGLDVQIVVLGTGKKKFEQEIEQLEVLYPNKAKGVAKFNVPLAHMITAGADFMLVPSR

SEQ ID NO: 17766 - protein, 176 aa, Thermus thermophilus
MPEEIATLAGGCFWCTEAAFKLLRGVLEVVPGYAGGHVPHPTYEEVCTGTTGHREAVQVRFDPGVLPYADLLRYFFAVHDPTSEDRQGPDVGPQYSPAIFYHSEEQKRVAEAVMRELAPLYPKPIATKLLPFTTFYPAEAYHRDYFARHPEAPYCRFVIAPKLEKARKAFKSLLRP

SEQ ID NO: 17767 - protein, 507 aa, Oryza sativa
GIPHTFCSSPFLAAPPHPPLSLSLCFGLSYSLLGFSSCSALWREEDRARAARLSMEWVRGKCVGRGAFGAVHVAVDRATGRAFAVKSVEAKGGAPAAAMACLESEIRILRRLSSPYVVEYLGDDGDAATTRNLHMELVPGGSAAAAAAMGGLGERGARGVVRRVAAALRYLHDVAGVVHGDVKGRNVLVGCDGDGRGAKLADFGAARLVSDAAVSRGPRGTPAWMAPEVARGGAPTPASDVWSLGCTAVELITGKRPWSELGGASEVGELLFLIGFGGKRPELPACASDSCRDFLDKCLRRDAGERWTCDQLLRHPFLSAADVHDGGEPSPFPSPRAVLDWAAASMSDSDSDDSGGAEARSEHEMMARAKGRLVELASNASWGREWGAGPTWEAADTWAPPSSPDTTATNAPVPSNPAAVADAGGPPAVIAGGRDSVLAVATAGAGRDRCDSQHGHYKCELARTRRARLAVASVAAVMYSYLIDSIIFWVQFKPPFSLQKKRGLQPG

SEQ ID NO: 17768 - protein, 637 aa, Glycine max
  misc_feature (50)..(50): Xaa can be any naturally occurring amino acid
  misc_feature (67)..(67): Xaa can be any naturally occurring amino acid
NQLSTQVLNPPKPVVTVFGASHHDRTNHLMPLCTYSPQEIDSGFYNFSHXQNLDKVYAIRLCKRDVXPNECRSCLNNSRVKLTRLCPKQFEAIKWEEKCMLRYSNRAIFHTMDASFSYPMSNINNATDAEEFNKVLGELLRNLSDKAASGDSRRKYAADTAVFANLQTIYGLVQCTPDLSRQDCGDCLHWSLADFGNVFKNKVGAVVLRPSCNVRYEIYPFYDEPTPSASVPLSLKEKGNSLRTTIAIVVPTVLVVVALLIFISIYFRRRKLARKNLLADEDDDEIELAESLQFNLDTIKVATNNFSDSNKLGEGGFGAVYQGRLSNGQVIAVKRLSSDPGQGGVEFKNEVLLLAKLQHRNLVRLLGFSLEGKEKLLVYEFVPNKSLDYFIFDPTKKARLDWDRRYKIIRGIARGLLYLHEDSRLRIIHRDLKASNVLLDEEMIPKISDFGMARLIVAGQTQENTSRVVGTYGYMAPEYIMHGQFSIKSDVFSFGVLVLEIVSGQKNHGIRHGENVEDLLNFAWRSWQEGTVTNIIDPILNNSSQNEMIRCTHIGLLCVQENLANRPTMANVALMLNSCSITLPVPTKPAFFMDSATTSLPNMSWEVNSGTTRSNQSTTKSAHDSVSEASISELYPR

SEQ ID NO: 17769 - protein, 910 aa, Zea mays
MAAVEPRQFGRLEPGSSPVRVATNGAKAYPPPASHLPRRADSPVRGCSFPPLVSPPRRLDDASDDEDEEQEDWRELYGSHLQLEVEPAVQDARDEGTADAWIERNPCLVRLTGKHPLNCEPPLARLMHHGFITPAPLHYVRNHGAVPRGDWATWTVEVTGLVRRPARLTMEELARDFPAVEIPVTLACAGNRRKEQNMVQQTVGFNWGAAGVSTSVWRGARLRDVLRRCGIVPRKGGALNVCFEGAEDLPGGGGSKYGTSVTREWALDPSRDIMLAYMQNGEPLLPDHGFPVRVIIPGCIGGRMVKWLKRIIVTPAESDNYYHFKDNRVLPSHVDAELANAEAWWYKPEYIINELNINSVITTPGHDEILPINSITTQRGYTMKGYAYSGGGKKVTRVEVTLDGGETWLVCHLDHPEKPNKYGKYWCWCFWSVEVEVLDLLGAKEIAVRAWDQSLNTQPEKLIWNLMGMMNNCWFKVKVNVCRPHKGEIGLVFEHPTQPGNQPGGWMARQKHLETAEAAAPGLKRSTSTPFMNTTDVGKQFTMSEVRKHASQESAWIAVHGHVYDCTKFLKDHPGGADSILINAGTDCTEEFDAIHSDKAKALLDTYRIGELITTGTGYSSDNSVHGGSVLSHLAPIREAVRAPALSNPRDKIHCRLVGKKELSRDVRLFRFSLPSPDQVLGLPIGKHIFVCASIEGKLCMRAYTPTSMVDEIGHFDLLVKVYFKNEHPKFPNGGLMTQYLDSLPVGSYIDVKGPLGHVEYTGRGSFVINGKQRHASRLAMICGGSGITPMYQIIQAVLRDQPEDHTEMHLVYANRTEDDILLRDELDRWAAEYPDRLKVWYVIDQVKRPEEGWKYSVGFVTEAVLREHVPEGGDDTLALACGPPPMIQFAISPNLEKMKYDMANSFVVF

SEQ ID NO: 17770 - protein, 294 aa, Saccharomyces cerevisiae
TTPLVHVASVEKGRSYEDFQKVYNAIALKLREDDEYDNYIGYGPVLVRLAWHTSGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDADYVRTFFQRLNMNDREVVALMGAHTLGKTHLKNSGYEGPWTANNNVFDNSFYLNLLNEDWKLEKNDANNEQWDSKSGYLQLPTDYSLIQDPKYLSIVKEYANDQDKFFKDFSKAFEKLLENGITFPKDAPSPFIFKTLEEQGL

SEQ ID NO: 17771 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKVQRVAASKVLSGPKAQPAGDKAEFIEKVRRALYLGKIVSYAQGFSQLRAASDEYHWELNYGEIAKIFRAGCIIRAQFLQKITDAYVENAGIANLLLAPYFKKIADEYQQALRDVVAYAVQNGIPVPTFSAAVAYYDSYRAAVLPANLIQAQRDYFGAHTYKRT

SEQ ID NO: 17772 - protein, 136 aa, Solibacter usitatus
MPLERANGNARSVLVVEDSENSAAMLEIAFLGIPNVAVLLTESAVEAMRILDSGDAHVNVIVTDLNMPRMDGFELIRRVRADCRLANLPIIVVSADTDPTTPSRVAELGVDAFFPKPFSPAQVRRKLEQLLDGRTP

SEQ ID NO: 17773 - protein, 420 aa, Solibacter usitatus
MLATATTPMNAYDVALENFDLAANALGLDDSIRAMIKYPERILSVSVPVRMDTGKIVRFEGYRVQHSTMRGPAKGGIRFHPNVTMDEVKALATWMTWKCAVVNIPYGGGKGGVTCNPKELSMGELERMTRRYASSILPIIGPEKDIPAPDVYTTPQIMAWIMDTYSMNKGYPVHGVVTGKPLSIGGSLGRNEATARGVFYTTMSSCEHLGIQLAGSRVVVQGFGNAGAIAADLFHGAGAKVLAVSDTSGCIFNKNGLHIPAVVAYKARTGRLEGFPEATRITPAELLALECEILVPAALENAITEENAHTIHAKIISEAANGPVTPEADRILGSKGIFLIPDILCNAGGVTVSYFEWVQDENHLFWDEQDVNAKLEKIMKRSFADVLKIHLDKKVDMRLAANMLGVSRVAEACKVRGLYP

SEQ ID NO: 17774 - protein, 159 aa, Prochlorococcus marinus
MQVDVQNTTVLSADGSSIKLGEYSGEVILVVNVASYCGNTAQYDDLQKLHDLYASKGLRILAFPCNDFGKQEPDSISEIKDFCTTKYGVKFEIYEKVHAKGNTTEPYTTLNKVEPEGDVEWNFEKFLIGKDSKVIARFKPGVKPFDENLIAAIEVALDS

SEQ ID NO: 17775 - protein, 128 aa, Heliobacterium gestii
MKEIVAFIRRHQVPATKKALEEAGFPALTIQSVEGRGKQKGIGGWAAEVDPELNQFTSTALQSMEPEIKWIPKRMLTIIVQDDQVPAAVDAIMAANKTGHIGDGKIFVCPLEEVVRVRTQERGSEAVI

SEQ ID NO: 17776 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWELNYGEIAKIFRAGCIIRAQFLQKITDAYVENAGIANLLLAPYFKKIADEYQQALRDVVAYAVQNGIPVPTFSAAVAYYDSYRAAVLPANLIQAQRDYFGAHTYKRT

SEQ ID NO: 17777 - protein, 221 aa, Capsicum annuum
MGVCYGMMGNNLPSHSEVIQLYKSRNIGRLRLYDPNHGALNALRGSNIEVILGLPNVDVKHISSGMEHARWWVQKNVKDFWPDVKIKYIAVGNEISPVTGTSSLTSFQVPALVNIYKAIGEAGLGNDIKVSTSVDMTLIGNSYPPSQGSFRNDVRWFTDPIVGFLRDTRAPLLVNIYPYFSYSGNPGQISLPYALFTAPNVVVQDGSRQYRNLFDAMLDSV

SEQ ID NO: 17778 - protein, 1119 aa, Unknown
  Nostoc sp. PCC 7120
MTQDELLVLIEQAATEGWRELDLSGQELTELPGEIGKLQQLESLILGKQVGGYEKVGYRIFQKALGNNLKTLPIELLSLPNLRKLDISGNPLEGIPDVVMQILHLEELILIRVQLTEIPEALAKLTNLTQLILSDNQITEIPEALAKLTNLTQLNLSYNQITEIPEALAKLTNLTQLNLSYNQITEIPEALAKLTNLTQLNLRGNQRTEIPEALAKLTNLTRLNLSYNQRTEIPEALAKLTNLTQLILSDNQIKEIPETIAKLTNLTHLILSGNQIKEIPETIAKLTNLTQLGLDGNQIKEIPEAIAKLTNLTQLGLDGNQIKEIPEAITKLTNLTHLILSGNQIKEIPETIAKLTNLTQLALSSNQITEIPEVLAQLTNLTQLFLSSNQITQIPEALAPLTNLTTLHLRVNQITQIPEAIESLPKLELLDLRGNPLPISPEILGSVYQVGSVEEIFNYLRLLRSGEVRPLNEAKLLLVGQGSVGKTSLIERLIHNKYDRNQPQTDGLKVETWNVQVNSKDIRLNVWDFGGQEIYHATHQFFLTKRSLYLLVCNCRTSEEENRIEYWLKLIESFGGQSPVIIVGNKKDEQPLDINRKALREKYPNIQAIIETSCQDNIGIDELRTAILQQVGNLKEVYDLLPLSWFEVKQQLESMSQDFITYSSYIGICYENKIPEEHNQEQLIDLLHRLGLVLNFREHPILRDTNVLKPNWVTEGIYALLSDENLKTKSKGIFTPADLTRVLNPERYPTKRHGYLIELMKEFELGFELACYPPQFLIAGLLPKDQPDATELEGETLEFQYHYKVLPESIISRFIVNTHERIHNQIYWRSGVMLQYQQHNEIYNIARIKADPEDKKIFIAISGRKETRRSFLAILRDVFQKIHKSLANLEITEWVPVPGYPNHPPLDYQELLGLETMGILEYPIGKLKININIRQLLDGYESLESRRKLQKGDHDLDDRTAYEDILDIAKLAVSRPIITKAEAKAVSENPQFTNNLQGANIANFANEVKDNASQQASNFNQTSGANIAEIMQLINNLRQTVAQFPPEIRDDIIIDIDDVEVEIQKPEKERNTPKLKKRLAALLTAASVAAAPIASVVDFTNNVMELGSKLGIELIQPSP

SEQ ID NO: 17779 - protein, 284 aa, Sorghum bicolor
MSGAAEEALLREYVIGEEVGRGRFGTVRRCYAASTGEPFALKTTPKAALRELEADPLDLALAEQEPKVHLLASAASRHVVALHAAFEDADAVHLVLDLCAGGDLFALVSARGPLPEPEAAGLVAQLADALAGCHRRGVAHRDVKPDNLLFDASGALRLGDFGSADWFGDGRPLTGLVGTPYYVAPEVVAGREYTEKVDVWSAGVVLYMMLSGTVPFSGATAGDVFQAVLRGNLRFPPRAFPAVSPEAKDLMRRMLCKDVWRRLSAEQVLSHPWIVTRGGSVAVA

SEQ ID NO: 17780 - protein, 625 aa, Cryptomeria japonica
MSCSARLVVDSYTHSRVPLGESSQWRHQSLSRTSNSHRLHRHVDIRARVVTPTTPIEQKPIIQTSTPTSNSTSTSLTWRSDPDRRFEIPNRVFPGMWEKKSKSESCGWNPVQRLAAAALDAVEKSFITALEKKFPLPKTADPEIQMAGNFSPVPESPVQHELEVVGQIPQCLEGVYVRNGANPLFEPLAGHHFFDGDGMVHAVRLKQGIASYCSRFTRTYRLVEEEKLGRAFYPKAIGELHGHSGIARLMLYYARSMFGLVDRSKGMGVANAGLIYFNGRLLAMSEDDLPYAVRVTEDGDLATVGRFDFDGQLQSAMIAHPKIDPETKELFALSYNVIKKPYLKYFMFSPDGRKGPDVTISVKEPTMMHDFAITDKYVVVPDQQLVFKLQEMVAGGSPVIYDKEKVPRFGILPKYDSDESRMKWIEVPDCFCFHLWNAWEENEDEVVVIGSCMTPPDSIFNESDAALRSVLSEIRLNLKTGKSSRRQLAPMNLEAGQVNRNKLGRKARYVYLAIAEPWPKVSGIAKVDLEAESPERVVGKIEYKKGCYGGEPFFVPRTSNPEAPEDDGYVLTFMHNEETWQSELLILDAKSPTLEPVASVKLPSRVPYGFHGTFITSQELDQQVL

SEQ ID NO: 17781 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTKWNNGELSSYLIDITKDIFTKKDEDGNYLVDVILDEAANKGTGKWTSQSALDLGEPLSLITESVFARYISSLKAQRVAASKVLSGPKAQPAGGKAEFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 17782 - protein, 318 aa, Cucumis sativus
  misc_feature (125)..(125): Xaa can be any naturally occurring amino acid
MDFPVINMNNLNGESRVSFLNQINDVCENWGFFELVNHGIPHELMDKVEKMTKEHYRKCMEQRFKEMVASKGLDSVETEINDTDWESTFFLRHLPVSNMSEIGDLDEEYKKVMKEFAAELEKLAXEILNLLCENLGLEKGYLKKVFYGSKGPNFGTKVSNYPPCPKPELIKGLRAHTDAGGLILLFQDDKVSGLQLLKDGKWVDVPPMHHSIVINLGDQLEVITNGKYKSVMHRVIAQEDGNRMSIASFYNPGNDAVIYPAPALVEGEQEKTKLYPKFVFDDYMKLYMGLKFQAKEPRFEAMKAMESTNINMGPIATV

SEQ ID NO: 17783 - protein, 201 aa, Prochlorococcus marinus
MSSLRQSEIKRKTNETDISVFINLDGNGISEIDTGIPFLDHMLHQISSHGLFDLKIRAIGDTHIDDHHTNEDVGIALGKAFSKALGERKGICRFGHFFAPLDEALVQVTLDCSGRPHLSYDLQLKAPRIGNYDTELVKEFFIAFVNNSGITLHINQIRGSNSHHIVEACFKAFSRAMRMATEIDLRRSGSIPSSKGMLENQ

SEQ ID NO: 17784 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEEGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAILPANLIQAQRDYFGAHTYKRT

SEQ ID NO: 17785 - protein, 976 aa, Pisum sativum
MEHLKKSPSSSSSSSMRPSFPRDPRGSLEVFNPTSNSSSPVRSPSNLKNWTEIEEPRNELSEQHNEFSDEVTNTSWMAIKEGETGAAVQRAAEWGLMLTTDAETGKPQGVAVRNSGGDEPSVKLETKRNSNNTVRTSGESSDGDDPRGFPRVSEDLKDALSAFQQTFVVSDATKPDYPILYASAGFFKMTGYTSKEVIGRNCRFLQGADTDPDDVARIREALEGGKSFCGRLLNYKKDGTPFWNLLTISPIKDDDGNVLKLIGMLVEVNKHTEGSKEKKLRPNGLPESLIRYDARQKEKATSSVSELLEAMKRPRALSESGQRPFIRKSGGGGGSEEDEEAVENKSRRKSDSVASFRPKPQGKIRHSMERISELPENKQKNSRRGSFMGFMRKSDSIDESIDNEVIVDVSSGSEDDERDDSFEFDDKEKLREKRKGLDLATTLERIEKNFVITDPRLPDNPIIFASDSFLELTEYSREEILGKNCRFLQGPETDPATVRKIREAIDNQTEVTVQLINYTKSGKKFWNLFHLQPMRDHKGEVQYFIGVQLDGSQHVEPLHNCIAEDTAKEGELLVKETAENVGEAVKELPDANQKPDDLWMNHSKVVRPKPHRKDDDAWRAIQKVLENGEQVGLKHFRPIKPLGSGDTGSVHLVELEGTGQYFAMKAMDKGVMLNRNKVHRACTEREILDMLDHPFLPALYASFQTKTHVCLITDYYSGGELFLLLDQQPTKVLKEDSVRFYAAEVVIALEYLHCLGIIYRDLKPENVLIQSNGHVSLTDFDLSCLTSCKPQLILPAIEEKKKRKKKKNKGQQKNQQVPMFMAEPMRASNSFVGTEEYIAPEIITGSGHTSAVDWWALGILLYEMLYGYTPFRGKTRQKTFANILHKDLKFPKSKPVSPHGKQLIYWLLHRDPKNRLGSLEGANEIKNHPFFKNINWALVRCTKPPELDGPILLDNDEKKEAKEIDPGLDDLQKNIF

SEQ ID NO: 17786 - protein, 478 aa, Prochlorococcus marinus
MNKPRILFWHRKDLRIFDNQSLIKAFSLSNAITSTYIFDKNYPHDFNANSRAWFLGNSLQELGNNWKKMGSRLIMEEGDPVLIIPQLAKKIDAKFVFWNKSIEPYEINRDLKIKKNLEEQNIQVIETWDHLLIEPLKIFSGNNKPYSVYGPFYKNLKSKMNLLGPYDQDKVVFQFKDIDNKLKENKTINSSDSVLEKFIKNIKFPGSNICPCKPGENAAETILENFINEKKIYSYDSARDFPSHNGTSFLSASLRFGTISIRKIWNATLNLNSDCANRVNYLSIETWQKELVWREFYQHCLFHFPELEKGPYRKKWDHFPWQNNNEWFQHWSNGETGVPIVDAAMRQLNSTGWMHNRCRMIVASFLVKDLICNWQMGEKKFMETLVDGDLAANNGGWQWSASSGMDPKPLRIFNPYTQAKKFDPICEYIKYWIPELSKVSNSELLNGEISNLEKNNYSSPIVNHNIQQRLFKSLYAEI

SEQ ID NO: 17787 - protein, 92 aa, Brassica napus
MSNRRSRQSSSAPRISDDQIIDLVTKLRQILPEIGQRRRSDKVSASKVLQETCNYIRNLNREVDNLSERLAQLLESVDEDSPQAAVIRSLLM

SEQ ID NO: 17788 - protein, 353 aa, Solanum thelopodium
DAWDTSVVVEVKVGDRIESVRFFHCYKRGVDRVFVDHPMFLEKVWGKTGSKIYGPKTGQDYLDNEIRFSLLCQAALKAPRVLNLKCSKYFSGPYGDDVLFIINDWHTALIPCYLKSMYQSRGIYVNAKVAFCIHNIAYQGRFAFSDFPLLNLPDEYRGSFDFIDGYEKPVKGRKINWMKAGILESHRVVTVSPYYAQELVSAADKGVELDNVLRKTSITGIVNGMDTQEWNPATDKYTDVKYDITTVMDAKPLLKEALQAAAGLPVDRKIPLIGFIGRLEEQKGSDILVAAIHKFIGLDVQIVVLGTGKKKFEQEIEQLEVLYPNKAKGVAKFNAPLAHMIIAGADFMLIPSR

SEQ ID NO: 17789 - protein, 447 aa, Ulva pertusa
MFGALSKAVGSVCSRQGQAAVTGLGSVTGHQVRRAGHAENTNTFIREALAVLDLPPAMEKIVITPQREMTVELIINRDDGKPESFMGYRVQHDNARGPFKGGLRFHKDADLDDVRSLASLMSFKTALLDVPFGGAKGGITVDTKALSEHEIEKLTRKFVQEIKDIIGPFRDIPAPDVGTDGRVMAWIFDEYSKFEGYSPGVVTGKPTWLHGSHGRESATGRGTVFGIKNMLQAFGEGPPADKTFAIQGFGNVGAWAGRLLAEQGGIVKAVSDASGCVYDDGPSGIDVPKLLRHLHRGDDLSKYPHGQQLLRDEIFDVKCDVFVPAALGGVITDPVARKISCKYIVEAANGPTTPSADLILRDRGIPVLPDIYTNAGGVTVSFLEWVQNLQNFKWTTEQVNDQLKTRMDEAFQSMWDSSQEHGVPLRTGAFTVSLRRVVRATVNRGFN

SEQ ID NO: 17790 - protein, 237 aa, Oryza sativa
MAAEDELKLLGFWASPYVCRVKLALHLKGLIYDYVKEDVFTNKSELLLSCNPVHAKVPVLIHNGKPICESQVIVQYIDEVFPDAGVTLLPADPHDRAAARFWAAYIDDKLLPPWVHAYRGKTDEEKAERMKQTLAVVDALETAMEECSKGNAFFGGDTVGYVDVALGGLLSWLHGTEELCGAKILDAAKTPLLSAWARRFGELDAANAALPDVGRLVEFCKMRHVELEAAEAAAARN

SEQ ID NO: 17791 - protein, 483 aa, Saccharomyces cerevisiae
LPSSEEYKVAYELLPGLSEVPDPSNIPQMHAGHIPLRSEDADEQDSSDLEYFFWKFTNNDSNGNVDRPLIIWLNGGPGCSSMDGALVESGPFRVNSDGKLYLNEGSWISKGDLLFIDQPTGTGFSVEQNKDEGKIDKNKFDEDLEDVTKHFMDFLENYFKIFPEDLTRKIILSGESYAGQYIPFFANAILNHNKFSKIDGDTYDLKALLIGNGWIDPNTQSLSYLPFAMEKKLIDESNPNFKHLTNAHENCQNLINSASTDEAAHFSYQECENILNLLLSYTRESSQKGTADCLNMYNFNLKDSYPSCGMNWPKDISFVSKFFSTPGVIDSLHLDSDKIDHWKECTNSVGTKLSNPISKPSIHLLPGLLESGIEIVLFNGDKDLICNNKGVLDTIDNLKWGGIKGFSDDAVSFDWIHKSKSTDDSEEFSGYVKYDRNLTFVSVYNASHMVPFDKSLVSRGIVDIYSNDVMIIDNNGKNVMITT

SEQ ID NO: 17792 - protein, 443 aa, Glycine max
MEGLGGLGHLFVTMFVTGFGGVIVLPAITDVTMAALCPGQDQCSLAIYLSGFQQAMAGVGSVVMTPLIGNLSDRYGRKALLTLPLTVSVIPQVILAYSRDTQFFYAYYVVKTLAAMAGEGSFHCLALAYVADKVPDGKRTSAFGILAGVGSASFVGGTLAARFLSTALTFQVASVLSMVALVYMRIFLKDSVPGGAIRQPLLKVVEESCAEDDSTPKSAGTFKKLPSLGDFICLLKCSPTFSQAAIVSFFNSLADGGLMAVLLYYLKARFQFNKNQFADLLMITGIGATLAQLFFMPILVPVIGEEKLLSTGLLISCINVFVYSIAWTAWVPYALAGCSVFAVFVRPSLCSIASKQVGPTEQGMVQGCLSAISSFANIIAPLIFSPLTALFLSEEAPFYFPGFSLMCLGLALMVAFFQSLMIRAVPPIAGGKISGNRCTDTLV

SEQ ID NO: 17793 - protein, 445 aa, Escherichia coli
AVMGRNLALNIESRGYTVSIYNRSREKTEEVIAENPGKKLVPYYTVKEFVESLETPRRILLMVKAGAGTDAAIDSLKPYLDKGDIIIDGGNTFFQDTIRRNRELSSEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKEQRVAASKVLSGPQAQPAGDKGEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 17794 - protein, 353 aa, Solanum toliaraea
  misc_feature (257)..(257): Xaa can be any naturally occurring amino acid
DAWDTSVAIEVKVGDSIEIVSFFHCYKRGVDRVFVDHPMFLEKVWGKTGSKIYGPKAGQDYLDNELRFSLLCQAALEAPRVLNLNCSKYFSGPYGEDVLFIANDWHTALIPCYLKSMYQSRGIYLNAKVAFCIHNIAYQGRFAFSDFPLLNLPDEFRGSFDFIDGHEKPVKGRKINWMKAGILESDRVVTVSPYYAQELVSAVDKGVELDNVLRKTSITGIVNGMDTQEWNPATDKYTDVKYDITTVMDAKPLLKEXLQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSR

SEQ ID NO: 17795 - protein, 421 aa, Ulva pertusa
MFGALSKAVGSVCSRQGQAAVTGLGSVTGHQVRRAGHAENTNTFIREALAVLDLPPAMEKIVITPQREMTVELIINRDDGKPESFMGYRVQHDNARGPFKGGLRFHKDADLDDVRSLASLMSFKTALLDVPFGGAKGGITVDTKALSEHEIEKLTRKFVQIFDEYSKFEGYSPGVVTGKPTWLHGSHGRESATGRGTVFGIKNMLQAFGEGPPADKTFAIQGFGNVGAWAGRLLAEQGGIVKAVSDASGCVYDDGPSGIDVPKLLRHLHRGDDLSKYPHGQQLLRDEIFDVKCDVFVPAALGGVITDPVARKISCKYIVEAANGPTTPSADLILRDRGIPVLPDIYTNAGGVTVSFLEWVQNLQNFKWTTEQVNDQLKTRMDEAFQSMWDSSQEHGVPLRTGAFTVSLRRVVRATVNRGFN

SEQ ID NO: 17796 - protein, 537 aa, Triticum aestivum
  misc_feature (447)..(447): Xaa can be any naturally occurring amino acid
  misc_feature (459)..(459): Xaa can be any naturally occurring amino acid
  misc_feature (482)..(482): Xaa can be any naturally occurring amino acid
  misc_feature (496)..(496): Xaa can be any naturally occurring amino acid
  misc_feature (508)..(508): Xaa can be any naturally occurring amino acid
  misc_feature (511)..(511): Xaa can be any naturally occurring amino acid
  misc_feature (515)..(515): Xaa can be any naturally occurring amino acid
  misc_feature (517)..(517): Xaa can be any naturally occurring amino acid
  misc_feature (520)..(523): Xaa can be any naturally occurring amino acid
  misc_feature (527)..(527): Xaa can be any naturally occurring amino acid
LIFAGKQLEDGRTLADYNIQKESTLPPWLLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQXDKEGIPPDQATXLSLAGKQLEDGRTLADYNIQEGXTSNWCSAFVGGMQXLSKTSNGQDITXEVXPLTXIXNVXXXXKDKXGIPRTTTPFG

SEQ ID NO: 17797 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWALNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 17798 - protein, 120 aa, Zymomonas mobilis
MRGIEEALVKKIEVVIKPFKLEDVKAALTDAGISGITVTETRGYGRQKGHTELYRGAEYVVDFLPKVKLETVVPDELVENVVEAVTVAARTGRIGDGKIFISDVLDAIRIRTGERGIEAI

SEQ ID NO: 17799 - protein, 445 aa, Escherichia coli
AVMGRNLALNIESRGYTVSVFNRSREKTEEVIAENPGKKLVPYYTVQEFVESLETPRRILLMVKAGAGTDSAIDSLKPYLDKGDIIIDGGNTFFQDTIRRNRELSAEGFNFIGTGVSGGEEGALKGPSIMPGGQKEAYELVAPILKQIAAVAEDGEPCVTYIGADGAGHYVKMVHNGIEYGDMQLIAEAYALLKGGLALSNEELAQTFTEWNEGELSSYLIDITKDIFTKKDEEGKYLVDVILDEAANKGTGKWTSQSSLDLGEPLSLITESVFARYISSLKDQRVAASKVLSGPQAQPAGDKAEFIEKVRRALYLGKIVSYAQGFSQLRAASDEYNWDLNYGEIAKIFRAGCIIRAQFLQKITDAYAQNAGIANLLLAPYFKQIADDYQQALRDVVAYAVQNGIPVPTFSAAIAYYDSYRSAVLPANLIQAQRDYFGAHTYKRT

SEQ ID NO: 17800 - protein, 353 aa, Solanum tridynamum
DAWDTSVAIEVKVGDSIEIVRFFHCYKRGVDRVFIDHPMFLEKVWGKTGSKIYGPKAGQDYLDNELRFSLFCQAALEAPRVLNLNCSKYFSGPYGEDVLFIANDWHTALIPCYLKSMYQSRGIYLNAKVAFCIHNIAYQGRFAFSDFPLLNLPDEFRGSFDFIDGHEKPVKGRKINWMKAGILESDRVVTVSPYYAQELVSAVDKGVELDNVLRKTSITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHVITAGADFMLVPSR

SEQ ID NO: 17801 - protein, 445 aa, Escherichia fergusonii
AVMGRNLALNIESRGYTVSIFNRSREKTEEVITENPGKKLVPYYTVKEFVESLETPRRILLMVKAGAGTDATIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQAAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVLNGIPVPTFAAAVAYYDSYRAAVLPANLIQAQRDYFGAHTYKRI

SEQ ID NO: 17802 - protein, 353 aa, Solanum trisectum
  misc_feature (156)..(239): Xaa can be any naturally occurring amino acid
  misc_feature (333)..(333): Xaa can be any naturally occurring amino acid
  misc_feature (348)..(348): Xaa can be any naturally occurring amino acid
DAWDTSLAVEVKVGDSIEIVRFFHCYKRGVDRVFVDHPMFLEKVWGKTGSKIYGPKAGQDYLDNELRFSLLCQAALEAPRVLNLNCNKYFSGPYGEDVLFIANDWHTALIPCYLKSMYQSRGIYLNAKVAFCIHNIAYQGRFAFSDFPLLNLPDEXXXXXXXXXXXXXXXXXXXXXXXXXXXXXXXXXXXXXXXXXXXXXXXXXXXXXXXXXXXXXXXXXXXXXXXXXXXXXXXXXXXXVKYDITTVMDAKPLLKEALQAAVGLPVDRKIPLIGFIGRLEEQKGSDILVAAIHKFIGLDVQIVVLGTGKKKFEQEIEQLEVLYPNKAKGVAKXNVPLAHMITAGADFXLVPSR

SEQ ID NO: 17803 - protein, 742 aa, Unknown
  Erythrobacter sp. NAP1
MPRTAFQQLGITEGDVVEISGKRATAAIAMAAYPEDDSLDVVRLDGLQRGNAEAASGEHVEIVVAESRPATRVVFAPAQREMRLQGPAQALKRNFFKKPITAGDLVATTGQQPVQNMPPDVRQMLRAPAYALTQIRLSVHSTSPKGIVHIDENTEVELRTEFEEPRDARGMVNYDDVGGMEDTIQQLREMVELPLRYPELFTRLGVDPPKGVLLHGPPGTGKTRLAQAVANESDAEFFTINGPEIMGSGYGESEKRLREVFEEATRASPAIVFIDEIDSIAPKRSGVPGEAEKRLVAQMLTLMDGIESRANLVVIAATNRPDAIDEALRRPGRFDREIVIGVPDQRGRREILAIHTRGMPLEEAVDLSELARVTHGFVGADIAALAREAAIDAVRRIMPRLNLEERTIPQDVLEDLCVTRADFFSALKRIQPSAMREVMVQVPNVGWDNIGGVGDAIDKLKEGIELPLKNAEAFRRLGIRPAKGFLLYGPPGTGKTLLAKAVAKEAEANFISMKSSDLLSKWFGESEQQIAKLFARARAVAPCVVFIDEIDSLVPARGSGQSEPQVTGRVVNTILAEMDGLEELQSVIVIGATNRPALVDPALLRPGRFDELVYVGTPDKEGREHILGIHTKDMPLASNVDLAEIAEKTDRFTGADLEDVVRRAGLGALRRMGGDVKAVEMQDFEDALEDSRATVTPRMEAEYRRMRGELKKRAAEANPIGFFAPDSLAPARAKKHGSDEEA

SEQ ID NO: 17804 - protein, 54 aa, Zea mays
  misc_feature (11)..(11): Xaa can be any naturally occurring amino acid
  misc_feature (42)..(42): Xaa can be any naturally occurring amino acid
KDAFHLWVRVXPFHVLRINKMLSCAGADRLQTGMRGAFGKPXGTCSKVDNWQVL

SEQ ID NO: 17805 - protein, 449 aa, Pasteurella multocida
MSQVATLDAFLERVAQRDGTQPEFLQAVREVFTSIWPFLEANPKYRSQALLERLVEPERVIQFRVAWTDDQGQTQVNRAFRVQYNSAIGPFKGGMRFHPSVNLSILKFLGFEQIFKNALTTLPMGGGKGGSDFDPKGKSDGEVMRFCQALMAELYRHVGADTDVPAGDIGVGGREVGYLAGYMKKLSNQAACVFTGRGLSFGGSLIRPEATGYGLVYFAQAMLAEKGQSFAGKTVSVSGSGNVAQYAIEKALQLGAKVVTCSDSSGYVYDEAGFTTEKLAALMELKNEKRGRVEEYAKQFGLKYVAGKTPWEVKVDIALPCATQNELDLASANTLIANGVQLVAEGANMPTTIEATDAFLDAGVLFGPGKAANAGGVATSGLEMTQSSQRLYWSAEEVDKKLHSIMLDIHANCKKYGTIEGQANINYVVGANVAGFVKVADAMLAQGVY

SEQ ID NO: 17806 - protein, 1789 aa, Aspergillus nidulans
MAAPTPQLPTRFPCWCRAIYSWGGEAKSDLGFIEGDLIECLNAGDGQWWMGRLRRDRRMVGLFPSNFVQLLGEDFVPVTRATSPMLPAAASPITNPTSAPKKQKTVFRKPFQAHKEALAPSGSGGSPSSTSLVGSTIPQTPPRDGSLSRRTKTGRTPTRANRQQSSLSRPLSIARPPSRGVSPHPPPEPTPQQHDISSRSRSRPPSRAVSPRPQLPEVTHSSPLVSPAGPTYAQTSHYPSHASSSRPQLPDFGRHSPLVSPSFPMYSHVQDTHSWSRSASPRPQLPEITHHSPLSPSVPMHNHSQLSHQSSREISPLQLTEREDSPPPPPPPPHRVAVQRQPSPGPAVPRQLDMNDRYVVFTRTPSPAGHSDANGQTPSPLRDAMEDVMTSLEDMGMPRDSRSPSPQPEFDNPWSPAAFDSLRESRHPQRNNRPLTSLGFEGEKEFYHSDAVHRNSVYTHDPFIEGPPQINNYVQRMESRLRQMQEQGRRGSEDIQPPVENSEEDDDMPPPPPPRHGSYHGRHNSIPAHLPSLRSRRSGHDLRNDMLNRSFTKSSNTTNSSSGVHSNATNQTSSTDRTSQSLMSGPSAGGFSATSAGSYARRGIAAGERPSTAVDAVRSRGFSDLTRMPRPESPMSGISYHSSHNTSRQGASSAIPWSTSATTPEEPNSVFGGLATPKAKKQGFFKKILESAKTGAANARSSIAVGQSGGSFSPTKGRAISPIRSSHSHRDTAAREMGTGNNPMDWVQVRRDVNRASSPSRNERIERAERCQMMDHPVIYAVEELYETAEGEESIDGLPISEPTDFGNVNLTLVDKSARFVNSLPPMTNPLSLAQGYVCRPYKSDVQRLRAIFTWVSEKIAWDEPIEDADIDLKRVLQTKRGCAQEVAYLVREMCAAVGIHADAIEGFLKPPGEVFDLDSLSRPNHWWNAVLVDGDWRFMDCSLANPTNPIRNQFVTTNTTVAESWYFLARPLELCYTHVPLEPEGQHICPPISPDVLLALPTVCPTYFKMGLQFPDYDTSVFRIEGLEVLQVRILVPADVECAAEVEAPGFARDADGDFFESGEIVRKRALVQPDWVNGQKRITIKAVLPGDEGQGMVKVYAGRKGLMHSSRDIPHPLAFALPIIHTGENPPYEFVLRHPTPHAQRHDLYIIQPQCAKLAVNNTFVFAVRQHPSSPTPQTSSNENSFSGRISPSVFSRPASALSMVSSSAGGSTVSTVSNEFSASTSAISSTRSNSGREKPAKLAIQSPSGKILRLTRKADHMISSPKTSDSPSECTADGSVWETVIKIGEGASPLQQQAFEFTPLLIPRDDIWHLALPRLASFEWTCTYLIYIEASKREMSPRLNLPDPFATIPRVSLLYPFSSPIHPLQSLSGLASAPAPASASASASTTHSAPGSTRSQGARTEGIHVSLYAKREDHSSPLACAGNKYRKLEYIVPDILSSSPRYGAGIAADVPTPIHGKGKVTTLVTEGAIQSNHTVQVASVASRIGLESVVLLHKGTGGGLASAKDKAAFLRTGNVQIVKLLGAEVRMFEKPVAPKTQDDIVEEVLNNLRAEGKVPYWIPSGASLHPLGGLGYARCAFEIAAQEKDILGSPNDRGSGGYGIKQPRFDYIFVACGSGSTVGGLIAGFKLLEKMENSQPHEQTRGERKRRVIGILTSPTMRKRYHEERILRFARGAGKLIGLNPQTDITMDDVVLDDRFAGERYGVLDAKTNDMLSLMAEKEEVILDPVYTAKVARGMMHWVAEGEIEKDLLASPATYRGQDGEQVNVLFIHTGGQSALGAYAST

SEQ ID NO: 17807 - protein, 391 aa, Ashbya gossypii
MSLRYSTRAAILRSIVHRHVGARLQSTVGAVPEADEPAPQSQDQHLTSPQMRGLMHELANYPVEDFEQLTKVSRPLTTKEKQLDERLEDFLRRFGVENQVLKPLEENKSVAATPFTLAGGYSRYPYLAQTSADEPYSKQELFVRQMEHASHTAKLGAEIKEVYFPHTDISNPPAIEKLSISKLAAAGVHLGQSTSLWRSSTQPYIYGSYKGIHIIDLNQTLFHLKKAANVVKGVADNGGLILFLGTTEGQKPPLRRAAQRVRGCYVPSKWIPGTLTNPIEISSVWGRHEVDFEGNPTGRELTEEENISIIKPDLIIVLNPTENRNALREAMQARVPTIGIIDTDSEPSMVTYPVPGNDDSLRSVSLLVSILAKAGERGLANRKEKLAALSE

SEQ ID NO: 17808 - protein, 411 aa, Pseudomonas putida
MIKTIVIIGAGLAGATAARSLRAQGYQGKIHMVGEEACVAYDRPSLSKDVLAGKLGDPPFIMDPFWYASADIDLHLGVRVTSIDVVSRQVLFESGHTLAYDRLLLATGVRARRMAIMGCELAGIHTLRDNADSFALRQVLGPGKSLVIVGGGLIGCEVATTARKAGTTVTILEAGDELLLRVLGHKIGAWCRAELELMGVRIELNAQASHFEGKGHVRAVVCADGRRVAADVVLISIGAEPADELARAAGIACERGVLVDATGASSCPEVFAVGDVAAWPLRAGGRRSLETYMNSQMQAETAAAAMLGTPVPAPQVPTSWTEIAGHRMQMIGDFGGPGEIVLRGDVQNGQPLVLFRLLDGRIEAATAINAAKEFSIATRLVVGRVPVSAKQLQDASLNLRELLKTKAQLCT

SEQ ID NO: 17809 - protein, 420 aa, Blastopirellula marina
MQNVLSVILAGGKGSRLEPLTRDRAKPAVPFGGVYRIIDFALSNCLNSGLRHIQLLTQYKGQSLDRHANTGWQRYFCRELGEFIDVIPPQQRIDEQWYQGTADAVYQNIYAMEKHRPDYVMILAGDHIYKMNYASMIDYHIENGADVTIGALRVSTEEAKSFGVMQVDADQRIVGFEEKSPTPKTIPGDPEHCLASMGIYVFNAHFLFEQLCQDATRRDSAHDFGKNIIPSIIDKQRVFAFPFRDENRKQDAYWRDVGTLDAYFEANMDLITVDPQLNLYDQDWPLRTYQPNVPPPKFVFAGSAQEGRRGCALDSIVCGGSIISGGEVERSIIGANVRVNSFAHVEDSILFEGVNIGRHTRIRRAIIDKGVHIPSGTEIGFDLEMDRRRGFTISSGGVVVIAKGDAVESMVRAEQEQVVV

SEQ ID NO: 17810 - protein, 278 aa, Glycine max
FGSRNHGVPEGVIEKIMKVTREFFGLPESEKLKSYSTDPFKASRLSTSFNVNSEKVSSWRDFLRLHCHPIEDYIKEWPSNPPSLSREDVAEYCRKMRGVSLKLVEAISESLGLERDYINRVVGGKKGQEQQHLAMNYYPACPEPELTYGLPGHTDPTVITILLQDEVPGLQVLKDGKWVAVNPIPNTFVVNVGDQIQVISNDKYKSVLHRAVVNCNKDRISIPTFYFPSNDAIIGPAPQLIHHHHHPPQYNNFTYNEYYQNFWNRGLSKETCLDIFKA

SEQ ID NO: 17811 - protein, 425 aa, Symbiobacterium thermophilum
MDVRSMARQARAAQRQLELTSPEERNAALEAIARALEARAGQIVAANRADLAAAEEAGLPGPMIARLRLDEGKLAGVIRGVRAVAELPDPLAVEPQAWIRPNGLRIQRVRVPLGVVGIIYESRPGVTVDAAVLCLKAGNAVLLKGGKEAARSNAALGEAMAAGLQEVGLPVELAQVLPSTREAAQELMAARSLVDVLIPRGGAGLIRATVEQSQVPVIETGTGVCHVYVHRAADLAMAREIVLNAKCSNPAVCNAAETLLVDREVAAPFLAEAGPALLAAGVRLRACPEALAILQETARPDLAGAGPAAVEPATEEDWAAEYLDLCLAVKVVSGLDEALAHIARYGTGHSEAIVTGDAGAADRFLRSVDAAAVYHNASTRFTDGGEFGFGAEIGISTQKLHARGPMGLAELTTYKYVVLGNGQVR

SEQ ID NO: 17812 - protein, 262 aa, Symbiobacterium thermophilum
MRERLRHCKRVIIKVGTSTLTHPGGHLHLGRMEALVRQIADLHFEGRQVILVTSGAVGAGLGRLGLAERPAEVAAKQALAAVGQGLLMQRYEGLFSEYGLVVGQVLLTREDLEDPDRRASSAQVMERLLAWGVIPIVNENDTVTSEEIRVGDNDTLSARVAALVRADLLILLSDVDGLYPADPHLHPGLSPIPWVSPDDDLDRFAGGPGSANGTGGMVTKVAAARICAEHGIPMVLACGERPDVLRQILAGEEIGTLFSREG

SEQ ID NO: 17813 - protein, 318 aa, Neurospora crassa
MGKSSKDKRDAYYRLAKEQGWRARSAFKLLQLDEEFNLFENVTRVVDLCAAPGSWSQVLSRESTPAPREQVKIVSIDLQPISPLPGIITLRADITHPATVPLLLKALDPDFDPSTMNPQASHPVDLVISDGAPDVTGLHDLDIYVQSQLLFAALNLALCVLKPGGKFVAKIFRGRNVDLLYAQLKVFFEKPPEGFTANLEEPLGVGNKLAEMLAEKQAKEEPTTKSATQTPADKDGIYDVEVEDLTNEPLKDIRWVAPFVACGDLSAFDSDASYKLPDDHVSLDPVQPPTAPPYKRAIELRRQNGGAYKKTGPATAKA

SEQ ID NO: 17814 - protein, 411 aa, Dioscorea tenuipes
MYNGEKINCTENRSVLHIALRAARDKVIKSDGKNVVPDVWHALDKIKEFSERIRSGSWVGATGKALTDVVAVGIGGSFLGPLFVHTALQTDPEAAECAKGRQLRFLANVDPIDVARSIAGLNPETTLVVVVSKTFTTAETMLNARTLREWISAALGPQAVAKHMVAVSTNLTLVEKFGIDPANAFAFWDWVGGRYSVCSAVGVLPLSLQYGFSVVHKFLNGAASIDDHFHSTPFEKNIPVLLGLLSVWNVSFLRYPARAILPYSQALEKFAPHIQQVSMESNGKGVTIDGVPLPFETGEIDFGESGTNGQHSFYQLIHQGRVIPCDFIGIMRSQQPIYLKGEVVSNHDELMSNFFAQPDALAYGKVAEQLLNEKVPDHLIPHKTFPGNRPSLESSITFIKCLQRWTVTSNI

SEQ ID NO: 17815 - protein, 537 aa, Glycine max
  misc_feature (205)..(205): Xaa can be any naturally occurring amino acid
  misc_feature (217)..(217): Xaa can be any naturally occurring amino acid
  misc_feature (220)..(220): Xaa can be any naturally occurring amino acid
MYRSSNIVARIFDRQICTPAPGTSVHHARRFYENLVPSHTVYEVECPDHSFRKFTDDGQYLISFSRNHQELIVYRPRWLSFSCKDEDCDKHDLPSRAKRFDSFFSQLYCVPLASCNELICKDFFLYMESNQFGLFATSTAQIHDAPAVGGAVHGVPSIEKITFHLLRLEDGEILDKKVFSNDFVNLTHNMGVFLYDDLLAIVSLXRYQTIHILQIRXSGXLVDVRAIGEFCREDDELFLNSNAQGMAFSDKNKQLQLPGNHIENHMHQGQPNLGNSFLSGIKQRLLSFIFQGLWNEERDDTLRIQRLRKKFYFHFQDYVDLIIWKVQFLDRHHLLIKFGSVDGGVSRNADHHPAFVAVYNMDTTEIVSFYQNSADELYLLFEQFCDHFHATSRNSMYMNFISSHSNNIHALEQLRSIKDKASSSAQFVKKMLASLPFSCQSQSPSPYFDQSLFRFDDKLISATDRHRQSTDHPIKFILRRYPYSLKFKIKPGPEAGSMDGRAKKISSFLFHPILPLALSVQQTLFLQPSVVNIHFRR

SEQ ID NO: 17816 - protein, 567 aa, Dioscorea tokoro
  misc_feature (238)..(238): Xaa can be any naturally occurring amino acid
MATSTLICETPQWKDLNDHVEEIKKTHLRDLMQDSDRCKSMITEFDGIILDYSRQRVLPATVEKLFQLAEVACLKQKIDRMYNGEKINCTENRSVLHIALRAARDKAIKSDGKNVVPDVWHVLDKIKEFSERIRSGSWVGATGKALTDVVAVGIGGSFLGPLFVHTALQTDPEAAECAKGRQLRFLANVDPIDVARSITGLNPETTLVVVVSKTFTTAETMLNARTLREWISAALGPXAVSKHMVAVSTNLTLVEKFGIDPANAFAFWDWVGGRYSVCSAVGVLPLSLQYGFSVVHKFLNGAASIDDHFHSTPFEKNIPVLLGLLSVWNVSFLRYPARAILPYSQALEKFAPHIQQVSMESNGKGVSIDGVPLPFETGEIDFGEPGTNGQHSFYQLIHQGRVIPCDFIGVMRSQQPIYLKGEVVSNHDELMSNFFAQPDALAYGKVAEQLLNEKVPDHLIPHKTFPGNRPSLSLLLPSLNAYNVGQLLAIYEHRIAVEGFVWGINSFDQWGVELGKSLASQVRKQLHLSRTKAEPVEGFNFSTTTLLTRYLEAETGVPSDQSQLPKL

SEQ ID NO: 17817 - protein, 343 aa, Unknown
  Nostoc sp. PCC 7120
MVNQNLTATEIGFTHEDFAALLDKYDYHFSPGDVVPGTVFSIEPRGALIDIGAKTAAYIPIQEMSINRVDAPEEVLQSNETREFFILTDENEDGQLTLSIRRIEYMRAWERVRQLQAEDATVRSGVFATNRGGALVRIEGLRGFIPGSHISTRKPKEELVGEELPLKFLEVDEERNRLVLSHRRALVERKMNRLEVGEVVIGTVRGIKPYGAFIDIGGVSGLLHISEISHEHIDTPHSVFNVNDEVKVMIIDLDAERGRISLSTKQLEPEPGDMIKNRDLVYDKAEEMAAKYREQLLAKQQGITLPAEGAEDLIEEEIPPATEDAVAEEEIVAVEEIPAAIEE

SEQ ID NO: 17818 - protein, 360 aa, Streptococcus thermophilus
MRKNIVFFCFVRKNIKGDRMMKKQKIAVLGPGSWGTALAQVLNDNGHEVRIWGNIPEQIDEINEKHTNTRYFKDVILDENIKAYKELSEALDSVNAILFVVPTKVTRLVAKQVAELLDHKVVVMHASKGLEPGTHERLSTILEEEIPSEMRSEIVVVSGPSHAEETIVRDITLITAASKDLETARYVQGIFSNSYFRLYTNSDVIGVETAGALKNIIAVGAGALHGMGYGDNAKAAVITRGLAEITRLGVKLGADPLTYSGLSGVGDLIVTGTSIHSRNWRAGDALGRGEKLEDIERNMGMVIEGISTTKVAYEIAQELGVYMPITTAIYKSIYEGADIKESILNMMSNELRSENEWDKK

SEQ ID NO: 17819 - protein, 994 aa, Propionibacterium acnes
MTDHAENRCGLEGPRPFSSRHVGSVEDDLRYIAETIGVTSPEQIIRDAIPASVLDSNEGDSSVRTPSFPPAADETTARAELVEIASGNRVTRALIGRGYYGTLTPPVIRRNILENPSWYTAYTPYQPEISQGRLEMLTIYQQLITDLTGLALANSSLLDEATAASEGMLLARRAARKVKSNRFLVHTHLFDQVRDVVLGHAEATGIEVVETDLRDPQSWRPEVEAGCFGVLAPYPDSTGALWNPSEVFDAVHKVGGITIAECDLLSLTLLAPPGELGADVAVGSSQRFGVPMGNGGPHAAYMSVRSGLERQIPGRLVGVSTDADGNPAYRLALQTREQHIRRDKATSNICTAQVLLAVVAAAYAVWHGPTGLTRIARQVTDRAHQLASALRAAGLDVADQQFFDTIRIRTKGGAKELWNRAREGGYTLDLVDGDILQISVDETVTDDELRELTQLLGGSTDEIRGPADRAWPEDLRRTSSFMTHPVFSSYHTETTMMRYLKRLADHDYGLDRGMIPLGSCTMKLNAAAEMEAMTWPAFSQMHPFAPVEDQAGSLRLIRDLEIWLAELTGYDTVSLQPNAGSQGEYTGLAAIRSYHVSRGDTERNVCLVPASAHGTNAASAASAGLRVVVVKSNDDGTIDRDDLAAKIAANEGRIAAIMITYPSTHGVYEDGVRQVCDMVHEAGGQVYIDGANFNALVGWGQFARIGGDVSHLNLHKTFAIPHGGGGPGVGPVAAKAHLAPFLPGHPLNPRNEHPLNDGGTVTHDGHAVSAAPFGSVSVLPISWAYLRLMGLKGLQFATEVAVLNANYIAHRLHDKIPILYTGQNGYVAHECILDLRPLTTETGITVDDVAKRLIDYGFHAPTMSFPVAGTLMVEPTESEDLAELDRFCDAMLAIVEEARMVQSGHWPANDNPLINAPHPAARLVADEWNHPYSRELGCYPGMRLGIQRDQERGLDVNTVTRIQAKYWPPVGRVDNTYGDRHLVCSCPPPEAFED

SEQ ID NO: 17820 - protein, 567 aa, Dioscorea tokoro
MATSTLICETPQWKDLNDHVEEIKKTHLRDLMQDSDRCKSMITEFDGIILDYSRQRVLPATVEKLFQLAEVACLKQKIDRMYNGEKINCTENRSVLHIALRAARDKAIKSDDKNVVPDVWHVLDKIKEFSERIRSGSWVGATGKALTDVVAVGIGGSFLGPLFVHTALQTDPEAAECAKGRQLRFLANVDPIDVARSITGLNPETTLVVVVSKTFTTAETMLNARTLREWISAALGPQAVSKHMVAVSTNLTLVEKFGIDPANAFAFWDWVGGRYSVCSAVGVLPLSLQYGFSVVHKFLNGAASIDDHFHSTPFEKNIPVLLGLLSVWNVSFLRYPARAILPYSQALEKFAPHIQQVSMESNGKGVSIDGVPLPFETGEIDFGEPGTNGQHSFYQLIHQGRVIPCDFIGVMRSQQPIYLKGEVVSNHDELMSNFFAQPDALAYGKVAEQLLNEKVPDHLIPHKTFPGNRPSLSLLLPSLNAYNVGQLLAIYEHRIAVEGFVWGINSFDQWGVELGKSLASQVRKQLHLSRTKAEPVEGFNFSTTTLLTRYLEAETGVPSDQSQLPKL

SEQ ID NO: 17821 - protein, 1320 aa, Candida albicans
MKSQSTDTLQPRISSDSLVYSSSSSSSNVYSQPKLPFARSYSSIPEQVHDPGSRQSSKNSNTNFSFSEHDDSIQEFLISPIQSDIFPYSKKPVISPVLESPEAGGDSTIVETSSPSPTKSGTVSLNSNAIGSIIGSYDYSKSSLELEKPKPVEEPVFQKDHARDHARQGSDASTISNGSEQVSKDKRFVRYAMNTQSPLVNASNKWQISNVIKWLDKNQFNNSWKETFRRNEISGNRFLELENFDKESMIWKQFSKFLQLDDDLNSVDRFIELLRKESSHELQTRKSLGGGEISPINVKHENRKSTPIYTKHMSTSSVSSSNSSSSISRPLSYVDSKPKEQLSSPSHHSFFRKHSRSTSNESKDAKKRYSSFDDNRVKSVPKNDKKSNGILSTLRKYGGDKIAKNTKQRSSTYFPSLDLPPPLESDPPAYNERKISVDSELSPKSIKSFSDDLSIDPKYLPTQHQELDLRKFHDCEPITILASKDNISFVPIVITELSNAKSHIIKALGLIDIGSITLHLTDFFHKEGEAIPDFLIPKVLKLDGLLKFYVRQELKSPEGTTTTFSTTSSDSKSYIADGNKTYPETPQYLLQAQHDSRVDYWNFKDLTSISEDPSKSLAGAKQNIDSKRNDTKQKPKEFPLKFPFANAPKKGNTVPQLQIDTSGVNNISKPPTSTGSTFQVLRKKGHEIDFDKRRKSPYESKTPKIIANIYSSSVANTKKSPISASTVMALKDDVVVQRPETISRSNSIIAKRTAPPPPGDRRVQIQRQNSILRRKPGLKSTNNVTSGSSEGSKKNISDSTDDNDSEDAFFVKPLKKKENELGNNSDNNSENDEDNDSDDDFFVKPIKKEVADVSAGKVELDDSEEDFFVKPIHKKPSHMNVRPPVEEVYNNLEKYFPYTNLDKPIIDDSPASPSPQRRPTISRTFSSANKSPVAPTSADSKNTNDEQPSLRVRRMKTIRGVANEARRKVLQMKQASPPNTFANITRENSAKLTRSNTKMWGQRVVEVTSQEIEKGFVSKLRNKNGLYQEYAWIKGELIGRGSFGDVYLGLNVTTGEMLAVKQVVCGRNNKEGIEALHKEVETMKDLNHMNIVQYLGYDQQKNIYSLFLEYVAGGSIALCLKSYGKFDETLIRFITKQILLGLEYLHSNNIIHRDLKADNLLLEVDGTCKISDFGISKRSNDIYANNANMSMQGTIFWMAPEVIDSMVEGYSAKIDIWSLGCVVLEMFAGKRPWSNEAAISVIYKTGKEKLAPPIPDDIAHLVSPVAESFINRCFTIDPKDRPTAGELLNDPFVNTLDHDFNFANTKLAEMIRYNSKRLFT

SEQ ID NO: 17822 - protein, 625 aa, Cryptomeria japonica
MSCSARLVVDSYTHSRVPLGESSQWRHQSLSRTSNSHRLHRHVDIRARVVTPTTPIEQKPIIQTSTTTSNSTSTSLTWRSDPDRRFEIPNRVFPGMWEKKSKSESCGWNPVQRLAAAALDAVEKSFITALEKKFPLPKTADPEIQIAGNFSPVPESPVQHELEVVGQIPQCLEGVYVRNGANPLFEPLAGHHFFDGDGMVHAVRLKQGIASYCSRFTRTYRLVEEEKLGRAFYPKAIGELHGHSGIARLMLYYARSMFGLVDRSKGMGVANAGLIYFNGRLLAMSEDDLPYAVRVTEDGDLATVGRFDFDGQLQSAMIAHPKIDPETKELFALSYNVIKKPYLKYFMFSPDGRKGPDVTISVKEPTMMHDFAITDKYVVVPDQQLVFKLQEMVAGGSPVIYDKEKVPRFGILPKYDSDESRMKWIEVPDCFCFHLWNAWEENEDEVVVIGSCMTPPDSIFNESDAALRSVLSEIRLNLKTGKSSRRQLAPMNLEAGQVNRNKLGRKARYVYLAIAEPWPKVSGIAKVDLEAESPERVVGKIEYKKGCYGGEPFFVPRTSNPEAPEDDGYVLTFMHNEETWQSELLILDAKSPTLEPVASVKLPSRVPYGFHGTFITSQELDQQVL

SEQ ID NO: 17823 - protein, 451 aa, Parvularcula bermudensis
MRYLPLSDQDRAEMRARIGVDRIDELFVDVPADALNPHLDLPDHQGELAVERFVSGLAAKNHAAGDGPFFAGAGAYRHHVPATVDHIIQRSEFLTAYTPYQPEIAQGTLQYLFEFQTQVATLTGMEVANASMYDGSTATAEAALMARRITKRRKVVCSGGLHPHYAAVVRTNLELIDDEVVVAPITPNGLGKIRQFIDEETSCVIVQSPDVFGNVRDIAAVAEAAHNVGALLIVVVTEAISLGLLKAPGLLGADIVVGEGQSIGNALNFGGPYVGLFAARKKHVRHMPGRLAGETVDADGRRGFVLTLSTREQHIRRDKATSNICTNSGLCALAFTVHLSLLGGEGLRRLAHLNHQAAARTADRLTAIDGVELVTPTFFNEFTVRLPSKAGPIVEALASMGIIAGVPGDRLWPEQEEFHDLLVVAVTETVSDEDIDQFGTALAQEIGRSSW

SEQ ID NO: 17824 - protein, 72 aa, Burkholderia pseudomallei
MAKDDVIQMQGEVIENLPNATFRVKLENGHVVLGHISGKMRMHYIRILPGDKVTVELTPYDLSRARIVFRAK

SEQ ID NO: 17825 - protein, 525 aa, Parvularcula bermudensis
MVMNAKGRPTQAGDTAPQQIAPPTHTGNRALLIEEPLIFESGDFSGSGVDLPEPGDSPLRLGGYEAAAAPALPGLSEPEAMRHYVRLSQKNYAIDMGIFPLGSCTMKHNPRLNERMARLPGFADIHPLQPQSTVQGALELIDRLAGWLKELTGMPAVAMSPKAGAHGEFCGMMAIRAALAARGDIATRRRVLAPESAHGTNPATAVQCGFTVDAIPADDGGRVDLAALKERLGTDVAAIMVTNPNTCGLFERDIRAIADAVHEVGGFFYCDGANFNAIMGKARPGDLGIDAMHINLHKTFSTPHGGGGPGSGPTVLADSLAPFAPLPSLISDGTGFRLIEHERDNSAGQAFGRLVAFHGQMGMFVRALTYMLSHGADGLKQAAEDAVLNANYVLARLSGVMTPAFEGHCMHEALFDDRFLKETGIGTIDFAKAMIDEGFHPMTMYFPLVVSGALLIEPTESESKQGLDVFCDALIGLAGDAQSGLVERFKAAPVYAPRRRLDETRAARQPVLRWEPKDPAALAAE

SEQ ID NO: 17826 - protein, 445 aa, Klebsiella pneumoniae
AVMGRNLALNIESRGYTVSVFNRSREKTEEVIAENPGKKLVPYYTVQEFVKSLETPRRILLMVKAGAGTDSAIDSLKPYLDKGDIIIDGGNTFFQDTIRRNRELSAEGFNYIGTGVSGGEEGALKGPSIMPGGQKEAYELVAPILKQIAAVAEDGEPCVTYIGADGAGHYVKMVHNGIEYGDMQLIAEAYALLKGGLALSNEELAQTFTEWNEGELSSYLIDITKDIFTKKDEDGKYLVDVILDEAANKGTGKWTSQSSLDLGEPLSLITESVFARYISSLKDQRVAASKVLSGPQAQPAGDKAEFIEKVRRALYLGKIVSYAQGFSQLRAASDEYNWDLNYGEIAKIFRAGCIIRAEFLQKITDAYAQNAGIANLLLAPYFKQIADDYQQALRDVVAYAVQNGIPVPTFSAAIAYYDSYRSAVLPANLIQAQRDYFGAHTYKRT

SEQ ID NO: 17827 - protein, 247 aa, Saccharomyces cerevisiae
MVHLGPKKPQARKGSMADVPKELMQQIENFEKIFTVPTETLQAVTKHFISELEKGLSKKGGNIPMIPGWVMDFPTGKESGDFLAIDLGGTNLRVVLVKLGGDRTFDTTQSKYRLPDAMRTTQNPDELWEFIADSLKAFIDEQFPQGISEPIPLGFTFSFPASQNKINEGILQRWTKGFDIPNIENHDVVPMLQKQITKRNIPIEVVALINDTTGTLVASYYTDPETKMGVIFGTGVNGAYYDVCSDI

SEQ ID NO: 17828 - protein, 352 aa, Solanum vespertilio
AWDTSVAIEVEVGDSIEIVRFFHCYKRGVDRVFVDHPMFLEKVWGKTGSKIYGPKAGQDYLDNELRFSLLCQAALEAPRVLNLNCSKYFSGPYGEDVLFIANDWHTALIPCYLKSMYQSRGIYLNAKVAFCIHNIAYQGRFAFSYFPLLNLPDEFRGSFDFIDGHEKPVKGRKINWMKAGILESDRVVTVSPYYAQELVSAVDKGVELDNVLRKTSISGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSR

SEQ ID NO: 17829 - protein, 190 aa, Xylella fastidiosa
MHTHVSHAFASKLSLLSLDRFPMSSIYTFTFTRLDGRPQALADWRGQVLLLVNVASRCGFTPQYAGLEMLWQRYRDAGLIVIGFPCDQFAGQEPGDEAKIAEFCTLNYGVDFPMAAKIKVNGADAHPLWQWLKHRRRGLFGMAAIKWNFTKFLIGRNGQPIARYSPIKSPEQLEVHIVRALGEEGGGNTH

SEQ ID NO: 17830 - protein, 693 aa, Streptomyces coelicolor
MTTPRPEYPRPHFDRSHSWLTLNGTWDFRADPAEAYSADASDGYDRAITVPFAWETPASGIAEHWLRTAWYRRTFTVPADWAGQRVVLHFGAVHHAATVWVNGTEVAHHEGGYTPFAADVTDALGDGEHQLTVRVHAPADKRDIAHGKQRSMPRDDYDGVCFTPSSGIWQSVWLEARPATHLAALRLRPNDDLTGITVEAVVHGPAADRAELRLRVRDEDTAVTATLDPDGRLATELPLSAPRLWSPEDPHLYHVDAELTSADGTDRVAAYTGLRTVTVDGESLYLNGRRLFVRGVLDQGYWPETGITAPDDAALRRDIELAAEAGYNLVRKHLKLEDPRFAHHADTLGMLLWAEPASPGRFSPASTAAFAEQIEPMVERDGNSPAIVIWGLYNEEWGLDWDIPGDPAKQRATADAYDRLKALDPTRPVVDNSGWTHVKTDLLDWHYYDESAASWATTVADLLSGERDDFPVKLGPDFVVRKKLAVPGQPLRGLPNLNSEYGGGFTGLDRAWHLRWQTQELRRHDRLAGYVYTELYDIEHESAGLLDFGRGAKDLAGVDPAHANAPTTLVLDVTPVAPGRDLLTTGPDFTVDVHVSHHGDDPVAGTVHTTWTPVYARTPDAPGDAVPGCRAEAKPYVLGAAVTVPAALPDGWTSGRLHLALVVDGTVAARTALDVDTRTDPYIGDDPQARPTA

SEQ ID NO: 17831 - protein, 57 aa, Arabidopsis thaliana
  misc_feature (29)..(29): Xaa can be any naturally occurring amino acid
MGRRPARSYRQTKGKPGPRSRNCRGVPDXEVTIHEVGRMTKSVDDFPICVQLVSRET

SEQ ID NO: 17832 - protein, 353 aa, Solanum virginianum
DAWDTSVAIEVKVGDSIEIVRFFHCYKRGVDRVFVDHPMFLEKVWGKTGSKIYGPKAGQDYLDNELRFSLLCRAALEAPRVLNLNCSKYFSGLYGEDVLFIANDWHTALIPCYLKSMYQSRGIYLNAKVAFCIHNIAYQGRFAFSDFPLLNLPDEFRGSFDFIDGHEKPVKGRKINWMKAGILESDRVVTVSPYYAQELVSAVDKGVELDNVLRKTSITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSR

SEQ ID NO: 17833 - protein, 382 aa, Triticum aestivum
  misc_feature (136)..(136): Xaa can be any naturally occurring amino acid
  misc_feature (148)..(148): Xaa can be any naturally occurring amino acid
  misc_feature (180)..(180): Xaa can be any naturally occurring amino acid
  misc_feature (234)..(234): Xaa can be any naturally occurring amino acid
  misc_feature (302)..(302): Xaa can be any naturally occurring amino acid
MAAPTSAIGFEGYEKRLDITFSEASIFADPHGRGLRALSRAQIDSVLDLARCTIVSELSNKDFDSYVLSESSLFIYSQKIVIKTCGTTMLLLTIPRILELAEELCMSLAAVKYSRGMFIFPGAQPAPHRSFSEEVXCDVLNRYFGHLXAGGNAYVIGDPAKPGQKWHIYYATEQPEQPMXVTLEMCMTGLDKKKASVFFKTSADGHVPCAKEMTKLSGISDIIPEMEVCDFEFXPCGYSMNAIDGSVFSTIHVTPEDGFSYASYDVMGMHASALGYGDIVKRVLRCYEPSEFSVAVIIFGGXGHDDYWGKSSTPRHRLQHVVEQDSPDGASDLQELEVTKSPGSAGPQVVFTGSGKNVKASLVRKQLPTPPWEGKFLGRVFF

SEQ ID NO: 17834 - protein, 214 aa, Unknown
  Synechocystis sp. PCC 6803
MTTATHLLKLAATVLLGSLVTTAPLVRAQFTAPAPQNNTSTPIPKVELNFQPLETALASQQFSQANEITRRLLLAATNRTLQGWLTTDTIEQIPCQDLKTIDQLWLQHSNNRFGFTPQLEAFLATGNRPGRLMSPESYDQFGDRIGWRKENQWVIFKKNLDFTLNAPAGHLPSPRDEYQINGGRLEYTALMGRFQVCQSGQVPTAPVRFTPFGS

SEQ ID NO: 17835 - protein, 445 aa, Bacteroides fragilis
MNIEKIMSSLEAKHPGESEYLQAVKEVLLSIEDIYNQHPEFEKAKIIERLVEPDRIFTFRVTWVDDKGEVQTNLGYRVQFNNAIGPYKGGIRFHASVNLSILKFLGFEQTFKNALTTLPMGGGKGGSDFSPRGKSDAEIMRFCQAFMLELWRHLGPDMDVPAGDIGVGGREVGYMFGMYKKLTREFTGTFTGKGLEFGGSLIRPEATGFGGLYFVNQMLQTKGIDIKGKTVAISGFGNVAWGAATKATELGAKVVTISGPDGYIYDPNGISGEKIDYMLELRASGNDIVAPYADEFPGSTFVAGKRPWEVKADIALPCATQNELNGEDAKNLIDNNVLCVGEISNMGCTPEAIDLFIEHKTMYAPGKAVNAGGVATSGLEMSQNAMHLSWSAAEVDEKLHSIMHGIHAQCVKYGTEPDGYINYVKGANIAGFMKVAHAMMGQGII

SEQ ID NO: 17836 - protein, 442 aa, Kluyveromyces lactis
MSLVPQAYLSNFHNRVKNEDVPLFTAAQLSRNKRGKQVNYAEFDTDLLDEFIDKNDEDDLEDDVDDSDGRRRGGDYYDQVDGSDGGAAAAAATAAAAAGLGEDGGIGEGTPGSGDPGAVTGGTPAADTGPDGTNDGTAGTSNPSSELDRIKLNDLPDLESQDDSATPLALLKYPRIRETFVQSRIAISYKDLLGDSIQDPQQVDIESPIMVPIRLNVEFSGHKLADFFMWNLNDHSMTPEQFATILCQDLDFPVLSNPNNSPYTQIISMINEQLQEYETLASLQVPDLHVIINLTANLDSKLYDDTFEWNLNDDSLCPEQFAELVVQDLGLQREFVPAIAHSLHESLLKVKKDWLEGNLNLAHVENKAAFGYTSGIRLDIDTLGASWFPKVEVLSQWEIEKREIEKERNMRRLKRESAKVDDGRSRRRGKRRMDDLETTLRI

SEQ ID NO: 17837 - protein, 419 aa, Desulfitobacterium hafniense
MHYVIIGNSAAGVFAAEALRGLDSSGKITMISEENNRPYSRCLTSYYIGEEIDQDRIYIRDANFYAATGIDFIPQKVEQVNDTEKSITLQSGEIVGYDKLLIATGASPYSLPVEGLDLEGVCELRTLEDARRIMDFAPHVKEAVVMGAGLVGLKGAHALHELGIKVSIIVNSRIMSRSVDPHTGQIITELLEQDGYEVIYNTKLSKILGQDKVEGVCLSSGKEIPCQLVLMAAGVSPNVDLVKNTGIEVNKGIIVDKHMQTTVSHIYAAGDVAEAYHAVWDEKRVISIWPVATAQGTVAGSNMAGVERIYEGSVGSNSAVFCGVGVVSAGIPYLPTGEGQELSTYDKATKRYRKFIVKDDILVGMIMVGDIDGAGILTAMIKQKTKVSLDTLNYWLNHPVRFQGYCTAEAKGGIVCGIC

SEQ ID NO: 17838 - protein, 973 aa, Unknown
  Marinobacter sp. ELB17
MLNYYDPGTQSYEAGKSILNPDFDFGTPARVSENLVTVSIDGREIAVPEGTSVLRAAALAGINIPKLCASDNLEPFGSCRLCAVEIEGRRGYPASCTTPVSEGMDVTTQTGKLAKLRRNIMELYISDHPLDCLTCPANGDCELQDVAGAVGLREVRYGFDGKNHLDAEIDDSNPYFSFDPSKCIVCSRCVRACEEVQGTFALTIEGRGFDSIVSASQNEPFMDSECVSCGACVQACPTSTLMEKSVIDAGQPEHSVITTCAYCGVGCSFKAEMKGEEVVRMVPYKGGEANHGHSCVKGRFAFGYATHKDRIKEPMIRESINDPWQVVSWDEALAFSAKKLRGIQTEFGRESIGGITSSRCTNEETYLVQKLVRAAFGNNNTDTCARVCHSPTGYGLKTTLGESAGTQTFDSVMKANAIVVIGANPTDAHPVFGSLMRRRLRQGAKLVVIDPRRIDVLKTPHADEGLHLPLRPGTNVAMVNAMAHVVITEGLEDKEFINSRCDTEAYNAWRTFIAEARNSPEAMEEVTGVPAAKVREAARIYAEAENGAIYYGLGVTEHSQGSTMVMGIANLALATGNIGREGGGVNPLRGQNNVQGSCDMGSFPHELPGYQHVSDPEVRERFKAVWGVEIDHEPGLRIPNMFDAAIAGTFKALYVQGEDIAQSDPNTHHVEAALKALDCLIVQDIFLNETAKFAHVLLPGSTFLEKNGTFTNAERRINRVRKVMEPIAGMEDWEVTMALSNALGYPMNYNHPSEIMDEIALLTPSFTGVNYDKLERLGSIQWPCNDEHPDGTPTMHTLDFPIGKGRFAVTEYLATEERASRRFPLLLTTGRILSQYNVGAQTRRTANSDWHEEDLLELHPSDAELRGVKEGDWLGISSRVGHTVLRAKLSTRMLPGVVFTTFHHPGSGANVITTDNSDWATNCPEYKVTAVQVEKVSQPSDWQRNFVDFDKRQQDFAKPAEEHSSDAHASALK

SEQ ID NO: 17839 - protein, 320 aa, Escherichia coli
MIKKIGVLTSGGDAPGMNAAIRGVVRSALTEGLEVMGIYDGYLGLYEDRMVQLDRYSVSDMINRGGTFLGSARCPEFRDENIRAVAIENLKKRGIDALVVIGDGGSYMGAMRLTEMGFPCIGLPGTIDNDIKGTDYTIGFFTALSTVVEAIDRLRDTSSSHQPISVVEVMGRYCGDLTLAAAIAGGCEFVVVPEVEFSREDLVNEIKAGIAKGKKHAIVAITEHMCDVDELAHFIEKETGRETRATVLGHIQRGGSPVPYDRILASRMGAYAIDLLLAGYGGRCVGIQNEQLVHHDIIDAIENMKRPFKGDWLDCAEKMY

SEQ ID NO: 17840 - protein, 569 aa, Leuconostoc mesenteroides
MTEPHIYDTIIIGGGPAGLSAGIYAGRSTMDTLIIEGDQIGGQVTTTSTVANYPAVETIDGTALVNRMQQQAKSFGVQFVFDTVTDYNFSDEVIKTVTGKKDTYHARSIIIATGAEPHQVGFQGEQDFRGRGVAYCSTCDGELFSGLEVFVIGGGYAAAEEADYLTRFARHVTIVMRSNDFTCPPLTADRARLNPNITIWPNTEIQTVAGQNYLTDATFINNKTNEQTTYHVADGDNTFGIFVYVGTDPQTKMFQHDIMLDEHKYIVTDSQGQTNIPGVFAAGDVISKPLRQIVTAASDGANAATNAELFVSEQKHRLNIPVNRSAVSSPKTDVTKGPTSTIDATDHSALPTHTGQWFAKEIIQALQPIFDKLTQDVTLHQLTDDSSKSHELSSFLEEFSQLSSHLKFKMEPTSTELESKYHVHHMPNFRLLTDNNEDTGIQFSGIPTGHELNSLVLALYNIAGPGQTIDTELVQRIQRLPKTDLNIGVSLTCHFCPDVVAACQHIAAINDNVTAEMIDLQLFPELRESHHIMSVPAMIINNSDNVIFGSQSLEEIVSAIETSSPLPVH

SEQ ID NO: 17841 - protein, 534 aa, Gibberella zeae
MRSFRASTVPKTVRQWPQRRSYAVRVPGKCQKDIKTVAELKAWGPSSPVPDVEVSGWVRSVRKSSGVRFIDITDGSSMRPVQVVVDKSLAADMRPGAAVRLKGTWVDESGKKTLASSSAQLPDTKGECETSTSPEQPELKVSEVEFLGGSDPMTYPIQNKYQSPESLRTISHLRSRTPLNSTMLRLRSDATAMLTQFFFRERFQQTHPPIITSSDCEGAGEAFVVKASSPDEFFRAPKYLTVSSQLHLEALAQSLGNVWTLSPTFRAEKSDTSRHLSEFYMLEAEMSFVDDMNEVMNLAQRMLNSLTSGLKELNAAKELKKNRVDSKEPSERLAFKDLVEQEQLDRRWQGMLTTKTWPRITYSEAIEILKPIADQFKHRPQWGAGLQSEHEKYLAERIGYDETTDAYVPVFITQYPRDIKAFYMRQSSSSPSSGLTVDCFDLLVPNMGELAGGSMREHRLPQLKENMRALGLEVPSKHSAGGKEMAWYLDLRRWGCPPHGGFGLGFDRLLSYLSGVPNVRDVVPFPRHYHRCDC

SEQ ID NO: 17842 - protein, 294 aa, Saccharomyces cerevisiae
TTPLVHVASVEKGRSYEDFQKVYNAIALKLREDDEYDNYIGYGPVLVRLAWHTSGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDADYVRTFFQRLNMNDREVVALSGAHTLGKTHLKNSGYEGPWTANNNVFDNSFYLNLLNEDWKLEKNDANNEQWDSKSGYLQLPTDYSLIQDPKYLSIVKEYANDQDKFFKDFSKAFEKLLENGITFPKDAPSPFIFKTLEEQGL

SEQ ID NO: 17843 - protein, 188 aa, Medicago truncatula
MAFKGYILFLVMVLVANMCTQNEAQSGCTSTITSLSPCLNYIMGSSSNPSSSCCSQLSSVVQSSPQCLCSLLNGGGSSFGITINQTLALSLPSACKVQTPPVSQCKGGNGQTSPTSSTSPAGSPVDSPTESPEGAITPSANSDFPSGGAGSKSIPSTDGGSSNGSTIEVSFNLFLSLLAIVFCVITKF

SEQ ID NO: 17844 - protein, 567 aa, Dioscorea tokoro
MATSTLICETPQWKDLNDHVEEIKKTHLRDLMQDSDRCKSMITEFDGIILDYSRQRVLPATVEKLFQLAEVACLKQKIDRMYNGEKINCTENRSVLHIALRAARDKAIKSDGKNVVPDVWHVLDKIKEFSERIRSGSWVGATGKALTDVVAVGIGGSFLGPLFVHTALQTDPEAAECAKGRQLRFLANVDPIDVARSITGLNPETTLVVVVSKTFTTAETMLNARTLREWISAALGPRAVSKHMVAVSTNLTLVEKFGIDPANAFAFWDWVGGRYSVCSAVGVLPLSLQYGFSVVHKFLNGAASIDDHFHSTPFEKNIPVLLGLLSVWNVSFLRYPARAILPYSQALEKFAPHIQQVSMESNGKGVSIDGVPLPFETGEIDFGEPGTNGQHSFYQLIHQGRVIPCDFIGVMRSQQPIYLKGEVVSNHDELMSNFFAQPDALAYGKVAEQLLNEKVPDHLIPHKTFPGNRPSLSLLLPSLNAYNVGQLLAIYEHRIAVEGFVWGINSFDQWGVELGKSLASQVRKQLHLSRTKAEPVEGFNFSTTTLLTRYLEAETGVPSDQSQLPKL

SEQ ID NO: 17845 - protein, 266 aa, Panax ginseng
MAASTMALSSPSFAGMAVKVAPSSSELFGSGRISMRKTGKKPAASSGSPWYGPDRVKYLGPFSGEAPSYLTGEFPGDYGWDTAGLSADPETFAKNRELEVIHSRWAMLGALGCVFPELLARNGVKFGEAVWFKAGSQIFSEGGLDYLGNPSLVHAQSILAIWATQVILMGAVEGYRIAGGPLGEVVDPLYPGGSFDPLGLAEDPEAFAELKVKELKNGRLAMFSMFGFFVQAIVTGKGPLENLADPLADPVNNNAWAYATNFVPGK

SEQ ID NO: 17846 - protein, 428 aa, Zea mays
MPAPDGWTKKFTPQRGGRSEIVFVSPTGEEIKNKRQLSQYLKAHPGGPAASDFDWGTGDTPRRSARISEKVKVFDSPEGEKIPKRSRNSSGRKGRQGKKEAPETEEAKDAETGQDAPSEDGTKETDVEMKPAEEAKEAPTETDDAEKAADKADDTPAPAPMEEDEKETEKPAEAVVAPLAQSEEKKEDAKPDEPEAVAPAPVSNPTENSAPAPAEPAAVPAPVPETESVAEPAAVLAPAPETKPDAKPAAVPAPAPENKPDAEPAAAAAPVPDTKSVAEPAAAPAPDTKSVAEPAAAAPVPETKLVAESAADAVAAPAPETKSDAEPAAAPVPETKPVAESAADAVAAPAPETKSDAEPAAAADPAPEIKSDAAAADPAPGTKADAAATDAAPGAEPDAAPLENTAADKGGSEESSQPVNNVNNGHST

SEQ ID NO: 17847 - protein, 486 aa, Mycobacterium smegmatis
MSGRHRKPTSSSSAKNVAKIAFTGAVLGGGGLGMAGQAMAATDGEWDQVARCESGGNWAINTGNGYHGGLQFSPSTWRAHGGTEFAPAAYMATKEEQIAVAERVLASQGKGAWPTCGRGLSGATPRNVVAEPEPAPLDAPGVNGELPPPAPVDMLAAPMPAPEGLPPAPEALPPAPEALPPAPEAPAPAPEALPPAPEALPPAPEALPPAPEAPAPAPEALPPAPEAPAPVAEALPPAPEALPPAPEAPPAPEALPPAPEAQIVDASLQVPADVPPAPPVEPAPPAPVDAVAAPENQNWDQAPAPADQPQTWALHVGGPLPLDPVLPAPAPAPAPAPAPGAPAAVAAPAPDPLAPAPNADVAPTPPEGVPHLASPENLPPGTTETPDQIPGQGPNMTYLREIWHAIQTQDISGKDALLALTQRPLTTPDVPGGAAPNRPVAPPPAPGDPALAPAPAPLGAPAPAPAPEPAPVGAPAPVGAPVPPPA

SEQ ID NO: 17848 - protein, 567 aa, Dioscorea tokoro
  misc_feature (112)..(112): Xaa can be any naturally occurring amino acid
  misc_feature (129)..(129): Xaa can be any naturally occurring amino acid
  misc_feature (238)..(238): Xaa can be any naturally occurring amino acid
MATSTLICETPQWKDLNDHVEEIKKTHLRDLMQDSDRCKSMITEFDGIILDYSRQRVLPATVEKLFQLAEVACLKQKIDRMYNGEKINCTENRSVLHIALRAARDKAIKSDXKNVVPDVWHVLDKIKEXSERIRSGSWVGATGKALTDVVAVGIGGSFLGPLFVHTALQTDPEAAECAKGRQLRFLANVDPIDVARSITGLNPETTLVVVVSKTFTTAETMLNARTLREWISAALGPXAVSKHMVAVSTNLTLVEKFGIDPANAFAFWDWVGGRYSVCSAVGVLPLSLQYGFSVVHKFLNGAASIDDHFHSTPFEKNIPVLLGLLSVWNVSFLRYPARAILPYSQALEKFAPHIQQVSMESNGKGVSIDGVPLPFETGEIDFGEPGTNGQHSFYQLIHQGRVIPCDFIGVMRSQQPIYLKGEVVSNHDELMSNFFAQPDALAYGKVAEQLLNEKVPDHLIPHKTFPGNRPSLSLLLPSLNAYNVGQLLAIYEHRIAVEGFVWGINSFDQWGVELGKSLASQVRKQLHLSRTKAEPVEGFNFSTTTLLTRYLEAETGVPSDQSQLPKL

SEQ ID NO: 17849 - protein, 567 aa, Dioscorea tokoro
MATSTLICETPQWKDLNDHVEEIKKTHLRDLMQDSDRCKSMITEFDGIILDYSRQRVLPATVEKLFQLAEVACLKQKIDRMYNGEKINCTENRSVLHIALRAARDKAIKSDGKNVVPDVWHVLDKIKEFSERIRSGSWVGATGKALTDVVAVGIGGSFLGPLFVHTALQTDPEAAECAKGRQLRFLANVDPIDVARSITGLNPETTLVVVVSKTFTTAETMLNARTLREWISAALGPQAVSKHMVAVSTNLTLVEKFGIDPANAFAFWDWVGGRYSVCSAVGVLPLSLQYGFSVVHKFLNGAASIDDHFHSTPFEKNIPVLLGLLSVWNVSFLRYPARAILPYSQALEKFAPHIQQVSMESNGKGVSIDGVPLPFETGEIDFGEPGTNGQHSFYQLIHQGRVIPCDFIGVMRSQQPIYLKGEVVSNHDELMSNFFAQPDALAYGKVAEQLLNEKVPDHLIPHKTFPGNRPSLSLLLPSLNAYNVGQLLAIYEHRIAVEGFVWGINSFDQWGVELGKSLASQVRKQLHLSRTKAEPVEGFNFSTTTLLTRYLEAETGVPSDQSQLPKL

SEQ ID NO: 17850 - protein, 668 aa, Oryza sativa
  misc_feature (541)..(541): Xaa can be any naturally occurring amino acid
MDDPNYPIFDMSEYDPNFGMEQGGSIPAPMPEEPATTQVASEGSGTVAASGSTASSSKRSRTSTVWQNFDEIKETGPDGKESNNATNSDGQLIMSEPTWDFAYKDPQLSLSLVLRDRGRDRVKWNEENLNDIESTKPVREKITEPKTPYHSMIDEDDVMKKKKKKKKKKKKKKKKKKKKKNKKKKKKKKKKKKKKKKKKRWPSNKAQDKPGHSRYSRRRPPPAAPVAAVAVAADDDELGGGRTPEQPPRGTVRPAGTPSASAMAAHPFPLPFLPQCTSILCDADTDNLWLASGNAQSSAAVRSRLLAAEREEAKAVLSLFLRQKGLRSILAARIANKADGFIEHLVSKLHITYRSRYAEGRELSTPEIRDALIPYLEALSKEHGDGGALPELVLYLLDLGMDHEEIKNVVRKFPAFAYYNVDRKIKPLVALLLELGVPRSNIPGIIKKRPQLCGISLSDNLKPMMTYLENVGINKDQWSKVLSRFPALLTYSRQKVETTVSFLTELGVPKENIGKILTRCPHIMSYSVNDNLRPTAEYFQXSIGADDASLIQKSPQAFGLNIEAKLKPITEFFLERDFTMEEIGTMANRFGIIHTLSMEDNLLPKYEYFLTMGYPRNELVKFPQYFGYSLEQRIKPRAAFMNALQNGLLLVFLRFSVSIAWVFVVLQC

SEQ ID NO: 17851 - protein, 567 aa, Dioscorea tokoro
  misc_feature (503)..(503): Xaa can be any naturally occurring amino acid
MATSTLICETPQWKDLNDHVEEIKKTHLRDLMQDSDRCKSMITEFDGIILDYSRQRVLPATVEKLFQLAEVACLKQKIDRMYNGEKINCTENRSVLHIALRAARDKAIKSDGKNVVPDVWHVLDKIKEFSERIRSGSWVGATGKALTDVVAVGIGGSFLGPLFVHTALQTDPEAAECAKGRQLRFLANVDPIDVARSITGLNPETTLVVVVSKTFTTAETMLNARTLREWISAALGPQAVSKHMVAVSTNLTLVEKFGIDPANAFAFWDWVGGRYSVCSAVGVLPLSLQYGFSVVHKFLNGAASIDDHFHSTPFEKNIPVLLGLLSVWNVSFLRYPARAILPYSQALEKFAPHIQQVSMESNGKGVSIDGVPLPFETGEIDFGEPGTNGQHSFYQLIHQGRVIPCDFIGVMRSQQPIYLKGEVVSNHDELMSNFFAQPDALAYGKVAEQLLNEKVPDHLIPHKTFPGNRPSLSLLLPSLNAYNVGQLLAIYEHRIAVEGFVWXINSFDQWGVELGKSLASQVRKQLHLSRTKAEPVEGFNFSTTTLLTRYLEAETGVPSDQSQLPKL

SEQ ID NO: 17852 - protein, 226 aa, Arabidopsis thaliana
MSQCIDGFKHVCSSFFRCFDIDIYKQSGGLGDPELLARETVFSVSEIEALYELFKKISSAVIDDGLINKEEFQLALFKTNKKESLFADRVFDLFDTKHNGILGFEEFARALSVFHPNAPIEDKIDFSFQLYDLKQQGFIERQEVKQMVVATLAESGMNLSDEIIESIIDKTFEEADTKHDGRIDKEEWRTLVLRHPSLLKNMTLQYLKDITTTFPSFVFHSQVEDT

SEQ ID NO: 17853 - protein, 481 aa, Hyphomonas neptunium
MSNGDRQTAVSRPGLAARLGLVIGPALAILIAVLPAPEGLERGGMLVAAVLVLMAVWWATEAIPIAATSLLPLGLLPLTGVASLGAIAAPYADSVVLLLLGGFIMAIGIEKWHLHRRIALNVLLLSGARLKLLAGGFMLATALLSMWISNTATSLMMAPIALSVAVAAGGGPRLASALLLGIAYSASIGGLATPVGTPTNLIAMGWLRENTDIEISFREWMSFGLPVVLIMLPMAWLILTWGLKSDAAAAKAAEATIRGQRNALGRMTIPESRVAIVFGVIALAWITREQLVQIPLFAGLTDMGIAILGAILMFLVPHGSREPEHQPGGWALLNWDDAKAVPWDVVLLFGGGLSLAAAVQASGLAGYLGNSLAELAAVPPIVLIFMVVTIIIFLTEIMSNVAAMTTFLPILGALATATGVDVRSLIIPCAMAASCAFMLPIATGPNAVVFGMRQFSIGRMMKSGFWLNVACVIIVTLYFGL

SEQ ID NO: 17854 - protein, 573 aa, Pimelobacter sp.
MSIAESTVLGEEPEWFRTAVFYEVLVRSFRDPNAGGTGDFRGLAEKLDYLQWLGVDCLWVPPFFSSPLRDGGYDVADYTGILPEIGTVEDFHAFLDGAHERGIRVIIDFVMNHTSDAHPWFQASRSDPDGPYGDFYVWSDTDELYQDARVIFVDTEPSNWTWDQTRGQYYWHRFFHHQPDLNFDNPKVQDAMLEAMAFWLDMGLDGFRLDAVPYLYERPGTNGENLPETHEMLKRVRRFVDDNYPDRVLLYEANQWPTDVVEYFGPEEREDGTVVGPESHMAFHFPVMPRIFMAVRRESRFPISEIMEQTPAIPEGCQWGIFLRNHDELTLEMVTDEDRDYMWGEYAKDPRMKANIGIRRRLAPLLDNDTNQIELFTALLLSLPGSPVLYYGDEIGMGDNIWLGDRDGVRTPMQRTPDRNVGFSAATPGKLHLPTIQDPVYGYQSVNVEAQLENPSSLLHWTRRMIHIRRQRDAFGLGTFEDLGGSNPAVLSYVRELPGDGGDDVILCVNNLSRFPQPVELDLRKYEGRVPVELIGGVPFPAVGELPYLLTLSGHGFYWFRLTDPDTTGRPVL

SEQ ID NO: 17855 - protein, 1428 aa, Shewanella oneidensis
MIELRIDNKIVSAEPSDNLLHAARKAGIAIPSLCDPTDASRQLDTQAHAEKQDCNLCLVQIENSDASLRCVKACETPAQTGMKVITQSAFLTKQRQAALNAILSDHFADCEAPCQQACPAGVDVQRYLYHIAQGDHTQAVKVIKETLPLPLSIGRVCPAFCETECRRGLIDDPIAIRQLKRHAADLDLADDEHGNSYQPPRLADTGKKIAIIGSGPAGLSAGYYLSNQGHNIEIFEAMPKAGGWLRYGIPEYRLPKAILDKEIELLCRNGLTIHTQMRLGHEIHLNQLITDFDAVCLAIGAQKAVPMHYKGSELAGCYLGVDFLKDHCLDKQLKLGKKVAVIGGGNTAIDCARTAVREGCDVTLIYRRTRAEMPAEAYEVHEAEVEGVKFHFLTNPLENHSDADGRVQSVTFSKMTLGEADASGRRAPVDTGETFTEAFDTVIAAVSQAPDLSFMQDPKGQLSHGELALSRWNTLMGCEQTMSSGVEKLFVMGDARRGPATAVAAIGDGRKAAKAIDKMLQIGLSCDLHAHEFNSVKTIPGSLKQAEVKSAEASSPLYPHTKRQPRLKMPELTALQRLLNYSEVELGFPADAAMQEAARCLECACQANTDCKLRDYATDYGVESKSLATENARYFSVDKSSPFIQFDANRCISCGKCVDVCQQQSGHCAIQFAKDSYQVLPQSISPADERRAPRVGFSASMADSHCVQCGNCVQVCPTGALVDARDKRQGDCTELTTASTICTYCGVGCRLDLKIDPSTNRIRHIEGNKDSVVNQGMLCVKGRFGFDFIHSDKRLTTPLIRKNGKLQPCSWPEAIDYVAKRLTEIKQKDGSNAFASLASAKATNEDNFVLQKFVRSVLGTNNIDHCARLCHSSTVTGLQQSIGSGAMTNDILSIKDSDVIFILGSDTTCAHPIIASKIQQAVNLYGARLIVADPKRVGIAEKAELYVAHRPGTDVMLLNAIMAEIIRNNWQDKDYIAKRTEGIEALYAELAKEDYSLEKAALITGVKAENIARIARTIGTAQKTAVYYAMGITQHTTGHDNVTAISNLQLLCGNIGVSGAGINPLRGQSNVQGACDMGALPNYFTGYQKVTDIHARMRFESHWQTPLSGEIGVTATHMMHDIAKGKINALYVMGENPVLSDPDQAHVLNALSQIEFLVVQDIFLTETAELAHVVLPAAAFVEKRGHFTNTERRVQRLEQALASPGEALPDWQIVQAIANAMGANWDYKDEAAIWAEINALTPQYRGILWERLTAGEDGQIPQGIQWPCPDEKHPGTPIMHQGQFTRGLGLFTPVSYRLPAEMPCNEYPLTLSTGRLLEQFHTGTLTRKTPGLDLLGAPKVMISVYDAEQLGINNGDKIRLTTRRGEIEIDAFVTKRAQAGVLFLPFHFVEAAANKLTINALDPVAYIPEYKVCAVRVEKVTKQMCEPT

SEQ ID NO: 17856 - protein, 569 aa, Unknown
  Erythrobacter sp. NAP1
MATAPNPTRDDFEALLNEQLGGADDGGFEGRVVKGTVTAIEAGHAVIDVGLKSEGRVNLKEFARGEDDHGLSVGDEVEVYVDRVENADGEAMLSRDRARREAAWDKLENEFGEGKRVEGRIFGRVKGGFTVDLDGAVAFLPGSQVDIRPVRDVTPLMEVPQPFQILKMDRRRGNIVVSRRAVLEETRAEQRSELIDKLAEGQVIDGVVKNITDYGAFVDLGGIDGLLHVTDMSYKRVNHPSEVIAIGDTVTVQIVRINAETQRISLGMKQLESDPWDGVAAKYPVNMKLTGQVTNITEYGAFVELEPGIEGLVHVSEMSWTKKNVHPGKIVSTSQEVEVMVLEVDSEKRRISLGLKQAQRNPWDEFAEKHPVGAEVEGEVKNATEFGLFIGLDGDVDGMVHMSDIAWGISGEDALALHRKGEQVKAVVLDVDVDKERISLGMKQLEKGAPTEAGAAAAGSLRKGQTVTVTVLEVRDGGLEVQVGDDGATGFIKRSDLGRDRDEQRPDRFQVGSKVDAMVTGFDRSKKPNFSIKARQIAEEKEAVQQFGSSDSGASLGDILGEALKKSDD

SEQ ID NO: 17857 - protein, 733 aa, Bartonella quintana
MFKTHKIEIEWAGRPLTLETGKIARQADGAVIATYGETIVLATVVSAKNPKPDQDFFPLTVNYQEKFYAVGRIPGGYLKRESRPTESETLISRLIDRPIRPLFADGYKNDTQVIVSVIQYDLENNPDILAMIASSAALTLSGVPFMGPIAGARVGYCNKQYILNPHIDEMPESKLDLVVAGTESAVLMVESEAQELPEDIMLGAVMFGHKGFQPVLDAIIKLAEVAAKDPRDFIPEDLSDLETAMLEMVEQDIRKAYTITDKQERSTAIDVLKTEIINKFMSETEENCKFSADQIATVFKQLQAKIVRSNILDTKKRIDGRDLSTVRPIQSEVGILPRTHGSALFTRGETQAIVVATLGTGEDEQYVDSLTGMYKETFLLHYNFPPFSVGETGRLGSPGRREIGHGKLAWRAIHPMLPTKESFPYTIRAVSEITESNGSSSMATVCGTSLALMDAGVPLVRPIAGIAMGLIKEGERFAILSDILGDEDHLGDMDFKVAGTNNGITALQMDIKIDGITEEIMKIALEQARDGRIHILNEMAKALTSARDELSEFSPRIEVMNIAVDKIRDVIGSGGKVIREIVEQTGAKINIEDNGTIKIASADAKTIEAAKRWIHSIVDEPEVGGIYQGTVVKTAEFGAFVNFFGSRDGLVHISQLTTERVTKTTNVVKEGDKVWVKLMGFDERGKVRLSMKIVDQQTGKEITGDNSIKAEKEKYADTKNNPENKRLRKKKEE

SEQ ID NO: 17858 - protein, 635 aa, Gibberella zeae
MLGRSNSDINLILSLRVLQSSLRSQLQTPRNTAFLSLAKFTTMPSKRLKRESSSPSAGGTAKKAKTSKMNGSGSSDALRRPHHKAQEAEENGIAIRKFYPAEMSNARARAYNNNEIPRPIEDLVDALEVTAKERKSIDVKDAVVHWFKMDLRISDNRALALASDKAKEAGVPLIALYIISPQDYEAHLRAPVRIDFMLRTLSVIKEDLAKLDIPLYVETVEKRKHLPDRILELMDEWGASHLYANMEYEVDELRREAAMIKDFAENGKAFEVVHDTCIVPPGELHTGAGKQYAVYTPWFKTWIAHIHENLDLLELYEPPEKNPDSARKKFKKLFNAEIPEAPKSKRLGDEEKERLRSLWPCGEHEAKKRLDKFCEERIGNYHEKRNIPADAATSSLSVHLASGTISARTCVRTARDRNKTKKLNGGNDGIQTWISEVAWRDFYKHVLVNWPYVCMNKPFKPEYSNISWSYDNDHFAAWCEGRTGFPIVDAAMRQMNTIGYMHNRCRMIVASFLAKDLLLDWRKGEKYFMEHLVDGDFASNNGGWGFSASVGVDPQPYFRIFNPLLQSEKFDPDGDYIRKWVPELKDLDNKAIHDPYNRKAGPQAKKKGYPEPIVTHKDCRERALAAYKEGLAIDE

SEQ ID NO: 17859 - protein, 644 aa, Streptomyces coelicolor
MCGIAGTYHWPDGKAVTDRLTDVLAHRGPDGAGRYSHPAGEGEVHLGHRRLAVVDLSTTGAQPMVSEGLALSYNGELYNAPELRTELESAGVRFRGTSDTEVVLEAWRRWGTDCLPQLRGMFAFAVFDERTGELVLARDQLGIKPLFLLRRGAGLVFASELKALATATGGKLEVDHAALVASLLYYWVPDSRCALREAEKLPPGSWLRCRPDGRVERGRFWNLRDVAAEGRERARSGERPDLAAVVEESTRRHLLSDVPVATFLSGGLDSSYLTALAARDRPGISAYTIGFRAEDARFEAMPDDLRYARQVAERFGVDLHEIEIAPNVLDLLPRMTYHLDEPIGDPAAINTFLICSAAREAGVKVMLSGMGADELFAGYRKHLANVLALRYQRVPRPLRRGVSAAVGRLPVASSRRGYRSVRFAKRFLSFADLPQETAFRRSYTMYDRQELLDLIDPDLAGTVEDVLTEHADVYEDNDLDDFVNRMCLADARMFLPGLNLAYTDRSSMAASTEVRVPYVDVEVVKAAFAVPGDRKIVGRQGKAVLKEAATSVLPREIVYRPKGLFSAPLRAWMSRDLAPLVREVVNDGELVRSGFLRRDALRRLVAEDAAGQRDFSKHLWHVLTLEYWYRGATSGSGDHSSSTA

SEQ ID NO: 17860 - protein, 72 aa, Bacillus licheniformis
MAKDDVIEVEGTVVETLPNAMFKVELENGHTVLAHVSGKIRMHFIRILPGDKVTVELSPYDLTRGRITYRYK

SEQ ID NO: 17861 - protein, 427 aa, Haloarcula marismortui
MSTQKEPPEQATDEDESPIATARRQLERAAEHLDLSEGMLEQLRHPSKTVEVSVPIHRTDGSVEVFNGYRVQHFEVRGPYKGGMRYHPSVSAEECTALAMLMTWKCAVMDLPFGGAKGGIVVDPSTLDAQETEQLTRRFAEELREVVGPTKDIPAPDMGTDEQTVAWFMDAYSMQEGETVPGIVTGKPTAVGGTHGREEAPGRSVAIVAREALDYYDGSVEGATVAVQGFGAVGANAARLLDSWGASVVAVSDVDGGIYDESGLDIESISADGDEHGQLGAVDAPRQLSNAELLELDVDVLIPAAVGNVLTEENAADVQASIIVEGANGPTTTAADTVFEERNIPVIPDILANAGGVTVSYFEWLQHINRRSWSREEVNDELEAEMLDAWEALQAEVEDRDVTWRTAAYIVALSRIGDAMNARGLWP

SEQ ID NO: 17862 - protein, 312 aa, Unknown
  Frankia sp. EAN1pec
MAEAPERRRWSAADVPDLNGRTAVVTGANSGIGFEAAKLLAGRGATVVMACRNPVKAQDALDTIRIAVPEADVSVLQMDLSSLTSVRKAADALVTERPVIDLLINNAGVMLLPQGKTEDGFEQHFGINHLGHFAFTGLVLEAVTASDAGRIVTVSSNGHRMGKIDFDDLDLAQKYRPFRAYARSKLANLLFTYELQRRLTAAGGSARSVAAHPGGANTEVGGNPSPVQRKLKKVVDHIPNPIVHSAFKGSLPLLRAAVDPSTRGGEYYGPSGLLKMTGHPVLVTSNAASRDTGTAERLWELSERLTMVTYPL

SEQ ID NO: 17863 - protein, 1177 aa, Unknown
  Magnetococcus sp. MC-1
MLMDIKRILLSAWLLASLLLLLIVGLLFHRFIQHEFNRRAEQHLQFAQQFLLDELGQRRKDLQQRAASLAQSPNISGPMHLINRYEDPTRRETLVFDQEKEQLIHEVLKHIHDLNNILVVLYDTKQRPIVWINREQTKTSVGYRGFGPDGAINLTLQRPEQPSPPPQRDLAGLSHWLSKHPLYHLIHFDQEIAQAELSPMLWQSKGGEPKQAGTLLLISRLDEHFTNHIQLRTHTQVQLLHHNSTLNQKQTGTHPFQKLDLQQALTKSLDLSQLSSVPASGHSHWIDHADARLSLLHAPLDNGDLALFGFALPKEQISTSFMAFQGAAALGGGLTALMLIPLGWWFIRRQLVSPLHTLLHEIQQFHQEGRIPPRQIRYGASEFRTLTLEFRTLAHSIIEREKRLRTLSTGLEQAPISVLISDTQGNIEYVNPYFEQLTGYYSHEVLGKNPNLLKSDLNPPELFRDLWRTISAGAPWRGEFINRKKNGALHWQMAHIAPVLDNDGQITHFIALSEEITARKQADAALNESNERFRTLAQVSPVGIFQTDHDGEYIYVNTTWESITGTTSPQALSSQWDIHLHPDDQPRVQQRWQETVLHGNAFHEEYRFLRGDGTIRWVIGSAAPQRDPDRVIQGFVGTLTDITERKQMELELGKERALLRSLIDSIPDLIFYKRADGTYMGCNRAFELFCKRPEAALIGHTDQALFSPELAQLLKSGDELVINKNSCFSHEATGLFGDGHQVPFLIQKSPMHGYQGELLGLIGVARDITQRLRVEQELQQAKEDAEAANRSKSEFLAAMSHEIRTPMNVVIGMGEILLETPLNAEQTRYINSMQHAGDALLELIDNILDLSKIEAGRMTLEERAFRLDTMVISITDFFRLQALNHNLSLVVEIAPELEQQYVLGDAGRVRQVLYNLLGNALKFTEEGGVSLHLSLDANQHIHTRVSDTGIGIAPQQLERIFDNFTQEDSSVTRRFGGTGLGLAICRRFTELMGGRIWVESIEGQGSTFHMTLPLVLSHTPLHETPTTAVITPYNQGIVEAPCAFTPEHPQRPLSILLVEDSEDNRTLFKAFLQHTPHALVMVENGADALERVIVERFDLIFMDMQMPIMDGYSATRAIRQWEQQRGVPPHIIYALTAHALSGDRERSLQAGCDDHLTKPIKKRKLLEIIQQHAQPVE

SEQ ID NO: 17864 - protein, 613 aa, Glycine max
MASISGICSSSPTLNHSTPKRRRTPLLPSSSFPSKPSPPRSLARETPAPQQQQQQLSAVTKPLHAGLEKKPRALWRRYVEWLYQHKELGLYLDVSRVGFSDDFVREMEPRFHAALRAMEDLEKGAIANPDEGRMVGHYWLRDSARAPTSFLKSQIDNTLVAICTFADDVVTGKIKPPSSPEGRFTQILSVGIGGSALGPQFVAEALAPDNPPLKIRFIDNTDPAGIDHQIAQLGPELASTLVIVISKSGGTPETRNGLLEVQKAFREAGLSFPKQGVAITQENSLLDNTARIEGWLARFPMFDWVGGRTSEMSAVGLLPAALQSIDIREMLAGAALMDEANRSTVIRNNPAALLALCWYWATDGVGSKDMVILPYKDSLLLFSRYLQQLVMESLGKEFDLNGNRVNQGISVYGNKGSTDQHAYIQQLREGVHNFFVTFIEVLRDRPPGHDWELEPGVTCGDYLFGMLQGTRSALYANNRESITVTVQEVTPRSVGALVALYERAVGIYASLVNINAYHQPGVEAGKKAAGEVLALQKRVLAVLNEASCKEPVEPLTLEEVADRCHAPEDIEMIYKIIAHMAANDRALIAEGNCGSPRSIKVFLGECNLDELYA

SEQ ID NO: 17865 - protein, 532 aa, Unknown
  Frankia sp. EAN1pec
MGRSRSPRLVSVSQPRRGHRHLRLEERFVTIAAASTATPQVIVIGAGFGGMSVALELKACGIDTFTVLERAPEVGGVWQANDYPGAACDVPSVIYQFSSHLKANWSRRFGSQAEIRDYVRQVSIESGVRPHIRFGTEVVSASFGESTNRWTVELADGEQLSADVLVAATGQLSRPRTPQIEGRDTFTGAQFHSAEWDHSVDLRGRRVTVVGGGASTIQVVPAIVDTAAHTTLIQRSPSWVVGKYDWSPGPLERSLSRVPGFLRLYHGAMWQWFEAKYPFVLRRYDAGRTLYEAFWRRRIRAALKDEQKIAACLPDYRIGCARILLSKAWYPTLAREDVSVFRDGVTVMTEDGVLTSDGRHIPTDVVIWCTGFTATEYLAPIRVTGRGGLDLHTVWKDGPEAYLGLAVPGFPNFFMSYGPNTGSLTNTITSMLEYQASYIRQAIEHIGRSRLAYSVRQDVHDSFNAELGRRLPQTVFSTGCPGWYATPSGKITTVWVGSHREYRRRTRFFDPTVYDEAVPAPTWSTPDVSLTQ

SEQ ID NO: 17866 - protein, 95 aa, Pisum sativum
MEGLHETGPPPFLTKTFDVVEDPSTDGIVSWSRARNSFVVWDLSKFSTAILPRYFKHSNFSSFVRQLNTYGFRKVDPDRWEFANEGFLAGQRILL

SEQ ID NO: 17867 - protein, 230 aa, Triticum aestivum
LYSNKFVQKSRLVPVRNSRDIVDPRRRAPNSQLPALLLSSEPARSPPQPPTPPPSTRTGNLAMAAASSATSVHDFTVKDASGKDVDLSVYKGKVLLIVNVASQCGLTNSNYTELSQLYPKYKDQGFEILAFPCNQFGGQEPGTNDEIVQFACTRFKAEYPIFDKVDVNGNNVSPLYKFLKSSKGGLFGDSIKWNFSKFLVDKEGRVVDRYAPTTSPLSIEKDIKKLLGSS

SEQ ID NO: 17868 - protein, 774 aa, Kluyveromyces lactis
MDGVMLDKVELNQHEVGAARERSRSMASLSKFIPKSIWKPQQQQQQQQPSETSEGNTKASNSHPVMLHASLHEAPAIVLQEAKPVSRESIEQEGAPAEKAASGNSSKLSMRLKKVFGKKEPSQPPVDSELSPPASSEAAANHDANDTTNTLNRNRTNSDTDPEPKRNLYSDGSQIQGTPLTSPSKSISSYNSGTHKPNNLVTGNQASKLSPNFDIPEASSNGNGFVPSYNSMTNISTASLNLIDENEETQNFEGSLHQSGEIIHPAITTPLKSGSESPFLSSQSMKPFPASDEAENSHRRSESNGVSVKPQLRRTASQPTDVHVQVNGKTASTKEEFSPRRGTVGADASFIQPPKRSERLRNKSFSNKFQDILVGPQSFEKIRLLGQGDVGRVYLVREKQTNRLYALKIFSKPEMIKRKKIKRILTEQEILATSNHPFIVTLYHSFQTEDYLYLCMEYCMGGEFFRALQTRKTKCISEDDARFYSSEVTAALEYLHLMGFIYRDLKPENILLHQSGHIMLSDFDLSVQAKDTKNPQVKGNASHSLVDTKICSDGFRTNSFVGTEEYIAPEVIRGNGHTAAVDWWTLGILIYEMLFGFTPFKGDNTNQTFSNILKNEVVIPNNNETSRACKDLIRKLLIKNENKRLGSKLGASDIKKHPFFKNDQWSLLRNQEPPLIPVLAKNGCDFAKLSSNPKGSKDKKDSAEQQEKLMFEEKVELDDQVSDNDPFHDFNSMSLMKQDNDSLIYGDSTSYGKISYTPNQNRSRSNSHRSFFKR

SEQ ID NO: 17869 - protein, 176 aa, Colwellia psychrerythraea
MKHTIEVMISEEKIKTRVAQLGLQISEHYQDSDNLVMVGLLRGSFVFMADLARVITVNHSVDFMTASSYGNGMESSRDVHILKDLDDNIEGKDVLLVEDIIDTGNTLSKVLQILNLRGPNSIQICTLLDKPTRREEDVAVKWIGFEIPDEFVVGVGIDYAQKYRHLPYIGKVIPTE

SEQ ID NO: 17870 - protein, 412 aa, Oryza sativa
LQEFGTRTVVTHLPGFDGPLPFYLETGYVGVEEETGTELFYYFVESERSPHSDVVLLWLSGGPRCSVFSGFVYEIGRVMFVAERYSGGTVPRLEYNPYSWTKLASILFVDSPVGSGFSYAHDPKGYDVGDISSSMQIVKFLRKWLDDHPKYLSNPFYIGGDSYAGKVVPLITQYLSEGIEEMRHPIINLKGYLVGNPSAGDKIDVNSRVPYSHSFGVISDQLYEAALANCKGDYENPTNKPCTDVMQTINNLMSKVLEPACPFDWPWPMPGRDASNRKSLTEEHYWLGDPPVEPPFSCFAAYRYYLSYFWANDNATRAALGIKEGTVTEWIRCATGLPYTRDLPSSIECHFNVTTRGYRALVYSGDHDPIVPFSGTQAWIRSLNFSIVDDWRAWHLDGQAAGLNSQSSMLTT

SEQ ID NO: 17871 - protein, 427 aa, Unknown
  Bradyrhizobium sp. BTAi1
MADHGNSPPDLVESDRLRASPSRRSFFAASAGLAGSLIAAPVAADSLADVPPREDGANLSGHSERSQYVKLARIPEAGPGKRNVDPSDAINSKAPLDKLFGGITPTDLHYERSHSGAPDLDPAKHRLLVHGMVGKPLVFNVEDLKAMPSVSRVVFIECTGNGWENWKKADENLTVQHTHGLVSTNEWTGVPLKFIVDLVGKEPDSHWMLAEGGDAAGVARSIPLTDEILSEAFVAYGQNGEPLRPAHGFPMRLVMPGFEGNLNIKWLRRLKFGDQPWMTRWETARYTQLQANGKATQFQLRMDTNSVITTPSGTMVIKPGYQRINGLAWSGHGRIAKVEISTDGAKSWRQAQLTQPALPKAQVRFQMDWTWEGKPTRIVSRSTDDRGNVQPDRKSFIAAMGTNALFHYNAQQTWSIDETGRVRNVLD

SEQ ID NO: 17872 - protein, 578 aa, Arabidopsis thaliana
MCGILAVLGCIDNSQAKRSRIIELSRRLRHRGPDWSGLHCYEDCYLAHERLAIIDPTSGDQPLYNEDKTVAVTVNGEIYNHKILREKLKSHQFRTGSDCEVIAHLYEEHGEEFIDMLDGMFAFVLLDTRDKSFIAARDAIGITPLYIGWGLDGSVWFASEMKALSDDCEQFMSFPPGHIYSSKQGGLRRWYNPPWYNEQVPSTPYDPLVLRNAFEKAVIKRLMTDVPFGVLLSGGLDSSLVAAVALRHLEKSEAARQWGSQLHTFCIGLQGSPDLKAGREVADYLGTRHHEFQFTVQDGIDAIEEVIYHIETYDVTTIRASTPMFLMSRKIKSLGVKMVLSGEGSDEILGGYLYFHKAPNKKEFHEETCRKIKALHQFDCLRANKSTSAWGVEARVPFLDKEFLNVAMSIDPEWKLIKPDLGRIEKWVLRNAFDDEERPYLPKHILYRQKEQFSDGVGYSWIDGLKDHANKHVSDTMLSNASFVFPDNTPLTKEAYYYRTIFEKFFPKSAARATVPGGPSIACSTAKAVEWDATWSKNLDPSGRAALGVHVAAYEEDKAAAAAKAGSDLVDPLPKNGT

SEQ ID NO: 17873 - protein, 421 aa, Wolinella succinogenes
MNPLPLALTPKKILLIGAGKVAAQKARAILESDCPLFILAKEVRDDYFLDKEVKLAPFSPQELEGFDLIIDATGDEALGRWLWEHKKEYRYWLNVVDVPALCDFYFSATVRRGDLCVSVSSGGASPTLAQGVRDKIARFLPSLLAPLLNRLKEERQKGRIDPKSALPSIQKALGKVFLIGCGPHSVGNLTLKALETIEILDVALIDALVGEEILNLLSPQCLQISVSKQKGCHSYTQEEINGLMLRYAKEGLNVGRLKGGDPMVFGRVAEEAGFLMEQGIEVELLSGVTSFLAGCLQSGITPTLRGVSAGALVVSAHLKESRFHDEWLAWLKDSPYTLVVLMAHSFAREITLGAKNRGVPLTIPAAFVSKIDSPSPKSVIGNLGCLEEMAKECEKPAILVIGEAVKESLRMPYVGERVILE

SEQ ID NO: 17874 - protein, 580 aa, Chlamydophila pneumoniae
MPKQAEYTWGSKKILDNIECLTEDVAEFKDLLYTAHRITSSEEESDNEIQPGAILKGTVVDINKDFVVVDVGLKSEGVIPMSEFIDSSEGLVLGAEVEVYLDQAEDEEGKVVLSREKATRQRQWEYILAHCEEGSIVKGQITRKVKGGLIVDIGMEAFLPGSQIDNKKIKNLDDYVGKVCEFKILKINVERRNIVVSRRELLEAERISKKAELIEQISIGEYRKGVVKNITDFGVFLDLDGIDGLLHITDMTWKRIRHPSEMVELNQELEVIILSVDKEKGRVALGLKQKEHNPWEDIEKKYPPGKRVLGKIVKLLPYGAFIEIEEGIEGLIHISEMSWVKNIVDPSEVVNKGDEVEAIVLSIQKDEGKISLGLKQTERNPWDNIEEKYPIGLHVNAEIKNLTNYGAFVELEPGIEGLIHISDMSWIKKVSHPSELFKKGNSVEAVILSVDKESKKITLGVKQLSSNPWNEIEAMFPAGTVISGVVTKITAFGAFVELQNGIEGLIHVSELSDKPFAKIEDIISIGENVSAKVIKLDPDHKKVSLSVKEYLADNAYDQDSRTELDFKDSQGPKERKKKGK

SEQ ID NO: 17875 - protein, 50 aa, Zea mays
KMLSCDGADRLQTGMRGAFGKPQGTVARVHIGQVIMSMRTKLQNKEHVIE

SEQ ID NO: 17876 - protein, 949 aa, Mycobacterium avium
MVDGAPTADPSEESTRSGDLPDRLRVHSLARTLGTTSKRVLDALSELDGRVRSAHSTVDREDAVRVRDLLAAQPSAELEPAAEDAASGGPDAGITGEPESRLLLETPDATERPHYMPLFVAPQPLESSDDDGDADETADSDDSDGDDDEQADRPSSRRRRRGRRGRGRGRGEQGGSDGPGDGDNDEPQNRGKKGGQSDGDDDSDGQDAEDADDSDTGDDGSADGGNRRRRRRRRRKSGSGDDNEDGPSPDDPPNTVVHERPPRNGKNGGDDGNGSSSSEIKGIDGSTRLEAKRQRRRDGRDAGRRRPPVLTEAEFLARREAVERVMVVRDRIRTEPPHQGSRYTQIAVLEDGIVVEHFVTSAASASLVGNIYLGIVQNVLPSMEAAFVDIGRGRNGVLYAGEVNWEAAGLGGSDRKIEQALKPGDYVVVQVSKDPVGHKGARLTTQVSLAGRYLVYVPGASSTGISRKLPDTERQRLKEILREVVPSDAGVIIRTASEGVKEDDIRGDVTRLQERWKQIEAKAIEIKEKAAGAAVALYEEPDVLVKVIRDLFNEDFAGLIVSGDDAWNTINEYVNSVAPDLVSKVTKYEPATGPDGTPGPDVFAVHRIDEQLAKAMDRKVWLPSGGTLVIDRTEAMTVIDVNTGKFTGSGGNLEQTVTKNNLEAAEEIVRQLRLRDIGGIVVIDFIDMVLESNRDLVLRRLTEALARDRTRHQVSEVTSLGLVQLTRKRLGTGLVEAFSTSCPNCGGRGILLHADPVDSAPSNGRKSESGGRRGRRKKSKAEEPVVAKVPVHSPGEHPMFKAMAAGSSTQAASDEDESAAEEAGDELERKKAARAEELEAAEDTEDLEDTEDDDEDSDDSDDSDDEDLDDEDIDDEEDLGDDDEDLELDDDDLDTEDSDDSDDSDDSEDSDDSEDQRDPAAECPGVSALGRPRRRRAAGRPAGPPIHAD

SEQ ID NO: 17877 - protein, 795 aa, Mycobacterium smegmatis
MARTDRISDPWGSRTPYAAGEPWPQRVDRYLTPGLTDDDVDRWVQSAAVLHSNGDGLDIAVKDGRIVGVRGRADDRVNHGRLDPKDLFGWQANHARDRLRTPLIRQDGVLVESDWDTAMDRIVARSRQLLDERGPNSIGFYTSGQLFLEEYYTQCVIAHGAIGTNHVDGNTRLCTATAAEALKESFGCDGQPGSYTDVDHADVIALYGHNVAETQTVLWMRMLDRLAGPNPPAIVCIDPRPTPVARHATVHLAPLPGTNVALMNGLLHEILDHDWMDHDYIEAHTVGFHELRKRVAEFPPERVADICGVDPDDVRRAGELIGTAERLLSTVLQGFYQSHQATAAAVQVNNIHLVRGMLGRPGCGLLQMNGQPTAENTRECGADGDLAGFRNWANDSHIEELATLWNLDVTAIPHYAPPTHAMQMFRYAEEGSLRMLWVSATNPAVSLPELGRIRRILSQDRLFLVVQDLFLTETAQLADVVLPAAAWAEKTGTFTNADRTVHISDKAVDPPGQARSDFDIFLDYARRMDFRDRDGRPLPAWNTPDEAFEAWKRCSAGRPCDYTGLSYEKLRGSGGIQWPCNAEHPDGVERLYAGGEFFAAPDYCEAYGKDLITGAPLEPTEYRAMNPFGKAIIKAAEYVPPHERPSAEYPCVLITGRTVYHFHTRTKTGRTPQLQAAAPEVWVELARADALRAGIVEGDLVEIRTVRGCVTAAARLTDLRRGVVFLPFHYGYWDTGDDGGKDGHHRAANELTLTDWDPVSKQPIFKTAAASVRRIGAGMAATPEPVAHAVADEHL

SEQ ID NO: 17878 - protein, 298 aa, Zea mays
  misc_feature (16)..(16): Xaa can be any naturally occurring amino acid
PRSKPEAIRVNRENPXVTLKGIKILPAVEPVTDLLATLTECDLCFVALPSSALRSVLAPHAERLAGKLLVSLTKGIEAHTFKLMSEILEEIAPEARIGVLSGPNLAREVAEHALTATVIASEDEELCERVQAVLHGRTFRVYASADRFGVELGGALKNVYAIIAGMAVALGMGENTKSMLITRALAEMTRFAVNQGANPMTFLGLAGVGDLIVTCSSPKSRNYQVGFALGQGLSLEDAVTRLGEVAEGVNTLKVLKAKAQEVGVYMPLVAGLHAILFEGRTLNQVIELLMRAEPKTEV

SEQ ID NO: 17879 - protein, 363 aa, Prochlorococcus marinus
MNENSSQTIKELSENQEIKNSSELDNDAASQNEEDLSFEKSDIPSADSSSSRTNTDFDNAGFTQEEFASLLGKYDYNFKPGDLVKGTVFALEPKGAMIDIGAKTAAFMPVQEVSINRVEGLNDVLQPSESREFFIMSEENEDGQLALSIRRIEYQRAWERVRQLQKEDATIYSEVFATNRGGALVRVEGLRGFIPGSHISARKIKDDLEGEYLPLKFLEVDEERNRLVLSHRRALVEKKMNRLEVGEVVVGNVKGIKPYGAFIDIGGVSGLLHISEISHEHIETPHNVLNVNDQMKVMIIDLDSERGRISLSTKALEPEPGDMLTDPQKVFSKAEEMAAKYKQMLFEQTDDIEEIPTASNEAE

SEQ ID NO: 17880 - protein, 314 aa, Bdellovibrio bacteriovorus
MTQDQKVENVIIIGSGPAGLTSAIYSSRANLEPLMIEGEEAGGQLMTTTEVENFPGFDHGITGPDLITVMRKQAERFGTRFITRNVTKVDFSQRPFKVWIGDKLHLAKSIIISTGASAKYLGLPSEKVYANRGVSACATCDGAFFRNQEIGVVGGGDTAMEEAQFLTRFATKVYLIHRRDHFRASKIMVDRALKNPKIEVLYNTEVIEVLGDGKGMTGAKIKGTLDGAVKELPITGLFLAIGHKPNTDLFKGVLDMNETGYLITQPNTTYTNIPGVFAAGDVQDHVYRQAITAAGTGCMAAIDAERWLEAQEAH

SEQ ID NO: 17881 - protein, 226 aa, Arabidopsis thaliana
MANHETIFDQLKKQIPVDEEEPLILNRDSSVGLVIVDVVNGFCTIGSGNMMVEESAKLAREFCDRKWPVLAFIDSHHPDIPERPYPPHCIIGTEESELVPALKWLESEDCATLRRKDCINGFVGSMESDGSNVFVDWVKEKQIKVIVVVGICTDICVFDFVATALSARNHGVLSPVEDVVVYSRGCATFDLPLHVAKDIKGAQAHPQVKSLMLLKLACLVFVVVVN

SEQ ID NO: 17882 - protein, 476 aa, Mycobacterium bovis
MVLRSLASPAALTDPKRCASVVGVAAFAVRREHAPDALGGPPGLPAPRGFRAAFAAAYAVAYLAGGERRMLRLIRRYGPIMTMPILSLGDVAIVSDSALAKEVFTAPTDVLLGGEGVGPAAAIYGSGSMFVQEEPQHLRRRKLLTPPLHGAALDRYVPIIENSTRAAMHTWPVDRPFAMLTVARSLMLDVIVKVIFGVDDPEEVRRLGRPFERLLNLGVSEQLTVRYALRRLGALRVWPARARANTEIDDVVMALIAQRRADPRLGERHDVLSLLVSARGESGEQLSDSEIRDDLITLVLAGHETTATTLAWAFDLLLHHPDALRRVRAEAVGGGEAFTTAVINETLRVRPPAPLTARVAAQPLTIGGYRVEAGTRIVVHIIAINRSAEVYEHPHEFRPERFLGTRPQTYAWVPFGGGVKRCLGANFSMRELITVLHVLLREGEFTAVDDEPERIVRRSIMLVPRRGTRVRFRPAR

SEQ ID NO: 17883 - protein, 268 aa, Oryza sativa
MVAEHPTPPQPHQPPPMDSTAGSGIAAPAAAAVCDLRMEPKIPEPFVWPNGDARPASAAELDMPVVDVGVLRDGDAEGLRRAAAQVAAACATHGFFQVSGHGVDAALARAALDGASDFFRLPLAEKRRARRVPGTVSGYTSAHADRFASKLPWKETLSFGFHDRAAAPVVADYFSSTLGPDFAPMGRVYQKYCEEMKELSLTIMELLELSLGVERGYYREFFADSSSIMRCNYYPPCPEPERTLGTGPHCDPTALTILLQDDVGGLEV

SEQ ID NO: 17884 - protein, 223 aa, Glycine tabacina
  misc_feature (90)..(90): Xaa can be any naturally occurring amino acid
PSPQEVVALYNQFNIRRMRIYGPSQEVLEALRGSNIQLLLDIPNDNLQNLASSQDNANKWVQDNIKNYANNVRFRYVSVGNEVKPEHSFXQFLVPALQNIQRAISNAGLGNQVKVSTAIETGALAESFPPSKGSFKSDYRGAYLDGVIRFLVNNNAPLLVNVYPYFAYIGNPRDISLDYALFRSPSVVVQDGSLGYRNLFDATVDAVYAALEKAGGGSLNIVV

SEQ ID NO: 17885 - protein, 287 aa, Debaryomyces hansenii
MSATTNTTNRASGTNPLILCGDSMFESSDMFSHPQGPDSVLENDIIPMKHESMEELSSHLPLDDQLNNDLQKTSPFNIHSSVLDSVFSSTMDENDQLQDHTPMFDELDVIMDEGKASLKDDWVSLFGGNDDSGKREETNVSMNAPTKRSYSEVDTFETIEESIEPELEPTAPKQLFTPTQSNLSTPIIDTQSKVTKNKKAKVDHLGCISYSKKQRSELLVPVVTETGDPMSMKRARNTEAARRSRARKLERMNQLEVKVEELIGEKTDLANEVLRLKEILIANGISH

SEQ ID NO: 17886 - protein, 713 aa, Glycine max
MADRSRSFMKDVKRVVIKVGTAVVTREEGRLAVGRLGALCEQIKQLNSLGYDIILVSSGAVGIGRQRLRYRKLINSSFADLQKPQLELDGKACAAVGQNSLMALYDILFTQLDVTSAQLLVTDNDFRDEDFRKQLTETVKSLLSLKVIPVFNENDAVSTRKAPYEDSSGIFWDNDSLSALLALELKADLLVLLSDVEGLYSGPPSDPHSKLIHTYIKEKHQNEITFGDKSRVGRGGMTAKVKAAVHAADAGIPVVITSGFAAENIINVLQGQRIGTLFHKDAHEWVQVKEVDAREMAVAARECSRRLQAISSEERNQILHKIADALEANEKIIRTENEADIAVAQEAGYEKSLVARLAIKPGKIASLANNMRIIANMEDPIGQVLKRTELSDGLILEKTSSPLGVLLIVFESRPDALVQIASLAIRSGNGLLLKGGKEARRSNAILHKVITEAIPDTVGGKLIGLVTSREEIPELLKLDDVIDLVIPRGSNKLVSQIKSSTKIPVLGHADGVCHVYVDKSANVEMARRIVLDAKIDYPAACNAMETLLVHKDLIEKGWLNDIVVDLRTEGVKLYGGPRASSLLNIPQAQTFHHEYSSLACTVEIVDDVYAAIDHINLYGSAHTDSIVAEDKEVANVFLRQVDSAAVFHNASTRFSDGARFGLGAEVGISTSRIHARGPVGVEGLLTTRWILKGSGQVVDGDKGIVYTHKDIAT

SEQ ID NO: 17887 - protein, 436 aa, Unknown
  Polaromonas sp. JS666
MNAPDSPNALAARSELTDLMQRMGSGAKVASAHMARASAAVKNWALSKLATLLRQNVKALDNANQRDLARAQAAGLAGPLLDRLRLSPKDIETVALGCEQLAAMPDVIGEIIGMKEQPSGIRVGQMRVPIGVFGMIYESRPNVTIEAASLAIKSGNACILRGGSEAIESNKALASLVQQALLDAGLPADAVQLVPTTDREAVGLLIAMPQYVDVIIPRGGKGLIERISREAKVPVIKHLDGNCHVYVDDPCDIDMAVRVADNAKTQKYSPCNASEGLLVARGVAAGFLPKIGAVYAAKGVEMRCDAEARALLAGVAGANLQPVSEQDWYEEYLAPIISIKVVAGIDEAIAHINQYSSHHTDAILTRDHMHAQRFLREVDSASVMVNASTRFADGFEFGLGAEIGISTDKFHARGPVGIEGLTSLKYVVLGNGEVRT

SEQ ID NO: 17888 - protein, 321 aa, Pasteurella multocida
MIKKIAVLTSGGDAPGMNAAIRGVVRSALAAGLEVYGIYEGYYGLYHNKVKQMTRYSVSDIINRGGTFLGSARFPEFKDPAVRAKCAEILRSHGIDALVVIGGDGSYMGAKLLTEEHGFPCVGIPGTIDNDVAGTDYTIGYQTALQTAVEAIDRLRDTSSSHQRISIVEIMGRHCSDLAISAGIAGGCEYIVASEVEFNREELIQQIERSIIKGKRHAIIAITELICDVNELAREIESRVKHETRATILGHIQRGGTPCAFDRILGSRMGVYAVDLLMQGKGGYCVGIQNEQLVHHDIIDAINNMRREFKADWLALSKRLD

SEQ ID NO: 17889 - protein, 427 aa, Oryza sativa
MAGVSAASTAGKIGSFLSKRPYAPPSWASHLSPAPSQTFSLGHFPTPIHKWNLPNLPNGTEVWIKGRVVCLWSLASDTRVWGKLQRDDISGMQLSGNKVRKLEFLMADAVAQGADCVITVGGIQSNHCRATAVAAKYINLDCYLILRTSKLLVDKDPGLVGNLLVERLVGAHIDLVSKEEYGKIGSVALADLLKKKLLEEGRKPYVIPVGGSNSLGTWGYIEAIREIEHQIQISGDVQFDDIVVACGSGGTIAGLALGSKLSSLKAKVHAFSVCDDPGYFHSYVQDLIDGLHSDLRSHDLVNIENAKGLGYAMNTAEELKFVKDIATATGIVLDPVYSGKAAYGMLKDMGANPAKWEGRKILFVHTGGLLGLYDKVDELSSLSGSWRRMDLEESVPRKDGTEVSDISLSKKSIRLNLYDKIQSRWLM

SEQ ID NO: 17890 - protein, 615 aa, Ashbya gossypii
MPAGSMMAGRDALLSDIRKGSRLKKAVTNDRSAPSIGGGGRVESSGSVGGSAPSLPSGAASGLPMGPQLGDILAGGIPKLKPVGEPVRALQVPPNASAGAPPVPSVRPPVRKHAGGSPEGARAPVSPVAPKLPETGAPPVPSARPPQHGGDGALPVGAPRLPAFGAPPVPGAGPARPDAFSTPPGGAPNLPNISPPPVPGAPPPVGAPKLPEAGPPPVPGVAPPVPSIVPPPPSAAAPPPTAAPPIPAAPPQPLAPQMPAAAQSAPPPAHPPPPPPPPPAVKAPVAPPISPPAAQQPPSIIPPASGGLPFLAEIQKKRDDRFVVDGGSNYTTQSSAQSHEPVKPQITSLRDHSQQPPPHLPTSAAPPLPQMAAPAPPIPSFAAPQIPQVQLPAAHQPADTVAEGTSTTHSEHPFLSEMQRRLDATSLAGSSPSRSTAERYETADTPASSAGDAAIPLGRPHVKQQPDRTFSPPQHIPPAAVPPPPPSIPPPVLDERPPEMIAKAPPPPPPPQAEGAFPPPASVPSHRQRLFSSAGGTSGSSSQVPVRESSIDTFTISNRVSTGDAVSRQPICIDDTRFKFSNAGGIPKPRVFQNKTKLYPSGRGSSVPLDLSLYS

SEQ ID NO: 17891 - protein, 420 aa, Streptomyces avermitilis
MSLLNTPLHELDPDVAAAVDAELNRQQSTLEMIASENFAPVAVMEAQGSVLTNKYAEGYPGRRYYGGCEHVDVVEQIAIDRVKELFGAEHANVQPHSGAQANAAAMFALLKPGDTIMGLNLAHGGHLTHGMKINFSGKLYNVVAYHVDETTGQVDMAEVEKLAKESRPKLIVAGWSAYPRQLDFAAFRRIADEVGAYLMVDMAHFAGLVAAGLHPNPVPHAHVVTTTTHKTLGGPRGGVILSTAELAKKINSAVFPGQQGGPLEHVIAAKAVSFKVAASDDFKERQQRTLDGARILAERLVRDDVKAVGVDVLSGGTDVHLVLVDLRDSELDGQQAEDRLHEVGITVNRNAIPNDPRPPMVTSGLRIGTPALATRGFQAADFTEVADIIAEALKPSYDADALKARVTALADKHPLYPGLK

SEQ ID NO: 17892 - protein, 794 aa, Oryza sativa
  misc_feature (779)..(779): Xaa can be any naturally occurring amino acid
MEMEMEDNKAPSPPSPMESDVAGEKRKREDDASSSAVLAAANNTGGAQHPMWKTSLCSFFRRRAASSADGCSHGDSCRYAHSEEELRPRPDGTWDPTSDRAKKLRKVAADEVEEEVVTIDDKALDKCLVGLPRGWANDRLKTFLQDKARTNYSSILPPALLLGISYATAKKKKGMTVGFVTFENIEQLKNAIEVLTENQSGGKEIKIADANRRSHQKLHTEKPVSDNGVTTENGTSVDVPPGETSAPEAAISNKKSVRDAVTPLAHMSYNDQLEHKKNSVAQILKRLTRNARKACPTGIPLPDWVFKSKEIGGLPCKLEGILESPVINGYRNKCEFSVGFSLEGKKTVGFMLGNFREGVTAVEEPVDCPNVSEISCKYALMFQDFLQSSSLPVWNRVDNCGFWRQFTVREGRCQAQAVAQNAENQISEVMLIVQVCSTGVDDAVMKDEFDKLTVALQQGAATCSPPLPLTTIVVQDHKGISNAAPADCPLIPLLVPKVDQSEGTVDKTRIHDHIGNLWFSISPTAFFQVNTLAAERLYTLAGDWANLNSGTLLFDVCCGTGTIGLTLAHRVGMVVGIEMNESAVSDAERNALINGVSNCRFVCGKAEDVMGSLLTEYLGSPQQDIPVSEGAVSGTVKDEEVIDSSKNSGENLDSSMQKNDNGESQQLGDAPADSSSSAIDEIKGNSNDRVGNGLEGSHDEYNEVAGEDIHGEASLINESVDLKVSDCLEDRKTSDDGSSISNNDVTAATACQFEDIVAIVDPPRVGLHPTDQAYTLNLXVIKALRTHPRIRRLV

SEQ ID NO: 17893 - protein, 449 aa, Bordetella parapertussis
MGPQLVSWKNKRNLSPEILPMSQAPAHSLPSYLDAEHLGPWGIYLQQVDRVTPYLGPLARWVETLKRPKRALIVDVPIEMDNGSIAHFEGYRVQHNTSRGPGKGGVRFHQDVTLSEVMALAAWMSIKNAAVNLPYGGAKGGVRVDPRTLSHSELERMTRRYTSEIGVIIGPSKDIPAPDVNTNAQTMAWMMDTYSMNEGATATGVVTGKPIALGGSLGRVEATGRGVFVVGCEAARDLNLDVSKARIVVQGFGNVGGTAARLFHEAGAKVIAVQDHTGTIHNDGGLDVHKLLAHVGNQGGVAGFTGAQQLADDDFWGLETDFLIPAALEGQINENNAARVRAKVVVEGANGPTTPEADDILRENGVYVVPDVLANAGGVTVSYFEWVQDFSSFFWSEEEINQRLERLMREAYSAVSQVAKEHKVTLRTAAFIVACTRILQARQVRGLYP

SEQ ID NO: 17894 - protein, 343 aa, Solanum peruvianum
MEMDLPVSAIGFEGFEKRLEISFVEPGLFADPNGKGLRSLTKAQLDEILGPAECTIVDNLSNDYVDSYVLSESSLFVYSYKIIIKTCGTTKLLLAIPPILRLAETLSLKVQDVRYTRGSFIFPGAQSFPHRHFSEEVAVLDGYFGKLAAGSKAVIMGNPDKTQKWHVYSASAGTVQCNDPVYTLEMCMTGLDREKASVFYKTEESSAAHMTVRSGIRKILPKSEICDFEFEPCGYSMNSIEGAAVSTIHITPEDGFSYASFESVGYDPKTTELGPLVERVLACFEPAEFSIALHADVATKLLERVCSVDVKGYSLAEWSPEEFGKGGSIVYQKFTRTPYCESP

SEQ ID NO: 17895 - protein, 706 aa, Nocardia farcinica
MVQPDHSPSDVTPLGVWPGNAYPLGATYDGAGTNFSLFSEVAEAVDLCLIDRDGAETRVRLDEVDGYVWHAYLPTIGPGQRYGFRVHGPYDPERGLRCDPSKLLLDPYGKAFDGDFDDDPSLYTFGLDSLGHTMTGVVINPFFDWGADRAPNRPYHETVIYEAHVKGMTMTHPDVPEELRGTYAGIAHPAVVEHLKSLGITAIELMPVHQFLHDRVLLDQGLRNYWGYNSFGYLAPHNGYAASPRGGAAVTEFKAMVRALHAEGIEVILDVVYNHTAEGNHLGPTIAFRGIDNAAYYRLVEDDPSKYMDYTGTGNSLNVRHPHTLQLIMDSLRYWILDMHVDGFRFDLAATLARELHDVDRLSTFFDLVQQDPVVSQVKLIAEPWDVGEGGYQVGNFPGLWTEWNGKYRDTVRDYWRGEPATLGEFASRLTGSSDLYEATGRRPSASINFITAHDGFTLRDLVSYNEKHNEANGEDNRDGESHNRSWNCGVEGPTDDPEILALRAKQSRNLLATLILSQGTPMLAHGDEMGRTQQGNNNVYCQDSPLSWMDWSLAETNADLLEFTRRVIGLRTEHPVFRRRRFLAGRPIRSAGAARDIAWLTPGGEEMTPADWDSGFGKSLAVYLNGQGIPEPGPRGERITDDSFLLCFNAHHDPMDFVLPGPGYGGPWLVALDCSAPDGRAEAQYDAAATVTVPARCLLVLRCPE

SEQ ID NO: 17896 - protein, 325 aa, Solibacter usitatus
MTITLGATSTADDVLSGVNLHGKRILVTGVSAGIGVETARALAAHGAHVVGAARDLAKAEAATAQVQKDAAANGGGFELTALDLADLKSVRACADGLIAKGEPFDVVIANAGVMATPFGHTADGFETQFGTNHLGHFVLINRIASLIRTGGRLVNLSSAGHRISNVDVEDPNFERTPYDPMIAYGRSKTANILFAVAFDQRHRSRGVRATAVHPGAIQTELGRYMERAQLESMIDRINQQLAAEGKGPFEWKTIPQGAATSVWAGVLAPADEIGGRYCANCQVGRIVRGDAVITAAGEGVREYALDPHNAAALWKKSEELVGESY

SEQ ID NO: 17897 - protein, 570 aa, Unknown
  delta proteobacterium MLMS-1
MANHPDTTTTLPTEGESFADLFEQSIQVADVGEVVNGEVIAVGKDYVLVDIGDKSEGEIDITEFRNEEGEIEVKVGDTFEVYVEKREPEGGIKLSRERAIGIKVWEEIARIQEADSTIAGRIDSRVKGGLSVDIGVPAFLPYSQIDLRPVRDLDALIGESFDFKILKFNRRRNNVVISRRAIMEEARQQLRNEMRGTLEEGQVLTGTVTNITDYGVFVDLGGMDGLCHITDLSWGRVSHPSKMFKVGDEIQVKVLKYDQENDKVSLGVKQLKSDPWETIQQRYPVGAKVPGKVVSITDYGAFVELEEGVEGLVHISEMSWSKKSRHPSKIVTVGDEVEVSVLNVDPEAKRISLGMKQLQPNPWDMVAENYPAGSIIEGKIKNITDFGIFIGIEEGIDGLIHVSDLSWTERIKHPGEKYAKGETIQAVVLKIDKENERFSLGIKQLQPDPWEAAVEKYAIGTKLEGKITNVTDFGVFVELEEGIEGLIHVSELSKEKVETPVGLYNVGDTIEARVINVSAKDRKIGLSIKALSGEDEEARLEDFKQQQAKSGPSTLGDLLKEEMNRDKDEA

SEQ ID NO: 17898 - protein, 343 aa, Solanum peruvianum
MEMDLPVSAIGFEGFEKRLEISFVEPGLFADPNGKGLRSLTKAQLDEILGPAECTIVDNLSNDYVDSYVLSESSLFVYSYKIIIKTCGTTKLLLAIPPILRLAETLSLKVQDVRYTRGSFIFPGAQSFPHRHFSEEVAVLDGYFGKLAAGSKAVIMGNPDKTQKWHVYSASAGTVQCNDPVYTLEMCMTGLNREKASVFYKTEESSAAHMTVRSGIRKILPKSEICDFEFEPCGYSMNSIEGAAVSTIHITPEDGFSYASFESVGYDPKTTELGPLVERVLACFEPAEFSIALHADVATKLLERVCSVDVKGYSLAEWSPEEFGKGGSIVYQKFTRTPYCESP

SEQ ID NO: 17899 - protein, 299 aa, Mycobacterium smegmatis
MPDQDSHRFSPARVAVVQFNPQVGVENLKANSEAVYERLQQAVAGGANLIVLPELATTGYTFESREEAYAHAEPVPSGATVTGWAEFAAAHDVYIVGCLPELDGVELFDTAVLVGPEGYIGKYRKTHLWNEEKLFFSPGDLGYPVFHTRIGRIGLLVCWDIWFPETARIVAQQGADIICIPTGWVWTPPPLYDDSGTCMAAYLTMTAAHVNNVFIATADRIGTERTSGFMGNSLIAGTNGWPIDRIAGPDEDTILYADIDITASRGAPIWNQFNDLHRDRRTDLYDQLLGYRGGQALPR

SEQ ID NO: 17900 - protein, 458 aa, Pyrococcus furiosus
MEMAIRVPEAFDMLCNQCSMSLAGGCTIRGVCGKDPDLNSLQEALLYGIKGTSAYYYHALEMGYDDPEIGHFLSKALYSTLTNVNFDKNRFLQLILENGRVHLEAMKLLDKAYVETFGRPEPVEVPTGTAEGHGILVTGHSYKALYELLKQIKERGLEEEIKVYTHAEMFPAHAYPELRKFKALYGNWGGSWVQQRKEFAEFPGVIVGTSNCVQQPTKAYKDRIFTVGIAGLEGVPHIEDYNFEPVIERALETPRMKAYDGGKLLTGFHHTNVLAMKDKLIELINEGKIRHIFVVGGCDTPHKGMGYYERLTELIPKDAIILSAACGKFRYNARNYGTIEGIPRFLDFGQCNNVYSIIEIAIALANELGTDVNSLPVSIVLSWMEQKAVAILYSLLYLGIKGIYLGPKPPEFLTPNVFEALRKQFDLRLISDPERDLRDMLSKGISVEESAPLAEELD

SEQ ID NO: 17901 - protein, 187 aa, Wolbachia endosymbiont
MQKTSKDGYRSRSAYKLVEMDNKFKLFQEGQKIIDLGASPGGWLQVASQKGANVVALDVKPMNAINGVEFIQCDIINEFEILREKFKDQKFDVILSDMAPESCGLKSLDHIRIMLLCEAALNFAKHFLSHGGTFVVKIFQGESDKDFCNELKKMFKTVKYFKPKSSRSESTEMYLVSLGFIGSRLSI

SEQ ID NO: 17902 - protein, 391 aa, Pyrococcus furiosus
MKSVKLLDGVYWVGVKDWSRRIFDSLIPLPEGTSYNAYLVVGNEKSALIDTVNPGFERELEEKVSEIVPLKEIDYVVMNHAEPDHAGAIPYIMERNKKALLITTEKGKELAKAYYNVPDERIIVVKDGDEVDLGGKTLRFIEAPWLHWPETMFTYLVEDKVLFPCDFFGAHTAHGLYDDEVPSIIEYAQRYFGEIMMPFAGMAKRAMEKLKGLEIKMIAPSHGPIYRNPERILKAYESWVNGETREKVLVAYVSMWGSNREMAKELADLLVAKGIDVKVYDLVSADIGELAKDLVDSRAIVLAAPTVLGSAHPLAVYAAYLVKALRPPAKYAVLIGSHGWHGRSIDAILEILKGANFEVLGTVDAHARPKEEDYKALHSLADLLAKKVRGE

SEQ ID NO: 17903 - protein, 343 aa, Solanum peruvianum
MEMDLPVSAIGFEGFEKRLEISFVEPGLFADPNGKGLRSLTKAQLDEILGPAECTIVDNLSNDYVDSYVLSESSLFVYSYKIIIKTCGTTKLLLAIPPILRLAETLSLKVQDVRYTRGSFIFPGAQSFPHRHFSEEVAVLDGYFGKLAAGSKAVIMGNPDKTQKWHVYSASAGTVQCNDPVYTLEMCMTGLDREKASVFYKTEESSAAHMTVRSGIRKILPKSEICDFEFEPCGYSMNSIEGAAVSTIHITPEDGFSYASFESVGYDPKTTELGPLVERVLACFEPAEFSIALHADVATKILERVCSVDVKGYSLAEWSPEEFGKGGSIVYQKFTRTPYCESP

SEQ ID NO: 17904 - protein, 195 aa, Triticum aestivum
  misc_feature (133)..(133): Xaa can be any naturally occurring amino acid
  misc_feature (140)..(140): Xaa can be any naturally occurring amino acid
  misc_feature (151)..(151): Xaa can be any naturally occurring amino acid
  misc_feature (159)..(159): Xaa can be any naturally occurring amino acid
MGRRPARCYRQIKNKPYPKSRYCRGVPDPKIRIYDVGMKRKGVDEFPYCVHLVSWEKENVSSEALEAARIACNKYMTKSAGKDAFHLRVRVHPFHVLRINKMLSCAGADRLQTGMRGAFGKPQGTCARVDIGXVLLSVRXKDNNAAHASEXLRRAKFKXPGRKNIRPKWGSQFTRLQLIKTGKCPKGNQLPEHET

SEQ ID NO: 17905 - protein, 223 aa, Glycine latrobeana
PSPQEVVALYNQFNIRWMRIYGPSQEVLEALRAGSNIQLLLDIPNDNLKNLGSSQDNANKWVQDNIKNYANNVRFRYVSVGNEVKPEHSFAQFLVPALQNIQRAISNAGLGNQVKVSTAIETGALAESFPPSKGSFKSDYRGAYLDGVIRFLVNNNAPLLVNVYPYFAYIGNPRDISLDYALFRSPSVVVQDGSLGYRNLFDATVDAVYAALEKAGGGSLNIV

SEQ ID NO: 17906 - protein, 217 aa, Glycine falcata
ALYNQFNIRRMRIYGPSQEVLEALRGSNIQLLLDIPNDNLQNLASSQDNANKWVQDNIKNYANNVRFRYVSVGNEVKPEHSFAQFLVPALQNIQRAISNAGLGNQVKVSTAIETGALAESFPPSKGSFKSDYRGAYLDGVIRFLVNNNAPLLVNVYSYFAYSDNPRDISLDYALFRSPSVVVQDGSLGYRNLFDAMVDAVYAALEKAGGGSLNIVVS

SEQ ID NO: 17907 - protein, 227 aa, Glycine soja
LGNNLPTPQEVVALYNQANIRRMRIYGPSPEVLEALRGSNIELLLDIPNDNLRNLASSQDNANKWVQDNIKNYANNVRFRYVSVGNEVKPEHSFAQFLVPALENIQRAISNAGLGNQVKVSTAIDTGALAESFPPSKGSFKSDYRGAYLDGVIRFLVNNNAPLMVNVYSYFAYTANPKDISLDYALFRSPSVVVQDGSLGYRNLFDASVDAVYAALEKAGGGSLNIV

SEQ ID NO: 17908 - protein, 278 aa, Unknown
  Mycobacterium sp. JLS
MAGRTIVITGASDGVGAAAAKRLSRSGENVVVVGRSPQKTAAVADALEADSFVADFSDLAQVRDLAQRLLDAYPRIDVLANNAGGMVNTRETTVDGFEKTFQVNHLAPVLLTTLLLDRLVQCRASVLNTSSMANKFVRTGFDDLDAVQKQSGSVAYSSSKLANILFTKELHRRYHGAGISTAAFHPGPVASNFSAEVDNPMFGVIYRSPLRHLALIGTEQGSDELVWLASATPGVDWRSGEYYHKHKVAKANKLADDAGMAERLWENSLELLGERAVS

SEQ ID NO: 17909 - protein, 556 aa, Yersinia pestis
MWSLKESMEIFFTILILILVVSLSGVVTRMLPFQVPLPLMQIVCGALLAWPNFGLHVNFDPELFLVLFIPPLLFADGWKTPTREFIHHGREILGLALALVLVTIVGIGYLIYWMVPGIPLVAAFALAAVLSPTDAVALSGIVGKGRIPKSIMGVLEGEALMNDASGLVALKFAIAVAMGTMIFTVSGATLEFLKVAIGGLLAGVAITWLYSKSLRIMSRWSGDDPATQIVLLLLLPFASYLVAEHLGVSGILAAVAAGMTISQSGIIRNAPLAMRLRADSVWSMLEFVFNGMVFILLGLQLPGILETSITQAELDPTIQTWNLFADVAIIYGALLLLRFGWLWSMKKISKRVLTKRPLQFSDYTTRELWVASFAGVRGAITLAGVLSIPLFLSDGSAFPSRYQLVFIATGVILLSVIIGVIALPPLLRGVVVADKSASREEIRLARAAMAEVAIVSLNKMEERLMTSSEENIDSELLKEVSSRVIGTLRRRTGSKDEVENTLLIENLERRFRLTALRAERGELYHLRATQKISNETLQKLLHDLDLLEALLIEKEG

SEQ ID NO: 17910 - protein, 373 aa, Haemophilus somnus
MAKRDYYEILGVQKGADDKEIKRAYKRLAMKYHPDRTKGDKESEEKFKEINEAYEVLADKEKRAMYDQYGHAAFEQGGGAGGFGGFSGADFGDIFGDMFGDIFGGGRSRQRVVRGEDLRYDIEISLEEAVKGCKKDIQINTLVHCGTCHGSGAEAGSKIESCPTCHGAGRVRRQQSFFVTEQTCPHCHGTGKKIEKPCHTCHGEGRVHKTQNLTVTIPMGVDTGNQLRLAGKGAAGENGAPAGDLYVVIHVKKHHIFERDGNNLYCEVPISFTMAALGGEVEIPTLDGRLKVKIPAETQTGKLLRLRGKGITSRGYAGDLICEIVIETPIKLNEEQKELLRKLEESLEGKTLQRPKSSGFLDGVKKFFDNLGK

SEQ ID NO: 17911 - protein, 309 aa, Haloarcula marismortui
MAKRPAERAGVADIDCTGMQVLVTGSTSGIGREAALSLGRLGADVIVHGRDADAGAAVVSELSGLGVDAAFVQADFAAVDEVRSLAATVRDETDGLDILVNNAGGLFRQGRLTDIGVEYTFHVNHLAPYLLTTELLDHLNAGARVVTTASSAHRGTSLDLDRVTTVDSYTGTWAYSHSKLANVLFATELARRLETTGRDVVSNCLHPGAIPGSGFSRFLPGPIPQFVKLFDAVPGITSVEDGAAEILHLAVSSRIGDVSGRYFAGQRPATPSHAARDRAAASRLWRRSADLLGIDVPLGDVQSSAPTEN

SEQ ID NO: 17912 - protein, 107 aa, Dehalococcoides ethenogenes
MVMEITDQSFAAEVLKSDKPVLVDFWAPWCGPCRMVAPIIDKLSTKYEGKFKFCKLNVDENKTTAAQYRVMSIPTLLFFKSGQVADMVVGAVPESALSQKIDQLLQK

SEQ ID NO: 17913 - protein, 305 aa, Halobacillus halophilus
MSYVRNVQSLIGHTPMIELTHSDIPNQARIFAKLEFMNPGGSIKDRLGLKLIEDALNRGLLKPGGTIIEATAGNTGIGVALAAVGKGYRVVFVTPEKFSQEKQTLMRALGAEVINTPTEEGMRGAIKKADELVNDIPDSFNLQQFNNQANPDAYYETLGPEIHTDLNGEIDIFLAGAGTGGTFMGTSRYLKEQNPAIKTVIVEPEGSVINGGKAGPHDTEGIGMEFLPFYMDTSYFDAIHTIPDSIAFQRVKELALNEGLLVASSSGAAFEAALREAEQAEPGARIVTVFPDSSERYLSQGIYEE

SEQ ID NO: 17914 - protein, 461 aa, Rhodococcus erythropolis
MRIAEHVVDLIGNTPLVKLTSVTGENFGTVAAKVEYLNPGGSSKDRIAVKMIDAAEASGELKPGGTIVEPTSGNTGIGLALVAQKRGYKCVFVCPDKVSEDKRNVLRAYGAEVVVCPTAVAPDNPNSYYSVSDRLTREIPGAWKPNQYSNPGGPESHYETTGPEIWADTDGKITHFVAGVGTGGTITGTGRYLKEVSGGKVKVIGADPEGSVYSGGTGRPYLVEGVGEDFWPSAYDPSIPDEIIAVSDADSFEMTRRLAREEGLLVGGSCGMAVVAALEVAKREGPDALIVVLLPDGGRGYLSKIFNDQWMASYGFLRTPLDGKTNVPTVGDVLRGKSGELPDLVHTHPSETLRDAIEILREYGVSQMPVVGAEPPVMAGEVAGSVSERDLLSAVFEGRAHLADSVEKHMSKPFPLIGSGEPVSAATKALGDTDALMVVDDGKPVGVITRHDLLGFLSSDS

SEQ ID NO: 17915 - protein, 523 aa, Zea mays
GSSKTSPLQTATRRTPRPAPLDRLAPTVPPRRAASSGTHLADRHMDPTAAPGSGGTPADSDATSPTNTTVTLPPLTLRDVPRLASSSPAAAAAAAVPNPISRHPYFHPPANFYISPGDVSLRHAFFDLVSAAPTPLVAYRRGGPRRDLAVDPAAARAALVTCGGLCPGLNTVLRELVVGLQELYGVRHVFGVAAGYRGFYGADEDHVRLHPAAVDDWHKKGGTVLKTTRGGFDLGKIVDGIVARGYTQIYAIGGDGTMRGALAIFEEFKRRGLNISITGIPKTVDNDIGIIDRSFGFQTAVEVAQQAIDAAHVEAVSAVNGAGIVKLMGRSTGHIALHATLSSRDVDCCLIPEVDFYLEGKGGLFEFLYERIKKKGHAVVVVAEGAGQELIPRTDDQKREQDESGNTVFLDVGPWLKSELGRWWKREHPDELFTVKYIDPTYMIRAVPANASDNLYCTLLAHSAIHGVMAGFTGFVPGPINGTYSYIPLEDVAVAKNPVDVNDHKWAWVRSVTNQPDFLKSQA

SEQ ID NO: 17916 - protein, 420 aa, Unknown
  Polaromonas sp. JS666
MTSELGNSRKAWSVLIVSTLAFTVCFMVWMMFGVIGIPIKKMLNLNATEFGLLAATPVLTGSLIRVPLGIWTDRYGGRMVMAILMAVTVPAIWLMSYATAYWHFLVIGLFVGLAGGSFSVGTPYVARWFPKNRQGMAMGVYGAGNSGAAVNKFVAPVLLVAFGWAMVPQVYAVIMLGALVLFWLFSYSDPSHLVPSHVKFSDQLKALKDPKVIKYCQYYSIVFGGYVALSLWMVQYYVGEFGLDIRVAALLAACFSLPGGVLRAFGGVLSDRYGAHSVTWWVMWVSWVCLFLLSYPQTDFTILTVNGPASFHIGLNVYTFTALMFTLGIAWAFGKASVFKYISEDYGANIGGISGIVGLAGGLGGFVLPIIFGGLMDLTGIRSSAFMFMYGVVCVSLMWMYWTEVRGTEVMGRNAAGAQA

SEQ ID NO: 17917 - protein, 307 aa, Escherichia coli
MVSTTYLWYKARRTSDPFRIHRLDGSDNLTLCNNTHVSAHIPGCPLGSVIWDTWRHNPNFYIEVLIMATVSMRDMLKAGVHFGHQTRYWNPKMKPFIFGARNKVHIINLEKTVPMFNEALAELNKIASRKGKILFVGTKRAASEAVKDAALSCDQFFVNHRWLGGMLTNWKTVRQSIKRLKDLETQSQDGTFDKLTKKEALMRTRELEKLENSLGGIKDMGGLPDALFVIDADHEHIAIKEANNLGIPVFAIVDTNSDPDGVDFVIPGNDDAIRAVTLYLGAVAATVREGRSQDLASQAEESFVEAE

SEQ ID NO: 17918 - protein, 171 aa, Leuconostoc mesenteroides
MAIETAIFAGGCFWCMVQPFDSLDGIEKVRSGYTGGHVENPTYEQVLTHTTGHTEAVKIWFDSEKISYRELVEIYWEQTDPTDAMGQFQDRGDNYRPVIFVNSPEQREIAEESRAALAASNRFDEPIVTKIEDAKPFYEAEEYHQDFYKKDPEREALEMAQRLQFKADKWN

SEQ ID NO: 17919 - protein, 352 aa, Schizosaccharomyces pombe
MLSREEQNRCFVPVRRILDNEDLKLFKEGDAYKLIDSFICDLDEAVKDKPISASIPQSSSIEHVLNILDRVGEIKQENPAIDNMGSRFGNPAFQSFYDQVYIETPKLHQVFGIEHNAAMEAGRYFYESFGNRKRIDYGSGHELYFMSWLLILKQLGIFTKNDYPALVVRVFVKYVELMRSLQIFYTLEPAGSHGVWGLDDFHFLPFLFGAAQLVNHKYLRPKHVRDPEILEMCRADYMYLGYVYFLNKLKPSVSLRFHSPMIDDISAVKTWSKVNEGMIKMYRAEVLGKLPIMQHYLFGHLIPASPGMSPAPQDGDDSEVTHVHSHYADCCGIKIPSAISAAKNNGSRIPFD

SEQ ID NO: 17920 - protein, 296 aa, Triticum aestivum
  misc_feature (55)..(55): Xaa can be any naturally occurring amino acid
  misc_feature (64)..(64): Xaa can be any naturally occurring amino acid
MPFPWGPQTLKRPGWFFSPRPLAKKLWVPPVNEKSPVLTPPPCLMVPSPGNSGFXPLGVWKDPXFFKWFRGAGLFHGGLGNAPPFGIFIGEGVKGLPLFEPGAQPGPVAPFSFGWVLGTQLLLMGWVESKRWVEFFNPESQSVEWATPWSRTTEKFPNFTGEQGYPGGKFFEPLGLGGETKDGVYIPDTEKLERLKVAEIKQLRLAMLAMVIFYFEAGQGKTPLGALGLKNHFWLAPLVGEGFLHCPRTPGLHGIGWRSKNHHQCMCVRDFFGVVCVNRMGNQVLFIFPGYVPCKI

SEQ ID NO: 17921 - protein, 305 aa, Glycine max
MASAVEKEGGASEETLSLELPAPPGWKKQFIPKKAGTPKKNEIVFTAPTGEEINNRKQLEKYLKAHPGGPAVSEFDWGTGETPRRSTRISEKAKAAPPTQREPPKKRTKRSSASQKEISQEEKEEETKEAEMQEADDTTKGDNDIEKEKVVVNENHDKSVEDTDVNKSTRYGEEAKAGENVEVPIEEEKSNAADGELPALKDKADDKVTEGSEVFLRKDEEKIEQPQEETKEYSGFGEPEKLETCTTADKTVEVEGVNKEDHVKSTHEFEVGEIEGTKVNGEEHHKLDEINKAEAELTVNGTHES

SEQ ID NO: 17922 - protein, 306 aa, Glycine max
MTPYSLNPPGPSIQAGQTQLFNISPNNQDCRTIFNIFDPRKTRIEIGGLRDNYHQQDDKMMVLHDGSSSNSNKSSFNNNISPEPVVVMVDPIISSACDQQHNLPYEEESKNIDDHGSGNKWMSSKMRLMKKMMRPSMSPTTDKAINSGLESSSSRYSQRSLCNNNASSTTRVCSDCNTSTTPLWRSGPKGPKSLCNACGIRQRKARRAMTKATSGLITPITCAKTRVHNKEKKSRANHFAQFKNKYKSTTTTSAGSSEGVRKLEYLKDFAISLRSNNSDFEQGFPRDEVAEAALLLMDLSCGFVHL

SEQ ID NO: 17923 - protein, 151 aa, Brassica napus
  misc_feature (6)..(6): Xaa can be any naturally occurring amino acid
  misc_feature (12)..(12): Xaa can be any naturally occurring amino acid
  misc_feature (16)..(16): Xaa can be any naturally occurring amino acid
  misc_feature (19)..(19): Xaa can be any naturally occurring amino acid
  misc_feature (21)..(21): Xaa can be any naturally occurring amino acid
  misc_feature (25)..(25): Xaa can be any naturally occurring amino acid
  misc_feature (28)..(28): Xaa can be any naturally occurring amino acid
  misc_feature (32)..(32): Xaa can be any naturally occurring amino acid
  misc_feature (38)..(38): Xaa can be any naturally occurring amino acid
  misc_feature (55)..(55): Xaa can be any naturally occurring amino acid
  misc_feature (58)..(58): Xaa can be any naturally occurring amino acid
  misc_feature (68)..(68): Xaa can be any naturally occurring amino acid
  misc_feature (77)..(77): Xaa can be any naturally occurring amino acid
  misc_feature (80)..(80): Xaa can be any naturally occurring amino acid
  misc_feature (85)..(85): Xaa can be any naturally occurring amino acid
  misc_feature (87)..(87): Xaa can be any naturally occurring amino acid
  misc_feature (92)..(93): Xaa can be any naturally occurring amino acid
  misc_feature (97)..(97): Xaa can be any naturally occurring amino acid
  misc_feature (102)..(102): Xaa can be any naturally occurring amino acid
  misc_feature (104)..(104): Xaa can be any naturally occurring amino acid
  misc_feature (106)..(106): Xaa can be any naturally occurring amino acid
  misc_feature (108)..(109): Xaa can be any naturally occurring amino acid
  misc_feature (115)..(115): Xaa can be any naturally occurring amino acid
  misc_feature (125)..(126): Xaa can be any naturally occurring amino acid
  misc_feature (130)..(130): Xaa can be any naturally occurring amino acid
  misc_feature (135)..(135): Xaa can be any naturally occurring amino acid
  misc_feature (142)..(143): Xaa can be any naturally occurring amino acid
  misc_feature (146)..(146): Xaa can be any naturally occurring amino acid
MASSMXSSAAVXTSPXQAXMXAPFXGLXSSAXFPVTRXANNDITSIASNGGRVSXMKXWPPVGKKKFXTLSYLPDLXEVXLGKEXYXLLRNXXIPCXEFELXHXFXYXXHGTTPXYYDGRYWTMXXLPLXFGCTXSAQVLKXXQEXKRSTL

SEQ ID NO: 17924 - protein, 566 aa, Oryza sativa
MEAGAADEETPLIQQLPPEEQCSQYTCDGTVNSDKKPALKQSTGHWRACFFILGAQFAETLCFFMVSKNLVMYLTSALHESNIDAAQSVSIWIGTSFFTPLIGAFLADTYWGRYWTTVISLFIIIIGMLIVTVSSSPLFLNSSYYNWNICRATVYTGLYLTAVGSGSCSPGIHYFGADQFDSADPVERLAKGSFFNWYYFSMNVGSLLSTTLLVWVVANIGWSVGFAIPMLLSGFGLALFFAGRKVYRYKKQGGSPLTRVSQVVVAAVRNHRLKLPDDSSLLHEVSKVTEDDYRTQLTTQFRFFDKAAILSDEISPAQWSPWRLCTVSQVEELKILLRMFPVWVSMVVFFVVTAQITSTLIEQGMAMDGRVGPFTLPAASIATFDVISVLVWVPVYDTVLVPLARRVTGKDRGISHLQRIGVGLALAAVAMAYSAVVEARRLGTAPAPVSIMWQAPSYLVLGVAEAFSVIGMMEFFYEQSPESMKSLCTALGQLAIAVANYLNSGVLVVVAAATTRGGGAGWIPDNLDEGHLDYFFWMMAVVSVLNLLHFLHCSIRYRANNNTLSS

SEQ ID NO: 17925 - protein, 115 aa, Cryptomeria japonica
AGPAQGWSTLSQSKPIGSLPLMNTGTLMKQWKMGLKAKRSVKAAYKVKLVTPDGETEIECPDDQYILDAAEDAGIDLPYSCRSGSCSSCAAKVIEGEIEMEDQSFLDDDQIGSGF

SEQ ID NO: 17926 - protein, 498 aa, Propionibacterium acnes
MTSSTEASTSNPVDTDQQNVANTADGSVAVDDLGSPEAFLAAVDATIKYFNDGDIVSGTVVKVDRDEVLLDIGYKTEGVIPSKELSIKHDVDPFEVVNVGDEIEALVQQKEDKEGRLILSKKRAQYERAWGTIEQIKEEDGVVTGTVIEVVKGGLIVDIGLRGFLPASLVEMRRVRDLQPYVGQEIEAKIIELDKNRNNVVLSRRAWLEQTQSEVRQNFLHQLQKGQIRKGVVSSIVNFGAFVDLGGVDGLVHVSELSWKHIDHPSEVVEVGQPVTVEVLDVDMDRERVSLSLKATQEDPWQAFARLHQIGQIVPGKVTKLVPFGAFVRVEDGIEGLVHVSELAERHVEIPEQVVSVNDDVMVKIIDIDLDRRRISLSLKQANEGIDVESDEFDPSLYGMAASYDEDGNYIYPEGFDPETNEWKPGYDEQRIAWEQQYAEAQARWEAHRKQVIEAEQADQEAALTDGGAQSSYTSGPAEGSLASDEALQALRDKLTHN

SEQ ID NO: 17927 - protein, 436 aa, Salinibacter ruber
MNKQINSVAPMSDTTSEALSVDALAADCKAAARELSTLSTETKNRTLRRMADALEADEEAILAANGKDVSAAREEGLDDALIDRLVLNPDRITKMADALRDVASFADPVGEMGGTTKRPSGIEVGKMRIPLGVIGMIYEARPNVTADAAGLCFKAGNAVLLRGGSNAFHSNQAVAAALHTALEAEGVPPAAVTLIPTTDRAAVQEMLTLNQHLDLIIPRGGEGLIRFVDETSQIPVIKHYKGVCHLYVDEDADLEVAEDLLLDGKVSRPSVCNALETLLVHADVADDFLPRARALLDDAGVELRGDDRTRQLLPGVGAATEDDYAAEYLDLTLAARVVESDDEALNHIAEYGSNHTEVIVTDRLPTARRFVRSVDASVVLVNASSRFSDGGELGLGAEIGISTTKLHAYGPMGLEALTTEKFVVYGEGETRHPVEK

SEQ ID NO: 17928 - protein, 115 aa, Cryptomeria japonica
AGPAQGWSTLSQSKPIGSLPLMNTGALMKQWKMGLKAKRSVKAAYKVKLVTPDGETEIECPDDQYILDAAEDAGIDLPYSCRSGSCSSCAAKVIEGEIEMEDQSFLDDDQIGSGF

SEQ ID NO: 17929 - protein, 899 aa, Photobacterium profundum
MKRNKVSRRNFLKGSGFIASTAAGAGLFVAHNPELEAAPLTGEPTKRTTALAQCPYCGVGCGTIIQVENGKIVSMRPDKDHPTNYGLQCIKGLTAAEPMYVDRMEGDPYVRKDVWDEWNKPDHGDIEYISKTKGSFDEEHFIRVPYHDASDMVARKIAHFAKKYSGNSISLYGSGQLTMEGQYLENLFMKGVLGSNTIEANARMCMTSAVTGYFATLGSDTPPLAYDDIELADMVMHFGHNARESHPIIFWRIADHKKKKDIPTVVVDPRATGTNKGYADINDKNHVHVPLLNGDISFLNAIAHVLLKEHDDVIDWKFLKAHVTGWQEYIDGVKDNYSPEQVQDRMGGVNHDVSPEKIRRVAAMFADATRKRLARSKGKQEGEGYGGVIIMWGIGYNQHIHGQHNVISIINLLTLTGNLAKPGCGPFSMTGQPNAMGERFTGGLTGRLPFNEGLGNLKHRAHMAKMWRVPEKNLDNAASSPNPGYAVGMMERALKDDLKAMFLVYATHIDLPDQYNLVRPALAKTFNVVQEIYRHAPNNLYADVIFPACTWGEVNGVYISSERRINITEKAAQGPKGCRPDMDMVIDKGKEIAELLGMDGDKIFPYKRGKDGEYDAEEVFRDVCRASVGTDADLTGILDREKLDGISPYEQLKTLRGIQWPAPNYEAAKNGGTQRRYMMQEGQWENRPYGYFRTKDGKVHMKLCQQDYSQRKEITKKLMEFGVKKDHYTIDNQDLIIKARDMALTPDLPDEEFRGQSWQNVPKDKFPYWMGLGVVYEHFHTAKSNRSPTTRRLVPEMYVEMHAEDAKDLGIKDGEWVRVVSRRGSLEARAQVGGTDSLVKPARNSVPRGYMFGPWNLSVADSADPKKNKWLANGISNRCWDPVSGQVDFKKLACRIEKI

SEQ ID NO: 17930 - protein, 570 aa, Unknown
  Nostoc sp. PCC 7120
MSDSKPRDVQVLPIATNTKVLRARSWSRLRFEIEYALERGTTSNSYVIEGDKTAIIDPPVESFMKIYLEALQQTVNLKKLDYVILGHFSPNRIPTFKALLELAPQITFVCSLPAAGDLRAAFPDDNLNILPMRGKETLDLGKGHVLKFLPIPSPRWPAGLCTYDVQTQILYTDKIFGAHICGDDVFDDNWESFKEDQRYYFNCLMAPHAIHVEAALEKISDLQVRLYAVGHGPLVRTSLIALTQAYADWSKAQKDREISVALLYASAYGNTATIARAIALGLTKGGVAVKSINCEFATPEEIQTNLEQVDGFLIGSPTIGGHAPTPINTALGIVLKVGDNNKLAGVFGSYGWSGEALDMIEGKLRDAGYRFGLDTLKVKFKPDDVTLKFCEEVGTDFAQTLKKAKKVRVPQQAATPVEQAVGRIVGSVCVITAKQGDVSTGMLGSWVSQATFNPPGLTVAIAKERAIESLMYPGGKFALNILSEGNHLEYMKHFRKNFAPGEDRFANFTTTEADNGCTVLADALAYVECSVDQRLECGDHWVVYATVDNGKLLKPDDVTAINHRKTGNHY

SEQ ID NO: 17931 - protein, 723 aa, Aspergillus nidulans
MTSSSTQTATLAAGCFWGVEHLFRKQFGQGKGLLDAKVGYCGGNTASPNYRAVCTGDTGHAEALKITFDPSLVSYRSLLEFFYRMHDPTTKNQQGPDVGTQYRSAIFTHGDEQHKIAESVTEKVSKEWYKQPLSTEIIPAGQWWDAEEYHQLYLHKNPSGYECPAHFVRSFPPLSDHSSHLDRLQSSLVMHKWLPRGVGNWTLASQFFMRRYTGVDTVSGPANSIYQTVKAGQLSPRKLEQARMLYHYRVSYLICPLPRRYISTWTPAAHTHIQSTAISSTMASAVVVAMREALRHLKHVENHLRHHNQPNAANKVGKLSVEISQAVQEAMAYIPQCDVFDNMQDANGAVANRVAQQHANGGHQAMTNHPPPGGPIQQQAVVALLNEVQKEQNKPAHFESCPLQRLPPPPAAALQPHSWAQVAGSITSGSSHEIMQLMSPTLVTSCPGSKEGQNSDDGRSNDDLITFIPSSIPVLPEEKAGIIRILGRMNEASIAHITARIHEGPLQDIRIEAPDRARVVFQHLSHAEAFCEADKEMVVRLGFGRLGKGYRVEIAEIVDWTDDHRAMNQPIRERRRLSFARKGLFSYYKNIPGVLSPEAWKQDMRSIAGVGNIERLFVFNNGNGEWELVAMWWDQSLMLSKALATAIFTSTIIARRVLETVNRWKETKAVYRGVSVTYSSDPCEKELILTDDKCVLMRRHEKFRPNHPSYRPGKIRQGQPGRR

SEQ ID NO: 17932 - protein, 579 aa, Unknown
  Nostoc sp. PCC 7120
MVSMSTTGNAHTENVQHRLTVETVEIAPNTTAIRCLDWDRDRFDIEFGLQNGTTYNSYLIRGEQTVLVDTSHQKFRQLYLETLKGLINPKAIDYIIVSHTEPDHSGLVEDVLQLAPRATVLASKIALQFLEGLVHDPFSKRIVKSGDRIDIGKGHEIEFVSAPNLHWPDTIFSYDRKTEVIYTCDAFGMHFCDNRTFDEDLEAIEADFRFYYDCLMGPNARSLLNAMKRMGDLGKIKIIANGHGPLLYHHLDVLTECYQSWSQRQAKSETTVGLFYVADYGYSNLLVQAIGEGIQKTGVAVEMIDLSTAEIQEIQELAGRAAGLIIGMPPTTSVAAQAGISSLLSVVKDKQAVGLFECFGGDDEPVDTIRRKFIDLGVKEAFPAIRIKDVPGASAYQLCTEAGTDLGQLLTRERNIKQIKSLDVNMEKALGRISNGLYIVTTKKGDVSSAMLASWVSQASLQPLGFTIAVAKDRAIDSLMQVGDRFVLNVLEEGNYQELKKQFLKRLHPGADRFAGVRTQTAKNGSPILTDALAYMECEIQSSLECSDHYILYCTVEDGRVSKPDGLTAVRHRKVGNYY

SEQ ID NO: 17933 - protein, 173 aa, Pseudomonas fluorescens
MSLQELNTFPGVTAIPDSATRHFVFNHTMLRVKDITKSLDFYTRVLGFSLVEKRDFPEAEFSLYFLALVDKSQIPADAAARTEWMKSIPGILELTHNHGTENDADFAYHNGNTDPRGFGHICISVPDIVAACARFEELGCDFQKRLTDGRMKSLAFIKDPDGYWVEIIQPAPL

SEQ ID NO: 17934 - protein, 351 aa, Unknown
  Burkholderia sp. 383
MTHTQVVPLTRSRAPVPPRHCTFDVRDWEILSRYWHPVAFATEVGDRPLAVTLLDERIVLFRSGGAIVAARDVCPHRGAPLSRGWVVEDRLVCPYHGLEYAADGKCVRIPSQPDGPIPERLCLTTYAAQQAYGLVWVSLGGGELPLPDFPAWNAEGFQQILPPSIDIRASAGRQTEGFIDVAHFAWIHHESFADRRNPVVPQYSVERRENGLHAEYVSTVSNFPKSMQHRAPEGFLWRRVFEVDVPFFARLTVHFPEGGRLAILNAASPVSARLTRLFVPIARNFDHDLPLDDVYEFNRQVFEEDREIVEQQCPEDLPIDRSHEAPILADRSSGAYRRALGEIGLGQSYAR

SEQ ID NO: 17935 - protein, 338 aa, Arabidopsis thaliana
MNGEETTPFKRRQMTILMLPNDLLFNCLARISRLYYPTLSLVSTRFRSLLASTELYQTRTHLGRTERCLYVCFRLFTESDQLRWFTLCQGPFNSKKILVPISSPNFPSASWSDAAIVGPNIYAIGGLVNKNYSSSVMVMDCYSHTWREAPSMHVARLSHSVCVHDGKIYVTGGCKNLDSTNWMEVFDTQTQTWEFLQIPSEEIFGGSKYRSVEYEGTVYVKSEAKDVTYKLHKENVFYRYTDRRIEWYDSEKRLWTTLKGVEKLRSFSRVNLVNYGGKMAVVSVEYVFGKKEAKIWWAEIAIEKRQTGEIWGMLEWLDIVFRTNDKSYSLERALATTI

SEQ ID NO: 17936 - protein, 520 aa, Pseudomonas fluorescens
MLDANLKAQLKSYLERVTQPIEIVASLDDGAKSREMLDLLKDIASLSHQITLIDSGDDARKPSFSINRPGADISLRFAGIPMGHEFTSLVLALLQVGGHPSKASVEVIEQIRSLKGEFNFETYFSLSCQNCPDVVQALNLMAVLNPNIRHVAIDGALFQDEVNDRKIMAVPSIYLNGENFGQGRMGLEEILAKLDTGAIERQAEKISAKQAFDVLVVGGGPAGASAAIYAARKGIRTGVAAERFGGQVLDTMAIENFISVQETEGPKLATALEEHVKQYDVDIMNLQRADKLIPGKNGELHEVRFASGATLKAKSVILATGARWREMNVPGEQEYRNKGVAYCPHCDGPLFKGKRVAVIGGGNSGVEAAIDLAGIVSHVTLLEFDVQLRADAVLQRKLHSLPNVTVITSALTTEVTGDGQKVNGLRYKDRNTDELRTVELEGIFVQIGLLPNTDWLKGTIELSPRGEIIVDNRGETSIPGIFAAGDVTTVPYKQIVIAVGEGAKASLSAFDHLIRTSAPA

SEQ ID NO: 17937 - protein, 396 aa, Unknown
  Burkholderia sp. 383
MSTNETSGSRGDPVVIVGTGLAGYTVAREWRKLDGDTPLVMISRDDGSFYSKPALSNALAQRKTPEQLAMSDARTMAEQLRATIRTHCAVRRICADEHEIVLDDGSTQRYRALVLATGADARRVPCEGDGAADVLSINDLADYARFRGGLRDCRSVALLGAGLIGCEFANDLVAAGLTVTVIDPADAPLSRLLPTEAGRVFGHALSDAGVHLRLGTGVRSIARLARGYRLALTDGGHLEADLVISAIGLVPRVALARDAGLDVADGIVTDAWCRTSAPDIFALGDCAAIEGRVRPYVLPIMHAARALAQCLHGTPTRVAFPVMPIVVKTPAIPAVVVAADSGGRWTTEVGVGDAPRATRALCADPDSGRITGFALLDAATAEKAALLKTMAGDAAK

SEQ ID NO: 17938 - protein, 227 aa, Glycine soja
LGNNLPTPQEVVALYNQANIRRMRIYGPSPEVLEALRGSNIELLLDIPNDNLRNLASSQDNANKWVQDNIKNYANNVRFRYVSVGNEVKPEHSFAQFLVPALENIQRAISNAGLGNQVKVSTAVDTGALAESFPPSKGSFKSDYRGAYLDGVIRFLVNNNAPLMVNVYSYFAYTANPKDISLDYALFRSPSVVVQDGSLGYRNLFDASVDAVYAALEKAGGGSLNIV

SEQ ID NO: 17939 - protein, 362 aa, Streptomyces ambofaciens
MSRTAHLPTDPAPPATAAAKIFNYPHNAWYVAAWDHEVTGKQPLARTVAGIPLALWRTTEGRAIALADACWHRLAPLSKGRILGDELQCPYHGLRYNATGRCTGMPAQETINPSAVVPSYPVVERYRYVWVWVGDPDLADPATVPDMHQMDDPTWAGDGETIHADCNYQLILDNLMDLTHEEFVHSSSIGQEELSEAEFDVTHEGNTVTVTRWMRDIDAPPFWLKNMRDKFPGFSGKVDRWQIITFEAPGTIRIDVGVAKAGTGAPEGDRTQGVNGYVMNTITPETDRTSHYFWAFMRNYRLDSQTITTQLRQAVHGVFGEDEEMLCAQQRAIDANPEHEFYSLNIDAGGMWVRRIPIVSRI

SEQ ID NO: 17940 - protein, 473 aa, Yarrowia lipolytica
MRIFKQARPQVGLRAVRAAFGGPGKPAIRAPLHPRFFRHSARLQMQDPYKALGVESNASAKEIKKSYYQLAKKYHPDVNKEEDAKKKFEEVQKAYELLSNEEERKKYDTFGPAAFGEGGQPGGQGYGGNPFAGGGNPFAGFGGAGFGGGGFGAQGINLDDLFSAAFGGQGGGRGGFGRQQPYVQEFEGNDIQLNVEISLEDVARGVTRDLKYQAVTSCNTCEGSGMKKDAKKNTCSACGGTGARVHVVNGGFQMSTTCEVCRGSGEQIPKDGECGSCHSNGVVRETRETSINIPPGVDNGTILRVSGMGDAPEAQAGPTVRLHNGDLLVRIHVKPSKTFVRQRSDLVYKKEIPMTTAALGGTVLIPTLLGGKLRIKVPAGTQPGAQIAIPEQGLPKGRNGFGDLKVIYDVKITAPTDKTQTAVLETLADLTHDESARRSDGHVKSEPEAPAEDEKKHTPFLKKLFNRLKHHNE

SEQ ID NO: 17941 - protein, 616 aa, Prochlorococcus marinus
MTIEQNSSTNLNTLIKKTIQIPIEDNFICLRSLNPKRTRFEVEYSLEKGSCTNSFLFNSSQDEYSESHDYILIHPPGLTFEKEFLDEFETLISSDSSAIKLVMGHINPNKVAFVKRMNVKYKNLTVICSNPGAKLFKEIWNLRKPSQNTNPKEALEKVEVLPNIQIIKQLETHTLNSNFEVTFIPAPTARWPGGLIVFEKQTGLLMSDKLFGAHVYEEKWAELNSSSTEEERRHYFDCLMAPMSTQVNSIIEKFEDFEIDTIVPGHGPAISGSWRSLLNNYQSWGESQKYSNLRVALLFASAYGNTAAIADAIARGISKTGVKVKIINCEFTASDSLVTEIRKADGYLIGSPTLGGHAPTPIVSALGSLLAEGDRGKPAGVFGSYGWSGEALDLLEKKLKDGGFKFGFEPIKIKFSPDPLMIKKLEETGIQFGKQLINAKLRQQRKANVGLNTSKSDPTINALGRVVGSLCILTAQKGDEDNLISGAMVASWVSQASFSPPGITIAVAKERAVENLLHTGDNFALNILEQNNHQSLLKQFLQSFKPGDNRFTDLEIKLSPSNQPLLNEALAWLEGTVSQRMECGDHWLIYAEIKYGKVIKKDGVTAVHHRKTGANY

SEQ ID NO: 17942 - protein, 551 aa, Unknown
  Synechococcus sp. WH 8102
MGKPGRSSIPSVGVHHQGPMSFPDFSASDAQIQWQRFCDLLWYHEDLGIWLDISRMHVNPSHLEQLQPGFDKAFAAMAELEAGAIANPDEQRQVGHYWLRTPQLAPNEAVRDQIATEIDQIDQFGRDVISGVIKAPGGQPFTDVLWIGIGGSGLGPLLMIRALQGHGSGLPFHFFDNVDPNGMSAVLAELDDRLATTLVVTVSKSGGTPEPHLGMEQARHRVESRGGRWADQAVAITMVDSKLDREAQQDGWLKSFSMFDWVGGRTSITSAVGLLPGALIGADIRDFLAGAAQMDDATRLADLRRNPAALMAASWFVAGDGKGRRDMVVLPYRDRLEVFSRYLQQLVMESLGKRLDRDGNEVNQGIAVYGNKGSTDQHAYVQQLRDGVDNFFATFIEVLEDVSDIPVIKDECPGDFLDGFLQGTRSALTEGGRQSLSISMRRFDARRLGALIALFERAVGFYGDLVNINAYHQPGVEAGKKAAAAILDLQSRVEAVLKDGAPRTVSEIRQAVGDGSDEAIFWIMRHLAGNDRGYRAEGDWANPASIRFSCS

SEQ ID NO: 17943 - protein, 239 aa, Glycine max
MALSMHKDSANNQMDSSKYVRYTPEQVEALERVYAECPKPSSLRRQQLIRECPILSNIEPKQIKVWVSNRRCREKQRKEASRLQTVNRKLTAMNKLLMEENDRLQKQVSHLVYENGYMKQQIHTASAGTTTDNSCESVVMSGQNQQQNPTPQHPNRDANNPAGLLAIAEETLAEFLSKATGTAVDWVQMIGMKPGPDSIGIVAVSRNCSGVAARACGLVSLEPTKVAEILKDRQSWYRD

SEQ ID NO: 17944 - protein, 191 aa, Legionella pneumophila
MLRILLYFLLLINTTFCLAKTEKAIFAGGCFWCMEADFDHLPGVLSTTSGFDGGTLKDPTYEQVSAGNTHYAESVMVEFEPNKLSYKKLVEYFFRHIDPTVKNAQFCDHGSQYRSAIFYLNDQQKKIAMEYKKELEQKFPTVYTEIAPSTSFYPAEEYHQNYYKKNPIRYKYYRYRCGRDTRIQEVWGNKK

SEQ ID NO: 17945 - protein, 359 aa, Unknown
  Burkholderia sp. 383
MSARPYKIEAQPLAQRYARGWHCLGLARDFKDGKPHTLNAFGRKLAAFADSTGKVNVVDAYCPHMGADLSLGTVQGDNLVCPFHGWAWSGEGQCASIPYCKRIPPKARIGAWPTCEENNLLFVWNDPEGNAPPEDVAIPRLDVCFSDEWSDWVVDKMVIQANCRELVDNISDVAHFATVHRAPIDYFANLFEDHKATQLMVGRSEKLGGDALTALSTYFGPAVHITQMTGQSGGQPIHSVLLNCHVPIDMNSFELRYGVIVKKVAGLTDAQNMEIANAYVKEAQRAFYEDVDIWHSKTRIDNPLLCEGDGPLYQMRDWYSQFYLDVADVRPTSVARKAFEMRIREGEAPPALHHVFEPQ

SEQ ID NO: 17946 - protein, 591 aa, Prochlorococcus marinus
MIFTKSTALENQKSDIPKLSLQYEQIAIDTHTLRSLDWDRSRFDIEFGLRNGTTYNSFLIRGKKTALIDTSHLKFKDIWFEKLRQEINPTEIDYLIVSHTEPDHSGLIKYLIELNPNIEIVASKVAIKFLKDQIHQPFKSRAVKSGEEINLESTSISGIEHRIEFISAPNLHWPDTIFSFDHGTQVLYTCDAFGLHYCSEKLYDENPSLLNEDFRFYYDCLMGPNARSVVQALKKIDSLPTIQTIGVGHGPILNFNTQLWLNHYREWSTQRSTGENYAVVCYLSQYGYCDRLSQAIAHGIGKANAQVQLVDLIASDTQELSALISEASAVVVPTWPIKTDSELQSNIGTLLASLKQKQWVATYDSYGGNEEPIDFITNQLRKLGQKEAFKPLRVRDEPNKSVYQQFEEAGTDLGQILTRKKNIAATKSLDGDLNKALGCLSGGLYVVTAKDNEGADSRDGAMVASWVSQASFDPPGITVAVAKDRAIESLLQVNDRFVLNILQENNYLHLFRHFLKRFPPGANRFEGVELMNDLAAGGPVLSDALAFLSCKVIQRMETTDHWIIYSSVEKGNLSNTQSKTAVHHRRLGSNY

SEQ ID NO: 17947 - protein, 305 aa, Arabidopsis thaliana
MADRIKGPWSPEEDEQLRRLVVKYGPRNWTVISKSIPGRSGKSCRLRWCNQLSPQVEHRPFSAEEDETIARAHAQFGNKWATIARLLNGRTDNAVKNHWNSTLKRKCGGYDHRGYDGSEDHRPVKRSVSAGSPPVVTGLYMSPGSPTGSDVSDSSTIPILPSVELFKPVPRPGAVVLPLPIETSSSSDDPPTSLSLSLPGADVSEESNRSHESTNINNTTSSRHNHNNTVSFMPFSGGFRGAIEEMGKSFPGNGGEFMAVLQEMIKAEVRSYMTEMQRNNGGGFVGGFIDNGMIPMSQIGVGRIE

SEQ ID NO: 17948 - protein, 165 aa, Helicobacter hepaticus
MAVIYLAGGCFWGIQGYFDKLKGTLCSQVGYANSAVENPSYEFVCSGNSGAVEALELHYDEDLLPLREIIGRFLSVINPCALNFQGNDIGTQYRNGVYFVQESDESIIKECLKLWEKKHHKKAVTEVEKLQNFYSAELYHQKYLEKNALGYCHINTDLALQKWEE

SEQ ID NO: 17949 - protein, 214 aa, Prototheca wickerhamii
VDSKLQKLVKGIQNDGLRSILEDVYARNAEQDEFLQAVRGMVVSIAPVFEKHPEYLTAFKLLTEPERAIIFRVPWVDDAGQWQMNRGMRVQFSSAIGPYKGGLRFHPSVTLSIIKFLGFEQIFKNALTTLPMGGGKGGSDFDPKGRSEAEIMRFCQSFMTELYRHIGSDVDVPAGDIGVGGREIGYMYGQYKRITRDRGGVLTGKGMGWGGSEI

SEQ ID NO: 17950 - protein, 375 aa, Unknown
  Azoarcus sp. BH72
MSKRDYYEVLGVNRDAGDDEIKKAYRKLAMKYHPDRNPDSKEAEEKFKEAKEAYEVLSDAQKKGAYDRYGHAGVDPSMGGGGGGQGFEGFADAFGDIFGDLFGGRGGGGGRSNVYRGADLRYNLEISLEEAARGAEKTIRIPTVEECGTCHGSGAKPGTQPKTCPTCGGAGQVRIQQGFFSIQQTCPKCHGTGRIIPDPCGDCGGAGRVKKQKTLEVKIPAGIDEGMRLRHSGHGEPGVNGGPPGDLYVEIHIRQHPVFERDHDDLHCEMPISFATAALGGEIEIPTLEGMARIKIPAETQSGKVFRLRGKGIKNVRSHTHGDLMCHVVVETPVNLTERQKELLREFEEVSKGDAERHNPKAKSWMDKVRDFFAT

SEQ ID NO: 17951 - protein, 470 aa, Leuconostoc mesenteroides
MVSVMWFRRDLRLEDNIALFNALRHSNEILCVFHINPEQVTEKSTVNQSAFFASVLYFKNKLKKQGINLNIMYGDINDCFASLKQKLPDWHDIFFNFDERGFGRNRDQKSVAFFEDKLKVKAHPYIDYNLHGATEVKKDSGAGYKVFTPYFKRWIRQEKPAPVSYVIDKRIKSARLLFPENEQLLETFIDDRFSFIKKDLGSETAKKVLNRFINESLDQYDEERDFPANDSTSHLSRYLRTGEISIRTVWRAIDQSPDSDGKSTFMKELCWRDFYNMIYVMYPNQNVESVNKDFRHVDWINNEQQFEAWRTGQTGFPIVDAAMRQLNATGWMHNRLRMIVASFLTKDLLIDWRWGEAYFHNKLLDYDAASNIGGWQWAASTGTDSVPYFRIFNPTLQSKKFDSNGLFIKKYVPELKNVDNKMIHEPGKLSESEQTRFNVRIGQNYPFPIVDHSYARKRAISIYESSKDVN

SEQ ID NO: 17952 - protein, 749 aa, Streptomyces avermitilis
MSSAAEQEAVQEERAGEEHAARPAAVLNGRRPAAPAPPVWPGAPTPLGARFRTGPDGVTGTNFALWAGGAEAVELCLFDETGAEIRVPLTELTHEIWHGFVPGVLPGRRYGYRVHGRWDPWTGARWNPAKLLLDPYARAVDGDFSLPPEVYGHVRDWPQQQVADTVRDDRDSAPYVPKGVVVHDDDDWADDHRPKTPWADSVIYELHVRGFTKTHPGIPEELRGTYAGLAHPAAIEHLVGLGVTAVELLPVHQFAHEDHLLRKGLRNYWGYNSIGYFAPHAGYAAAGTNGQQVGEFKRMVRALHAAGIEVILDVVYNHTAEAGELGPTLSLKGIDNRGYYRLQPDARRYADYTGCGNTLHVVQPHVLRLITDSLRYWVTEMGVDGFRFDLAAALARSMHDVDMLSPFLAVIAQDPVLRRVKLIAEPWDVGSGGYQVGAFPPLWTEWNDRYRGAVRDFWRGALPDVRDLGYRLSGSSDLYAWGGRRPYASVNFVTAHDGFTLRDLVSYERKHNEANGEGNRDGSDDNRAWNCGAEGETDDERVRSLRRRQLRNLLTTLLLSTGVPMLVAGDELGRTQRGNNNAYCQDNEISWVDWELLEEPGWRALRDLTARLIALRHAHPVLRRRAFFSGRAHSADGLRDLAWFTPRGAEMTERDWYAPAATLGMYLSGRDIPGRDARGVPVVDDSFLAVLHAGHRPVSFVLPGPPWAERYEVVVDTSREDQAAAPGTAHRAGATVTVAARAVLLLRVG

SEQ ID NO: 17953 - protein, 533 aa, Desulfitobacterium hafniense
MVIITSWKRFKEYLYYDQELELLLDISRMNFSAEFLTELAEPMRDAYHQLQLLEKGALANPDEGRMVGHYWLRNPDLAPTEEIAQDIKETLKEILDFAEQIHSGRLQGEKGNPFRNILLVGVGGSILGPRFVADALASSRDKMKAFFIDNGDPDGIDRVLSRIGEELPATLCLIISKSGGTIETRNGMLEVRRAYEEAGLSFPDHAVAITQRGSQLDKLSQKEGWLRAFPMWDWVGGRTSLLSAVGLLSLALQGIDVAGLLQGAKDCDGRTRRPDTLANPGALLALMWYYSTQGQGGKQMVVLPYKDRLELFTKYLQQLIMESLGKEKNLQGETVHQGITVYGNKGSSDQHSYLQQLLEGPDNFFVTFIEVLKDRQGSSAYMEENSTSGEYLQAFLLGTREALTQKGRESLTITVKEVNAYTIGVLIALFERAVSIYALLVGINAYHQPAVEMGKKAAGQAIQLKNNIVECLKKHPDKRFSVHEIALAIGEEAHQEMVFKLLLHLTTNPEHGVNMAAGHPLPESRFFVSGPIL

SEQ ID NO: 17954 - protein, 691 aa, Glycine max
MAGKKEHETKGRGLKFGLATNAGLIKKIEVYNVHAMYALRYNKRNVQECPSAGSDDLGVWPLPQTPRGSIRTYYSSQPTKDFLFKRDKLAFFDKECSRIAEHIYLGSDTVAKNHELLRQNGITHMLNCVGFVCPEYFKGDFVYKTLWLQDSPTEDITSILYDVFDYFEDVREQGGRVLVHCCQGVSRSTALVIAYLMWREGQSFEDAFQFVKTARAVTNPNMGFACQLLQCQKRIHAMPTSPNSVHKMYRMAPHSPYDPLHLVPKMVNQPGARALDSRGGFIIHIPSAIYVWNGKHCNSVMSCNARTAAFQMIRYEGAKGPILTIHEGEEPPGFWIALSGDSDKEEEVMVMEEPSEGMESAELVDSGTTGPRKVDAYDLDFEIFHKALAGGVVPPFSLSDTGLETCLPAREQGWARLRRKFASGLLTSPKLNCDADSDPCNDHQPSVDVEVEKQDSADEPLSPSSIPPCGSPDSFECYPNREKGSPEAMDFSVHGVASSLPLSPPGTSNPFPCFISCSPKFNSKSPTLSPSSSDYASSFTFSPSSTNWSDLSFLSPRQPLSSGLESAEPFNVKDSSFSKNSSLLHKEDVPSPLEEFSANHTFGGVNSNLPMKGSFLSIAECRGSHPPSLMLPPSASESSHVPKNNLVRSLSFSLPELDDNASEINHKEDRSTELCNIMAELDIEEKGNGMT

SEQ ID NO: 17955 - protein, 372 aa, Desulfitobacterium hafniense
MTNAIGMIFGNLNSSALQGLDPNRPIGTVPFGGRYRLLDFALSSMVNSGIHTVGLITPQQYRPMLDHLGAGRDWSLDRKSGGLFFLPGVIHSLNHTVHFSLQDIAVNIDFLEKDCAKNIIISSSDQVFNLDFRPVLEEHEQAQADITLVYNQSVHPPEGSERIYLRMNAHKKVTAMSKSKEVAGLQSPWNYFIDILIIRRELLLQMLRGYGSIGTIELSEVIAHHLDIINVQGYFCGGYVGRIRSVQDYFLNNMALLQEEVRRDLFINTRPIRTKIRDNPPTKYGKQAQVKNSLISSGCTLEGKVENTILSRGVVIEEGCEVRNCIIMSKCVIGKHSVLENLIMDKFVEINEGSVLKGQPNKLMVIPKKAVI

SEQ ID NO: 17956 - protein, 398 aa, Desulfitobacterium hafniense
MRKKECIAMLLAGGQGSRLGCLTRNIPKPAVSFAGKYRIIDFSLSNCSNSNIDTVGVLTQYKPFALNTYINMGSAWDLNCLNGGIHILPPFVGEAQGSWYKGTANAIYQNMDFINFYNPEYILILSGDHIYQMDYYEMLSCHKQKHAEVTLSAIAVPWEEASRFGVMVTDAGGRIIRFEEKPPRPESNLASMGVYIFNWDVLKEALLEDERDPQSDHDFGKNVLPRLLQQGRRLYSYLFHGYWRDVGTIESYYNANMEVLQEERVDKFFELKQRVFSNEEILAPQHLGERAKIHNSLIGNGCTILGEVRDSVIASGVYVGEGSLIEQSILLPNSEIYEDVRLHKTILGENAIVRAHCRIGDKREGNPPQEGITVIGDHLHIPEGTVISEGENVRKDTA

SEQ ID NO: 17957 - protein, 272 aa, Pisum sativum
FVRQLNTYGFRKVDPDRWEFANEGFLAGQRILLRTIKRRRNVAQSPSMQRESGGACIELGEFGLEGEIERLRRDRSVLVAEIVKLRQQQNNSRDQISAMEARLLITEKKHQQMMAFLARALSNQSFIQQLANNKELKGVEMKRKRRLPASSSLENLQNDSVTMMTVPIESVVDYSSREQQEGLTAIESEIETLLSAYDNESRSEIKDPSANESNLSDWEELLNQKLVGGNPEDEVLIGDFSQIDAPVEDLVEKNDDWTVDLQNLVDEMDFEP

SEQ ID NO: 17958 - protein, 689 aa, Oryza sativa
MPPTPSTRLSDLPSRTAAVLLLLAAPASAASRAPPPASPGDTRKAASSPLRRSPRAHAPAGGFGAAAEAGLPSPASNLNRVEDDQILVEPDLAAELEQSLVDPTHELEQNLVEQGLVIGQEFVDVHACRRAVKDMAIAMHFELRVVKSDRSRFIAKCAREGCPWRVHVAKCHGVPTFTVRTLHGEHTCDGVRDLHHHQATVGWVARSVEATLRDNPQYKPKEILQDIREQHGVAVSYMQAWRGKERSMAAVHGTLEDGYRFLPAYCEQIVQTNPGSVAIYKGTGPDNSFQRLFVSFHASIHGFLNACRPLLEIDKADLKGKYLGTLLCASAVDAENMMFPLAFGIVDAESDENWMWFFSELRKMLGVNTDKMPVLTILSERQSQVVEAVEVNFPTAFHGFCLRYVSENFRDEFKNPKLLNIFWSAVYALTAAEFDSKVNDMVQVQDVMPWFQRFPPNLWAVSYFEGIRYGHFNLGITEILYNWAMECHEFPIVQTVEHIKHQLTCWFVERQNLALSYNSILVPSAEKLISEAIADSGCYQVLRANKVEFEIVSSERTNIVDTQARCCSCRRWQIYGIPCAHAVAALLSCGEDPRLYAHECFSIMKYRETYSQPIYSIPDRSQWNLPFSFAQGAGSKAYAVLRPPKIRRPPGRPKMKILKIESLKRPKRIVQCGRCHLLGHSQKKCSLRN

SEQ ID NO: 17959 - protein, 417 aa, Pseudomonas putida
MFSRDLTIAKYDAELFEAMQQEALRQEEHIELIASENYTSPAVMEAQGSVLTNKYAEGYPGKRYYGGCEYVDVVEQLAIDRAKELFGADYANVQPHAGSQANAAVYLALLSAGDTILGMSLAHGGHLTHGASVSSSGKLYNAIQYGIDGNGLIDYDEVERLAVEHKPKMIVAGFSAYSQVLDFARFRAIADKVGAYLFVDMAHVAGLVAAGVYPNPVPFADVVTTTTHKTLRGPRGGLILARANADIEKKLNSAVFPGAQGGPLEHVIAAKAICFKEALQPEFKAYQQQVVKNAQAMASVFIERGFDVVSGGTQNHLFLLSLIKQEISGKDADAALGKAFITVNKNSVPNDPRSPFVTSGLRFGTPAVTTRGFKEAECKELAGWICDILADLNNEAVIDAVREKVKAICKKLPVYGN

SEQ ID NO: 17960 - protein, 231 aa, Medicago truncatula
MNPDAVKSTLTNLAFGNVIAAAARNYQKELLSEEKAAQSSSINEEVDLDDLMDDPELEKLHADRIAAFKKEAEKREAWKKKGHGEFREVTEGDFLGEVTGSEKVICHFYHKEFYRCKIMDKHLKSLSTKHIDTKFIRLDAENAPFFVAKLAIKTLPCVILFRQGVAVDRLVGFQDLGAKDDFSTRALEVLLIKKGIIAEKKDVDEEDQEYDESKRRSVRSSAAADSDSDSD

SEQ ID NO: 17961 - protein, 175 aa, Triticum aestivum
MSPPAAISPTSRSVELATSTTKLPVHAVKNINTKTVEEMLGNWDDFKFAPIRESQVSRAMTRRYFQDLDNYAESDIVIIGAGSCGLSAAYILGKKRPDLKIAIIEASVSPGGGAWLGGQLFSAMIMRKPADAFLREVGVPYEDEGNYVVVKHAALFTSTIMSKVLQMPNIKLFNA

SEQ ID NO: 17962 - protein, 301 aa, Agrobacterium tumefaciens
MTKWTEANIPNQRGRSAVVTGTGGLGLETALALARAGCDVTIAGRNPEKGSDAVSRIQRAAPHVTVSFEKLDLADLTSIALFAQRMENDRESLDLLVNNAGIMVPPKRQETRDGFELQFGTNYLGHFALTAHLMPLLKKGTDARVVTVSSVAARAGKINFADINSEKNYHPMRAYSQSKLACLMFALELQDRSRAAGWGVSSIAAHPGVSRTDLLHNAPGRNSLQGLARTFLWFLFQPVAQGALPQLFSATSKEVKSGGYYGPDRLGETRGHPQPARIPPEALDRVAGKQLWEISQRMTGL

SEQ ID NO: 17963 - protein, 379 aa, Campylobacter jejuni
MEISYYEILEITQNADKETIKKAYRKMALKYHPDRNQGDKEAEDKFKLVNEAYEVLTNDEKRAIYDRYGKDALKGGGFGSSSSGFAGFEDLGDIFSSFFGEGFGSSRRRKSSNDEKIPSDFIVNLKLSFKEAVFGCKKNIDFTYKCSCKTCNGTGAKDGKLQTCPKCQGRGQVGVSQGFITFAQTCPDCQGIGEKASEKCSDCKGLGYNETKDSVELNIPEGVDTGMKLRVNAKGNILKNGTRGDMYVKIIAAEDDTFIRDDDDIYIEFPVFFTQAILGESIKVPTIRGEATLNLPKGAKDGQRFVLEKEGVKDVHSSRIGNQIVQISIKFPTFLNDEQKELLEKLSEVLVSKMVCIKTKKDFLKKSLIGLSLNFPKAF

SEQ ID NO: 17964 - protein, 364 aa, Mycobacterium smegmatis
MKQDVLTPEKLREAYQHVWFVVARSCDIDTPQSATLLDHNLVVFRDSTGAARVTDRRCIHRGANLADGKVVGDSIACPYHGWQFDGQTGQCSAIPSLKEGGRIPPKAAIKSYPVIERFEHVWTCLGDPVFDLPNPPEIADLELEWRPADPIHADCGFMAATENFRDMAHFPFVHEPSMGDVNPVVPDLEVKREGREVWASYFYAQVEESDFSGVGDAWMHYHSYAPGIATILYDFGPEIGKRYLVDFPSPVSYDKCIIFWGVATDKDFRGGTVDEILEIETKVFNEDTPVLEGLEPKEVPLAGQAFEVSAPADIYTLNYRRATQFAVQTIRQERGLDAGTDTEADAANAQTNGHARAATAAPAQ

SEQ ID NO: 17965 - protein, 604 aa, Solanum tuberosum
MATTTSHATNTWIKPKLSMPSSKEFGFASNSISLLKNQHNRQSLNINSSLQAPPILHFPKQSSNYQTPKTSTISHPKQENNNSSSSISKWNLVQKAAAMALDAVEGALTKHELEHPLPKTADPRVQISGNFAPVPENPVCQSLPVTGKIPKCVQGVYVRNGANPLFEPTAGRHFFDGDGMVHAVQFKNGSASYACRFTETERFVQEKALGRPVFPKAIGELHGHSGIARLMLFYARGLFGLIDHSRGTGVANAGLVYFNNRLLAMSEDDLPYHVKVTPTGDLKTEGRFDFDGQLKSTMIAHPKLDPVSGELFALSYDVIQKPYLKYFRFSKNGEKSNDVEIPVEDPTMMHDFAITEKFVIIPDQQVVFKMSEMIRGGSPVVYDKNKVSRFGILDKYAKDGSDLKWVEVPDCFCFHLWNAWEEPETDEIVVIGSCMTPPDSIFNECDEGLKSVLSEIRLNLKTGKSTRKAIIENPDEQVNLEAGMVNRNKLGRKTQYAYLAIAEPWPKVSGFAKVDLFTGEVEKFIYGDNKYGGEPLFLPRDPNSKEEDDGYILAFVHDEKEWTSELQIVNAMTLKLEATVKLPSRVPYGFHGTFINANDLANQA

SEQ ID NO: 17966 - protein, 96 aa, Phytolacca americana
ATYKVTLVTPSGTQTIDCPDDTYVLDAAEEAGLDLPYSCRAGSCSSCTGKVTAGTVDQEDQSFLDDDQIEAGFVLTCVAFPKGDVTIETHKEEDIA

SEQ ID NO: 17967 - protein, 474 aa, Bacillus thuringiensis
MNGYVYLVGAGPGDEGLITKKAIDCLKRADIVLYDRLLNPTFLSYTKETCELMYCGKMPKNHTMRQEMINAHLLQFAKEGKIVVRLKGGDPSIFGRVGEEAETLVAANIPYEIVPGITSSIAASSYAGIPLTHRNYSNSVTLLTGHAKGPLTDHGKYNSSHNSDTIAYYMGIKNLPTICENLRQAGKKEDTPVAIIEWGTTGKQRVVTGTLSTIVSIVKNENISNPSMTIVGDVVSLRDQIAWKERKPLHGKKVLFTSATNKTSVMKQRLQEAGAEIYQIPTFKKEEYTLTLEQINEIFNVDRLVFCSAESVEILMQSCSKYQKDIRSLQAELQHMNVATQEKLMQYGLLSKEAKFSSDTTVYLGRNINRIAFIQEKIGAGSYMMTHKYTIDHRFDEVHSRMLSEFLWDSIVFEGRASIDTFLAEVKRLGFIDIVTLPFSYTDVPTLRYANKVGFHNIDHQLQETLMQKDMVRQ

SEQ ID NO: 17968 - protein, 558 aa, Unknown
  Rhodococcus sp. RHA1
MNHPVASGKPAILTVDDDPGVSRAVARDLRRRYGEKYRIIRAESGESALDAMKQMKLRGDPVAAILADYRMPSMSGIEFLEKAMDLYPVARRVLLTAYADTDAAIEAINVIDLDHYLLKPWDPPEEKLYPVVDALLEAWASSDHHPAEETKVVGHRWAPRSSEVREFLARNQLSYRWYMSDEPEGGRLLTAAGEDGRRLPVVICSDGECLVEPSDTELGRHLGLRTDPSENFYDLVVVGGGPAGLGAAVYGASEGLRTALIERTATGGQAGQSSRIENYLGFPDGVSGAQLAERARRQATRFGAELITTRDVVALEVNGSARTVRFADGDTIDAHTVILATGVSYRRHPAPGVDDLTGRGVYYGSAVTEAARCTDQDVYIVGGANSAGQAAVYLSRGARSVTIVVRAQSLEDSMSYYLVQQIERNPRIRVRPCTEVIGVEGEGHLEKVRLRNNATGDEETVDAGFLFLFIGAIPRTEWLEGVVARDENGFVVSGPDLVVDGKPPSGWPLDRLPHHLETSVPGIFAAGDVRSESAKRVASAVGEGAMAVMLVHRYIGQP

SEQ ID NO: 17969 - protein, 417 aa, Clostridium thermocellum
MDYEIRGGCNMKKLKIADGIHMLTMNVEDILFEGIWELANGVTLNSYIVQGEKTAIIDGVIGWDGIPETLYKNLEDIGVDPKNIDYLIVNHMEPDHSGWISNFRKIKDDFTVICTDKAAKMVASFYGEDKIRVVKEGDTLDLGNGKVLSFHPVPNVHWPDTMYTYERETKTLFSCDMFGTFGRMGEHCFDDELTPEEVDFFELEGMRYYSNVMATFTPSLKKAIEKAKELEINVIAPGHGPVYRKNPQKIIDDYSRFALYAEGTGKNEVTILWGSMYGMTEKVVNYVESILQREGIKYNKLKMPLATESEMVATVFRSAGVIIGAPTYEYKLFPPVASALNELGRKRITGKTAFRFGSYGWSGGAEKELAEIIERNNMKWNFIESVEFEGAPKDEDLARVEERVLEFIKKMREKVAE

SEQ ID NO: 17970 - protein, 206 aa, Gibberella zeae
MAFNLPPFLARLARPFTQSSRLSIAPDQSAASVIPEGAQRCTVAAGCFWGTEHLYRRHFADKGLIDAKVGYIGGDLENPSYRAVCGGKTGHAEAAQIIFDPTKVTYAQLLEFFYKTHDPTTLNQQGPDTGPQYRSAIYFHNPEQEKIAREVTEKANKQWWKGGIVTEIAPAGKWWTAEEYHQLYLHNNPSGYECPSHFMRPFPPLE

SEQ ID NO: 17971 - protein, 300 aa, Corynebacterium glutamicum
MLADRRVQLYDDEDIDRILLRGGTILGTGRLHPDKFKAGIDQIKANLEDAGIDALIPIGGEGTLKGAKWLSDNGIPVVGVPKTIDNDVNGTDFTFGFDTAVAVATDAVDRLHTTAESHNRVMIVEVMGRHVGWIALHAGMAGGAHYTVIPEVPFDIAEICKAMERRFQMGEKYGIIVVAEGALPREGTMELREGHIDQFGHKTFTGIGQQIADEIHARLGHDVRTTVLGHIQRGGTPTAFDRVLATRYGVRAARACHEGSFDKVVALKGERIEMITFEDAVGTLKEVPFERWVTAQAMFG

SEQ ID NO: 17972 - protein, 484 aa, Legionella pneumophila
MLIFELSKTGRQAKAQIPRAVSKNYSIPEEFQRKSPPRLPACSELQVVRHFTCLSQKNFSIDTNFYPLGSCTMKYNPRGVHKAASLPGFINRHPLAMDNESQGFLETLYKLQNYISEITGMPGVSLTPMAGSQGEFAGVAMIKAYHQSRGDTARDEILIPDAAHGTNPASAVMCGFKVVEIATAPDGDIDLDELKRKVGPRTAGIMLTNPSTLGLFMRQIKEIASLVHQAGGLLYYDGANLNAILGKVRPGDMGFDVMHLNLHKTFATPHGGGGPGAGPVAVGKRLIPYMPLPVVKKTDSGYHWATRQDYPQSIGRLSCFMGNAGILLRAYFYMLVLGKEGLLRVSEFATLNANYLLKELTKVGYTAAYPDRRASHEFILTLNSEKKNYDVTAMDFAKRLLDYGVHAPTTYFPLLVPECLLIEPPETESKEELDAFVAVMKIIREEASKQPDILKAAPHTLPVKRLDDVKAARELDLNYFATHE

SEQ ID NO: 17973 - protein, 549 aa, Zea mays
SSSVPLSAEGITVQSFNADLLYEPWEVLDDDGFPFTMFAPFWNRCLCMPDPAAPLLPPKRINSGDLSRCPWDELIFEDESERGSNALLARAWSPGWQNADKALTAFLDGPLVDYSANHKKADSASTSLLSPYLHFGELSVRKVFHQVRMKQLMWSNDGDRAGEESCTLFLRAIGLREYSRYLTFNHPCSLEKPLLSHLRFFPWVVDEVHFKVWRQGRTGYPLVDAGMRELWATGWVHDRIRVVVSSFFVKVLQLPWRWGMKYFWDTLLDADLESDALGWQYISGSLPDGRELDRIDNPQFEGYKFDPHGEYVRRWLPELARLPTEWIHHPWDAPESVLQAAGVELGSNYPRPIVELDAANSRLQGALSEMWELEAASCAAIENGMEEGLGDSTDEPPIDFPQELRMEVDRQPAQPAIIHTPVVAGWRREDQRVPSMTSSLIRAETELTADFGNTSEDSRPEVPSNIHLQARAEREEIVDGATGNTVRVNGNQQQQNLQNNMHRVLGIAPSISEASSSWTGREGGLVPSTCKQFRFTIHKQSISQSSDRR

SEQ ID NO: 17974 - protein, 232 aa, Alkaliphilus metalliredigenes
MAVISMKQLLEAGVHFGHQTRRWNPKMAEYIFTERNGIYIIDLQKTVKMVEQCYNVMKEIASEGSTILFVGTKKQAQEAIEEEAKRCGMYYVNQRWLGGMLTNFKTIKLRIDRLHKLEKMAEDGTFEVLPKKEVIKLRHEMEKLEKFLGGIKGMTQMPDALFIVDPRKERIAIKEAQTLGIPVISIVDTNCDPDEIDYMIPGNDDAIRAVKLLTATMANAIIEGKQVEQTEE

SEQ ID NO: 17975 - protein, 761 aa, Thermus thermophilus
MAWLNPFWSSPKAYVRPPKRGLAPELWASRIPFTHLENFYEVFRALWENRDNLPYAWRILKDGVCDGCALGTSGLEDWTLHGVHLCNVRLRLLRLNTLPPLDPKVLEDVEALKGRKSRELRRLGRLPYPMLRRKGERGFRRVSWDEAMGLATEYLRRHLPEGAFFYLTSRGVPNETYYVVQKAVRALGCNHVDNAARICHSPSTVVLKEALGVAATTCSYTDLIGTDLVVFLGSNVANNQPVMMKYLYHAKKAGTKVAVVNPYREPGMERYFVPSDLESALFGTRIADRFFQILPGGDIAFLHGAAKWMLEEGWVDPGFIRAHTAGFEAYKALLEAIPFAELEKAAGVSREEMRAFAEMVGRAERAVFVWGMGITQHTHGEDNVRAIVNLALLKGFVGREGCGLMPIRGHSGVQGGAEMGAYATAFPGGLPVNPENARRLAELWGFPVPDRPGLTTPEALDRALEGRLGVLWAIGGDFREVMPDPEAVEEALRRVPLRVHQDIVLSSQMLLEPGECVLLLPATTRYEVPGGVTETSTERRVIFSPEIPGPRPPEARPEWEVFQELVHRLRPELKDRFRFASTAEIREEIARVIPLYEGIQRFKAKGDQFQYGGRRLCEGWRFPTPDGKAHFRPVPLPQKEVPEGAFRVVTRRGKQFNSIVHEDQDPLTGAFRDAVYMNPKDAARLGLKPGDPVVLENAFGRYAGRVYLAEVKEGTLEVHWPEGNVLVDPKARSPLAHIPAYKEILAHLRRGEAEAPSPLRP

SEQ ID NO: 17976 - protein, 490 aa, Aspergillus oryzae
MVGIGPKRPPSRKGSMHELPQNLLEQIKQFEDIFTVDGAKLKQIADHFVKELEKGLSVEGGNIPMNVTWVMGFPDGDEQGTFLALDMGGTNLRVCEITLTEEKGAFDITQSKYRMPEELKTGTAEELWEYIADCLQQFIESHHENEKLSKLPLGFTFSYPATQEYIDHGVLQRWTKGFDIDGVEGQDVVPPLEAILKKRGLPIKVAALINDTTGTLIASSYTDSDMKIGCIFGTGVNAAYMEHCGSVPKLAHKNLPPDMPVAINCEYGAFDNEHVVLPLTKYDIIIDRDSPRPGQQAFEKMTAGLYLGEIFRLALLDLLETRPGLIFQGQDTSQLRKPYLLDASFLAAIEDDPYENLQETQELMERKLNIKATQQELEMIRRLAELIGTRAARLSACGVAAICKKKNIESCHVGADGSVFTKYPHFKARGAQALREILDWAPNEKDKVVIMAAEDGSGVGAALIAALTLKRVKAGISCGIRDMADMQSLI

SEQ ID NO: 17977 - protein, 568 aa, Unknown
  Azoarcus sp. BH72
MSTATPVSTQESFAALFEESLALQEMRAGEVITAEVVRIDQNFVVVNAGLKSESYVPIDEFRNDRGELEVNPGDFIHVAIEALEDGYGETRLSRDKAKRIAAWNDLEKALNEGTLVKGVISGRVKGGLTVMTNSIRAFLPGSLVDMRPVKDTSPYEGKEYEFKVIKLDRKRNNVVVSRRAVLEESMGEERQKLLENLKEGTVVKGVVKNITDYGAFVDLGGIDGLLHITDLAWRRVRHPSEVLNVGDEIEAKVLKFDQEKNRVSLGLKQLGEDPWVGISRRYPQGTRLFGKVTNITDYGAFVEVEQGIEGLVHVSEMDWTNKNIHPTKVVQLGDEVEVMILEIDEDRRRISLGMKQCASNPWDDFAINHKKGDKVRGQIKSITDFGVFIGLDGGIDGLVHLSDLSWSESGEDAVRKFKKGDEVEAVVLAIDVERERISLGIKQLEGDPFTNFIATHEKNSLVRGTVKSVDARGAVIGLGDEVEGYLRASEAAPHRVDDLTTMLKEGDELELMIINVDRKTRSINLSIRAKDQAEQTEAMQKLASESSAASGTTNLGALLKAKLNEQKQ

SEQ ID NO: 17978 - protein, 1008 aa, Ashbya gossypii
MRTALLLSLGLVAAVDPSPVNEEVSLEERFEDVSTYDFDLDSISYLSHIAVEKAVDWLESHDISSISECFEYYNEHRLDPGTLEIAVSTGHEWYKSADFFRQGIDLVAELMEKSRDSQKLQWWKHGLVQSLIRLGTVDLFEELLRDNFGVHFEKLADIYKDMQVQLHSIDVVGGVVDAPHGNSLRAPKEFPWGGPNQGSGSSQGDSPSSPWDLPKEPPTVRSKAPAGNGEKTEGNPLDYANPKKATAEFNFPKFKKPKEDEKKDGDKKDDKKDDKSDNKDDKKDDKSDSNDDKKDDKSGKKDDKPDNKPDNKDDNKPDKKGDNKPDKKGDNKPDKKDDKSDNNDAKKDGKKGEKSDRKDENKDDNSDKKDDKKDGKSDRKDENKDDNSDQKDGKKDGKSDNKDEKSDDKSDNKDEKNDKSDKKDGNDDKKDEKNDKSDKKDGNDDKKDDEKDCDKKDGDQKDDKHDDKHDDKHDDKHDDKHDDKHDDKKKNKDKNDSDKKKKGGKHDEKHDDEKKDEDKHEDEKEEKKEDKSDKKEDKRDDKSDKKEDKRDDKSDKKEDKRDDEEDERENKPDRKEDKRIDKSGKKGDKSDKDVKSDEKDKNECGRFRKCRPIEKPDESKETNPKDDNSKGKKQEDQKSKDGKNKDGKPSDDDKTEEKPDKSKGWTKPCDRWKKNKPKDGDNSGKPKEQNPNDEKDKDSGKKGDEKSKPCDEPKVQPIEDEKDDKNSKGPKDSKDSKDSKDSINAVKATALPRGKPLRDPALADRLKNAHLRSSALPKSQILDPKFPVEPTQKPVPSASLVPKESLVVLPKPPATLVSPAEPPSSTAQPLETSEPAKPAEQAPRSTHKMSSIFIPRFKGFSKFLHAPNQAVLNGQEAPPAAPEPAPEAAPEAAPEAGNPDADPAASASPVDGTQASSIVRYTRTAAAGSSAASSDLSDAASTLLARRPGYVTFDGTFPTGKRLEKYYSNHTNGSSFIIDTNVSNVATNLHPWSFVGAVIVLVSSALLF

SEQ ID NO: 17979 - protein, 225 aa, Schizosaccharomyces pombe
MSQSQFDPYVQNGGTTVAIAGDGFAILAGDTRSVNGYNINTRFQPRVHEVGDDLVIGASGFEADALALVKRIQQRIDLYHDNHERKMSAQSCACMVRTLLYGKRFFPYYVYTTVAGIDKEGKGEIYSFDPVGSYEREWCRAGGSAANFITPFLDNQVNLHNQYVPGSHGKERKPRRLLKLEEAMKITTDAFTSAGERHIEVGDSVLVKIITKEGVETRIIPLKKD

SEQ ID NO: 17980 - protein, 431 aa, Unknown
  delta proteobacterium MLMS-1
MQILLINPPNCGRSIPEERYGITSVRQIFRGEPLALEELAGNLPDHDVRILDLKAEPDGLDRALNAALPDLVGLTGVTCEANTVRHLAAKVKAAGVRSVVVGGIHASILPAFFNHEEVDYICIGLGKLSFRELVEALEQGRQPADIPGIAKTSPGKQLQWLNRDYREADLVSHRPPAYQLVAGYREHYRLERLKVNMGFVASAAGCPHRCSFCCIKGQSGGRYLTRPPEHVIRDIELLADIPVIRLIDANTLGNLEQARELGEALRSAGLNKQFLADVRSDTVVNHPELFQLWREAGLRALIIGFEELDDRRLTAMNKANRAAINRAAVGILQDLGITIVGDFIVSPGYQEEDFRRLGDYLASSQIDLPIITVLTPLPGTDYHRHRQQEIINHDLDYYTLTNAVTPTKLAEEEFYRLYAELVRTSHQQAKL

SEQ ID NO: 17981 - protein, 314 aa, Thermus thermophilus
MDYGMYFFEHVTPYETLVRRMERVIASGKTPFQDYFLFESKGFGKVLILDKDVQSTERDEYIYHETLVHPAMLTHPEPKRVLIVGGGEGATLREVLKHPTVEKAVMVDIDGELVEVAKRHMPEWHQGAFDDPRAVLVIDDARAYLERTEERYDVVIIDLTDPVGEDNPARLLYTVEFYRLVKAHLNPGGVMGMQAGMILLTHHRVHPVVHRTVREAFRYVRSYKNHIPGFFLNFGFLLASDAFDPAAFSEGVIEARIRERNLALRHLTAPYLEAMFVLPKDLLEALEKETMVSTDQNPFYVTPEGEARQAPYKG

SEQ ID NO: 17982 - protein, 884 aa, Oryza sativa
MTTTTTTRLLLAAILLAVAAADDDGQTLLEIKKSFRNVDNVLYDWAGDGAPRRYCSWRGVLCDNVTFAVAALDLKSNELSGQIPDEIGDCTSLKTLILKNNQLVGMIPSTLSQLPNLKILDLAQNKLNGEIPRLIYWNEVLQYLRLNICNVGQIVRGLRSNNLEGSLSPEMCQLTGLWYLDLSYNRLTGEIPFNIGFLQVATLSLQGNNFSGPIPSVIGLMQALAVLDLSFNQLSGPIPSILGNLTYTEKLYLQGNRLTGSIPPELGNMSTLHYLNLANNNLEGPIPDNISSCMNLISLNLSSNYLSGAIPIELAKMKNLDTLDLSCNMVAGPIPSAIGSLEHLLRLNFSNNNLVGYIPAEFGNLRSIMEIFLFLCFSDLSSNHLGGLIPQEVGMLQNLILLKLESNNITGDVSSLINCFSLNVLNVSYNNLAGIVPTDNNFSRFSPDSFLGNPGLCGYWLGSSCYSTSHVQRSSVSRSAILGIAVAGLVILLMILAAACWPHWAQVPKDVSLSKPDIHALPSSNVPPKLVILHMNMAFLVYEDIMRMTENLSEKYIIGYGASSTVYKCVLKNCKPVAIKKLYAHYPQSLKEFETELETVGSIKHRNLVSLQGYSLSPAGNLLFYDYLENGSLWDVLHGSSKKQKLDWEARLRIALGAAQGLAYLHHDCNPRIIHRDVKSKNILLDKDYEAHLADFGIAKSLCTSKTHTSTYVMGTIGYIDPEYARTSRLNEKSDVYSYGIVLLELLTGKKPVDNECNLHHLILSKAADNTVMEMVDPDIADTCKDLGEVKKVFQLALLCSKRQPSDRPTMHEVVRVLDCLVYPDPPSKPALPPALPQSSTVPSYVNEYVSLRGGSTLSCENSSSASDAELFLKFGEVISQNTE

SEQ ID NO: 17983 - protein, 372 aa, Arabidopsis thaliana
MSSPERKRKKRSLEPSPESTPNPSLPDDLIVSILARVSRLYYPILSLVSKSSRTLVTSPELYKTRSFFNRTESCLYVCLDFPPDPNPRWFTLYRKPNQNITEKTKNSSGFVLAPIPNHHSHSSSIVAIGSNIYAIGGSIENAPSSKVSILDCRSHTWHEAPSMRMKRNYPAANVVDGKIYVAGGLEEFDSSKWMEVFDIKTQTWEFVLSPLAERFIYRSLVIEGEIYIFGDKVVTYKPKEDRWGGVGEHQSMDLGLFFHSYCVIDNVLYCYRPGGIKWYESEKRSWRKLRGLKGLSKLASSCVKLADYGGKMALLWDKYIPCSGNKSHSISCAVVSLERCKNQGIRGKVEWFDDMLTVPSSYNFVGALAATL

SEQ ID NO: 17984 - protein, 475 aa, Unknown
  delta proteobacterium MLMS-1
MAKHILLIHPLGYTADGSKTDIARLANLMPPLGLCSIAAYLDRQGCRTAIVDCFAHLDSDARIMEYLEEHPPDWIGLTCTTNGFLDAVRIVRMAKEARPEIRAVLGGVHVSALKEKILLQYPEVDCAVVGEGELPLAQLLQGAPFESIRGLVFRDDSGVRFSGLQDRGVELDDLPFPAYEKLRGYPEAYQLPIFNYPSHPNASCLSSRGCPYACSYCDRSVFRRSFKYNSAAYVYRHMQYLRQRWGIRHLNFYDDQFTFHRGRVVELCRRLIEEPLDMTFNCAIRAEHVDPELLALMKRAGCWMISLGIETGDPDLLAQHRQNADLDLLARVIHDIHRAGIRVKGLLMLGLPGESEESVRRSMRYVFSLPIDDFNLAKFTPFPGSPIYEKIHELGDFEEDYRKMDCMNFVFVTKGMTRQQLEELFLEFYRSHFMRPRVLLGYLAMLWQSPHSWWRFMANLSSFLRFARSNRRIEG

SEQ ID NO: 17985 - protein, 572 aa, Streptomyces avermitilis
MIVNEPVPDTFEDTPAKDRDPEWFKRAVFYEVLVRSFQDSNGDGVGDLKGLTAKLDYLQWLGVDCLWLPPFFKSPLRDGGYDVSDYTAVLPEFGDLADFVEFVDAAHQRGMRVIIDFVMNHTSDLHPWFQESRSNPDGPYGDYYVWADDDKQYQDARIIFVDTEASNWTFDPVRKQYYWHRFFSHQPDLNYENPAVQEEIVSALRFWLDLGIDGFRLDAVPYLYQQEGTNCENLPATHEFLKRVRKEIDTHYPDTVLLAEANQWPEDVVDYFGDFPSGGDECHMAFHFPVMPRIFMAVRRESRYPVSEILAKTPAIPSSCQWGIFLRNHDELTLEMVTDEERDYMWAEYAKDPRMRANIGIRRRLAPLLDNDRNQIELFTALLLSLPGSPILYYGDEIGMGDNIWLGDRDAVRTPMQWTPDRNAGFSSCDPGRLYLPTIMDPVYGYQVTNVEASMSSPSSLLHWTRRMIEIRKQNPAFGLGSYTELQSSNPAVLAFLREAPSTGGNGDDLVLCVHNFSRFAQPTELDLRAFSGRHPVELIGGVRFPAIGELPYLLTLAGHGFYWFRLRKDAV

SEQ ID NO: 17986 - protein, 449 aa, Pseudomonas putida
MSTMIESVDNFLARLKQRDPGQPEFHQAVEEVLRTLWPFLEANPHYLQSGILERMVEPERAVLFRVSWVDDQGKVQVNRGYRIQMSSAIGPYKGGLRFHPSVNLSVLKFLAFEQVFKNSLTSLPMGGGKGGSDFDPKGKSDAEVMRFCQAFMSELYRHIGADCDVPAGDIGVGAREIGFMFGQYKRLANQFTSVLTGKGMTYGGSLIRPEATGYGCVYFAEEMLKRQDKRIDGRRVAVSGSGNVAQYAARKVMDLGGKVISLSDSEGTLYAEAGLTDAQWDALMELKNVKRGRISELAGQFGLEFRKGQTPWSLPCDIALPCATQNELGAEDARTLLRNGCICVAEGANMPTTLEAVDIFLDAGILYAPGKASNAGGVAVSGLEMSQNAMRLLWTAGEVDSKLHNIMQSIHHACVHYGEEADGRINYVKGANIAGFVKVADAMLAQGVV

SEQ ID NO: 17987 - protein, 296 aa, Unknown
  Azoarcus sp. BH72
MEFKTLEDYVGKTPLVRMKRITAGHNNVILAKLEGNNPAGSVKDRPALSMVVRAEARGDIKPGDTLIEATSGNTGIALAMAAAMRGYRMILVMPENQSVERRQTMRAFGAELVLTPKEGGMEMARDVAEKMRDEGKGIILDQFANPDNPLAHYEGTGPELWEQTAGRITHFVSSMGTTGTIMGTSRFLKEMNPAIRIVGCQPEEGSQIPGIRKWPEAYLPAIYHRESVDSLEYVSQADAEEMTRRLAREEGLFAGISSGGAMHVALRIAAQVENAVIVSVICDRGDRYLSTGVFPA

SEQ ID NO: 17988 - protein, 1215 aa, Coccidioides immitis
MDDLQSLELLSLVSRVTTELQNHLGINDKTLAEFVIDQHLKCGGSFKEFKGSLEGMGAEFPQSLMESIDRLVLAMHPKYKPKQNATDKHSSERENGNGAKINDIEMKAKVFKGLAMPDKAPQWEDDDYTKPGEILRNDAGADVLDDTFAMLEGLAAKARGKGDGAKSRKRSRSPSSDDYDRGTRRREKYRSRSRSRSGERRYRRDEDLAHERSGTKYGGRNDRYRDDYKDRRGRRGRDDDDYFRRPPTPELDERPILYKVYDGRVTGIKDFGAFVNLQGVRGKVDGLVHVSAMQDGARVNHPSDLVSRAQPVKVKVVSIQGPRIGLSMKEVDQVTGRDLVPQRRIASGANMERLDGTGADDRYEDDDDGKPLRNKKRLNSPERWEIKQLIASGAVSAADYPDIDEEYHATLRGEGDFEEEEDVDIEVKDEEPPFLAGQTKQSLELSPIRVVRAPDGSLNRAAMAGTNLAKERRELRQQEAQDKAAEQASHVDLNAQWQDPMIAPDQRKFASELRTAQKTDAIPEWKRVTQSKDVSYGKRTNLTIKQQRESLPVFKFRKQLLEAVHKNQLLIVVGDTGSGKTTQVTQYLAEAGFANDGMIGCTQPRRVAAVSVAKRVAEEVGCRLGQEVGYTIRFEDCSSPDTKIKYMTDGILQREILLDPDLKKYSVIMLDEAHERTIATDVLFGLLKKTIKRRPDLKLIVTSATLDAEKFSEYFNGCPIFTIPGRTFPVEIMYSREPETDYLDAALVTVMQIHLTEPEGDILLFLTGQEEIDTSCEILYERMKSLGPNVPELIILPVYSALPSEMQSRIFDPAPPGSRKVVIATNIAETSITIDHIYYVIDPGFVKQNAYDPKLGMDSLVVTPISQAQAKQRAGRAGRTGPGKCFRLYTEAAFQSEMLPTSIPEIQRQNLSHTILMLKAMGINDLLHFDFMDPPPTNTMLTALEELYALSALDDEGLLTRLGRKMADFPMEPALAKVLIASVDMGCSDEVLSIVAMLSVQNVFYRPKEKQQQADQKKSKFHDPHGDHLTLLNVYNAWKNSRYSNPWCFENFIQARQMRRAQDVRQQLVSIMERYHHKIVSCGRNTIKVRKALCSGFFRNSARKDPQEGYKTLIEGTPVYMHPSSSLFGKAAEHVIFHTLVLTTKEYMHCTTAIEPKWLVEAAPTFFKVAPTDRLSKRKKAERIQPLHNRFAGEDDWRLSAQRRQGRGGGGGTWG

SEQ ID NO: 17989 - protein, 469 aa, Methanothermobacter thermautotrophicus
MTAMCAIAGFRGDDAPVKVQEMLDVLRHRGPDATGIYHDSRIVIRTATGEDVKEAPQSAEIAVGHNLLSIVGGPQPVSGDGVLVFNGEIYNQEELNWTGSDSELILDLIEGHGGDLEDALRFTVNKIDGDYAFAYTDGENLASRQDPVGVKPLYHSGEAFASEKKALWRIGLRNVETLPPGHAMINGVKVKLRGLPRAEPSDAEPEELRENLKSALRESVERRVRGLDEAALVFSGGVDSTLLAVLLDEHIDVRLYTVGLPGSSDPQFASRAAADLGMELEVLEVTEDTIREALPHVLGAIEEYNLMKIGVAMPLYLASEAASADGYRVMFSGQGADELFAGYHRYRRLLAEGRLEDALRHDLENIHHVNLERDDAVTMANSVELRVPFLDLQLIGVALTIPADLKIRGPEDELRKRILREAALEMGVPEYIAMRPKKAAQYGSGIDKVLRRKVLPGFDHETFLRRLMF

SEQ ID NO: 17990 - protein, 308 aa, Unknown
  uncultured archaeon
MTEKKEYYKTLGVDRGSSQDEIKRAYRRLAKKYHPDLNKENHKESEEKFKEVSEAYEVLSDTQKRANYDKFGSAGVDFGRGGFEWSNFTRFSDVEDIFGGLFKDLFGGNFGRAQGGSSMFDDLFGRGHTGADAGYRPERGSDIQYDLEIDLEDAAMGMEEEISIARLDFCPNCSGTGANAGGLETCATCRGTGQVKRVQRQGFAQFISIGSCPRCRGTGKEIKDPCENCNGNGKIKVNKKILVKMPAGVDTGSRLRIAGEGNAGERGGPPGDLYVMIHVREHEFFKERATTCFVMLLFTSRRRCLAMR

SEQ ID NO: 17991 - protein, 561 aa, Xanthomonas axonopodis
MTESFAELFEASQANLAKLKPGSIVTGTVVEVRGDVVVINAGLKSEGIVPIEQFRNDAGEIDVGVGDQVKVALDSIENGFGETVLSREKAKRAMVWDELEEALEKNETITGRISGKVKGGFTVDIKDVRAFLPGSLVDVRPVRDPAYLEGKELEFKLIKLDRKRNNVVVSRRAVVESEHSEEREQLMDKLQEGAILKGVVKNLTDYGAFVDLGGIDGLLHITDMAWKRVRHPSEVVNVGDELDVRVLKFDRERNRVSLGLKQLGEDPWDNIARRYPANSRVFGKVSNVTDYGAFVEIEPGVEGLVHVSEMDWTNKNVNPSKVVQVGDEVEVMVLDVDEERRRISLGMKQVAANPWETFAATHKKNDKVSGQIKSITDFGIFIGLDGGIDGLVHLSDISWNTTGEDVVRNYKKGDTLEAVVLAVDPERERISLGVKQLEQDPFGQYMASNPKGSKVEGVVREVDAKGATIDLADGIEGYVAARDIANERVDDATQHLKVGDKIEAKFVGMDRKGRTLQLSIKAKDDAEMRETLEDYQSASASGGMTQLGALLRAQLNNNKSE

SEQ ID NO: 17992 - protein, 464 aa, Xanthomonas campestris
MTVVSVEHALAGKLPEGGEVTVRGWVRTLRGSAGLAFINVTDGSCFAPIQVVANDTLPNFDEIKRLTSGCSLIAKGVLVKSQGKGQSFEIQASGVEIVGWVEDPLTYPIQPKPMTPEFLREVAHLRPRTNLFGAVTRIRNCLAQAVHRFFHQNGFNWISTPIITTSDAEGAGQMFRVSTLDMVNLPRDASGNVDFSRDFFGKETFLTVSGQLNVEAYCLALSKVYTFGPTFRAENSHTTRHLAEFWMIEPEIAFADLAEDARLAEQFLKYLFRAVLDERGDDLAFLAERVDKNAITKLEAFINAPFEQIDYTEAVKLLQNSGKKFDFPVEWGLDLQTEHERWLTEEHIGRPVVVTNYPEHIKAFYMRLNDDGKTVAAMDVLAPGIGEIIGGSQREERLDVLDARMAQFGLDKEHYSWYRDFRRYGSVPHAGFGLGFERLVVYVCGLSNIRDAIPYPRAPGSAEF

SEQ ID NO: 17993 - protein, 479 aa, Chlamydophila pneumoniae
MQTNIGLIGLAVMGKNLVLNMIDHGFSVSVYNRTPEKTRDFLKEYPNHRELVGFESLEDFVNSLERPRKIMLMIQAGKPVDQSIHALLPFLEPGDVIIDGGNSYFKDSERRCKELQEKGILFLGVGISGGEEGARHGPSIMPGGNPEAWPLVAPIFQSIAAKVQGRPCCSWVGTGGAGHYVKAVHNGIEYGDIQLICEAYGILRDFLKLSATAVATILKEWNTLELESYLIRIASEVLALKDPEGIPVIDTILDVVGQKGTGKWTAIDALNSGVPLSLIIGAVLARFLSSWKEIREQAARNYPGTPLIFEMPHDPSVFIQDVFHALYASKIISYAQGFMLLGEASKEYNWGLDLGEIALMWRGGCIIQSAFLDVIHKGFAANPENTSLIFQEYFRGALRHAEMGWRRTVVTAIGAGLPIPCLAAAITFYDGYRTASSSMSLAQGLRDYFGAHTYERNDRPRGEFYHTDWVHTKTTERVK

SEQ ID NO: 17994 - protein, 459 aa, Propionibacterium acnes
MPCQGVYAWCGNPVSGGDGCHPSWQDMPLRADMPYEAWPSAKSSLEPSKRQGRQVTLVGVCIVSTMNPILGADMTTYQYLIVGGGMAADSAARGIRDIDKKGSIAILSADVDAPYPRPALSKKLWTDPEFTWDQADLATVADTGAELRLGTEVLSIDRDGKTVLTASGQVFGYQKLLLVTGLTPSRIDDDGDAVLYFRSARDYQQLRALAQPGHQFVVVGGGYIGAELAAGLVQQGCEVALVTPDPTLGGSQFPAQIASEYQKLFADAGVHLVTGKRVCSVRKHEAAEVTLDDGTILQADDVIAGLGASPVTKLAEEAGLTVNDGVIVDEQLRTNDPAIWAAGDIANYPDPVLGRTRVEHVDNAIAMGKAAGRIMAGSKDSYTHTPMMYSQIFGVRWEAVGTLDSSLATTSVEAGDGQVVYYLSDGKPVGVLLWNLPGRTDKAVTVLADPPEDLSTAIS

SEQ ID NO: 17995 - protein, 614 aa, Ashbya gossypii
MEPLIEIRSRLRKSSQDLLQLKLYQSARWSSEALIGMCEGGVEDTTADEGSPLRNRRGKGDTGIQVSMDSEPFGERQYDLFLLASSLFDCKEYDRCAYFLRNEKHPRLKFLRLYSRFMSWDKKTQESSSDVLTKPADIAQKDPGVGTNVVDWIDERNVDTRKEANIQSQMVVDLGTGEKISITLILRELELYLVEQLANSKEPADVGYALLYYLRGILEKKQGLASEAIKSFVRSLELYPYNWTCWCELATCITRTDESLLLVKHLRDLFPANGERGDNAVMLRFFKISIFKDFGGDFDHFMDELDYLMGLFPNFSFLKSELALLNYHYMDYVNAELIFDEIVKLDPYRLDDLDIYSNILYVIQKPHKLAYLSQFAADLDAYRPETCCIIANYFSAKQQHEKAIMYFRRALTLNKTCTNAWTLMGHEFVEMKNSHAAIECYRRAVDINPCDFKAWYGLGQAYEVLDRHLYALYYLQKACSLKPLDKRMWQALANCYDKLDRPNQAIKCFQRASQLSNDQDITILYYLATLYERVQDAISCKNYMLKCIEVESANQGIILDECAKARLWLARHEVKHRNFPAAYNYASGVTHGTSQEIEAARVIARECRKRMEYQ

SEQ ID NO: 17996 - protein, 602 aa, Aspergillus oryzae
MATQHKTQSSPVNAAWWKEASVYQIYPASFKDSNGDGIGDIPGIISELDYLKALGIDLNWLSPILQSPQVDMGYDVSDYYRIHPPYGTVEDVDALIQGLHQRGMRYVMDLVVNHTSDQHEWFKQSRSSSDNEYRDWYIWKKPKYDANGVRQPPNNWGAYFGGSAWQYDETTDEYYLHLFAPEQPDLNWENPKVRSAVHQIMRYWLDKGVSGFRMDVINMISKDQSFPDAPITDPKAQWQHGAMHYCCGPRLHEYLQELGRVLKEYDAFSVGEMPNVYDPVEIGKAVGFDRGELAMAFQFEIMDIDHGPAGKFSPHKYRMSDLKHIVSKWQDFMYENEGWNALYLENHDQGRTISRFTSAGPEYRATAGKMLATFLGLQGGTPFVYQGQEIGLVNVPETWGIEQFRDIETLNYWNEITAAYPNDTELHKVTSQQFRVKSRDNGRTPMQWTSGKFAGFTAAHNGPWIDVHDDYEDWNAASQVGNPNSVFQHWAKVLALRKAHKRLFVYGSYKLIDEANNDLFTYLRVYGSQSALVLANFTGKEVSWVVPAETISILKNGAVLLESYQRHRPVRPDGTIAVMPFESFVMFLDSPNARVGAGGGKL

SEQ ID NO: 17997 - protein, 109 aa, Lactobacillus reuteri
MCGIVAFVDNEKPQIKDQLIKKMKDRIIHRGPDAEGQYVDDDVALGFRRLSFIDVKSGNQPIFNEDSSKAIEFNGEIYNFEELREELISKGHTFKTHADTEVIDHCQQV

SEQ ID NO: 17998 - protein, 720 aa, Arabidopsis thaliana
MKSLHVAANAGDLAEDCGILGGDADDTVLMDGIDEVGREIWLDDHGGDNNHVHGHQDDDLIVHHDPSIFYGDLPTLPDFPCMSSSSSSSTSPAPVNAIVSSASSSSAASSSTSSAASWAILRSDGEDPTPNQNQYASGNCDDSSGALQSTASMEIPLDSSQGFGCGEGGGDCIDMMETFGYMDLLDSNEFFDTSAIFSQDDDTQNPNLMDQTLERQEDQVVVPMMENNSGGDMQMMNSSLEQDDDLAAVFLEWLKNNKETVSAEDLRKVKIKKATIESAARRLGGGKEAMKQLLKLILEWVQTNHLQRRRTTTTTTNLSYQQSFQQDPFQNPNPNNNNLIPPSDQTCFSPSTWVPPPPQQQAFVSDPGFGYMPAPNYPPQPEFLPLLESPPSWPPPPQSGPMPHQQFPMPPTSQYNQFGDPTGFNGYNMNPYQYPYVPAGQMRDQRLLRLCSSATKEARKKRMARQRRFLSHHHRHNNNNNNNNNNQQNQTQIGETCAAVAPQLNPVATTATGGTWMYWPNVPAVPPQLPPVMETQLPTMDRAGSASAMPRQQVVPDRRQGWKPEKNLRFLLQKVLKQSDVGNLGRIVLPKKEAETHLPELEARDGISLAMEDIGTSRVWNMRYRFWPNNKSRMYLLENTGDFVKTNGLQEGDFIVIYSDVKCGKYLIRGVKVRQPSGQKPEAPPSSAATKRQNKSQRNINNNSPSANVVVASPTSQTVK

SEQ ID NO: 17999 - protein, 220 aa, Unknown
  Rhodococcus sp. RHA1
MVTAEDALPGRSQPIPVPATHFVNGHPLQPPFPEGMQTAVLGMGCFWGAEKEFWQLDGVYTTAVGYAGGYTPNPTYEETCSGRTGHTEVVLVVFDPKVISYAEILKEFWENHDPTQGMRQGNDQGTQYRSAIYTIDEQQVEIAEATGEAFEKRLAQAGYGAITTEIAPLTQFYYAEDYHQQYLAKNPGGYCPVHATGVSCPVGLLKQDEVPAQTDILPPS

SEQ ID NO: 18000 - protein, 294 aa, Xanthomonas axonopodis
MTRHLLPVALIQERNHGDAEANLAVIASRVAEAAAQGAKLVLLQELHNGAYFCQHESVDEFNLAEPIPGPSTERLSALAKQHGVVLVASLFERRAAGLYHNTAVVFEKDGRLLGKYRKMHIPDDPGFYEKFYFTPGDLGFTPIDTSVGRLGVLVCWDQWYPEAARLMALAGAELLLYPTAIGWDPDDQQPEQERQRDAWILSHRGHAVANGVPVLSCNRVGHEPSPLGASGIQFWGNSHVLGPQGEFIAEAGQDPTVLICDVDLQRSEHVRRIWPFLRDRRIDAYGDLLKRYID

SEQ ID NO: 18001 - protein, 456 aa, Legionella pneumophila
MPYIPHTPDDTKEMLEAIGAQDIQDLFDEIPASLQYAGFQNIPAGINEMEMLKEAQNQAQKNRNGICFIGAGCYEHHIPAAVWDIASRGEFLTAYTPYQAEASQGTLQLLYEYQTMICELTGMEVSNASMYDGATALAEAVLMAVRLNKHSKTNRVLIAGTVHPFYRETIETIVRNQHIEVITLPFDEQQGITNLGSLNQYTGEDITALVIAQPNFFGCLEQVDKMTSWAHHNKTISVACVNPTSLALLKPPGSWGEHGVDIVCGEGQPLGSPMASGGPYFGFLSTRMAHVRQMPGRIIGRTVDKDGKTGFSLTLQAREQHIRRAKATSNICTNQGLLVTAATIYMSLLGPEGLSQVATQCHQNTHELITALTQIEGVELAFKAPFFHEALIKLNQPVQSVLQQLADAGIAGGYAPEQHYPQLANTLLVCATEVRTAEDIAKYAKTLKTIMSKRGA

SEQ ID NO: 18002 - protein, 268 aa, Oryza glumipatula
MVAEHPTPPQPHQPPPMDSTAGSGIAAPAAAAVCDLRMEPKIPEPFVWPNGDARPASAAELDMPVVDVGVLRDGDAEGLRRAAAQVATACATHGFFQVSGHGVDAALARAALDGASDFFRLPLAEKRRARRVPGTVSGYTSAHADRFASKLPWKETLSFGFHDRAAAPVVADYFSSTLGPDFAPMGRVYQKYCEEMKELSLTIMELLELSLGVERGYYREFFADSSSIMRCNYYPPCPEPERTLGTGPHCDPTALTILLQDDVGGLEV

SEQ ID NO: 18003 - protein, 284 aa, Arabidopsis thaliana
MACRDFLKAERAAQSAGMPKDSYTVMHLDLASLDSVRQFVDNFRRAEMPLDVLVCNAAVYQPTANQPTFTAEGFELSVGINHLGHFLLSRLLIDDLKNSDYPSKRLIIVGSITGNTNTLAGNVPPKANLGDLRGLAGGLNGLNSSAMIDGGDFVGAKAYKDSKVCNMLTMQEFHRRFHEDTGITFASLYPGCIATTGLFREHIPLFRTLFPPFQKYITKGYVSESEAGKRLAQVVADPSLTKSGVYWSWNKTSASFENQLSQEASDVEKARRVWEVSEKLVGLA

SEQ ID NO: 18004 - protein, 381 aa, Unknown
  Mycobacterium sp. JLS
MSSPQQRHQRVVVVGAGPCGLAIARQLLHEQRIEPLVLDRATAPASTWRDRYEGFRLNTCGYWSHLPGQPIPRRYGRWPKRDDMVDYFDSYVRRQRIPLSLGVTVTRIDRDGDRWLITTDGDTYTADAVVIATGNYHTPALPAWPGMEGYTGDLLHSADYRNPWPFAGRDVLVVGSGNSATDIALQLSDEVAGRVRLAVREPPHLMPRSAAGIPVDAFSAAFSRLPVPVIDHAAALASRLWFGDLTSAGLPAPRRGIYRALLDDGSIPTLGDELVPQIKAGRIEVVAAVESFEGDSVVLADGRTIRPDVVIGATGYRHGLEPLVGHLDVLDEDGAPLVNGLPPAAPGLWFAGYEEPIIGPLQSFRLQAGPLAAEVAGFAAG

SEQ ID NO: 18005 - protein, 554 aa, Triticum aestivum
  misc_feature (230)..(230): Xaa can be any naturally occurring amino acid
NKFVQKSRLVPLRHARHYLPNPTLQPLPRGARGGRPPPPPPPPTMAMATALRKLSARGQPLSRLTPLYSMASLPATEERSAVTWPKQLNAPLEEVDPEIADIIELEKARQWKGLELIPSENFTSLSVMQAVGSVMTNKYSEGYPGARYYGGNEYIDMAETLCQKRALEAFNLDPEKWGVNVQPLSGSPANFHVYTALLKPHDRIMALDLPHGGHLSHGYQTDTKKISAVXIFFETMPYRLDESTGLIDYDQLEKSAVLFRPKLIVAGASAYARLYDYNRMRKICDKQKAVLLADMAHISGLVAAGVIPSPFEYADVVTTTTHKSLRGPRGAMIFFRKGVKEINKQGKEVKYDFEDKINAAVFPGLQGGPHNHTITGLAVALKQATTQEYRAYQEQVMSNSARFAESLTSKGYDIVSGGTDNHLVLVNLKKKGIDGSRVEKVLENVHIAANKNTVPGDVSAMVPGGIRMGTPALTSRGFVEEDFAKVADFFDSAVNLALKVKAAAAGTKLKDFVATLQSDSNIQAEIAKLRHDVEEYAKQFPTIGFEKETMKYKN

SEQ ID NO: 18006 - protein, 322 aa, Unknown
  Synechococcus sp. CC9605
MSIAPDITALIGGTPLVRLNRLPQACGCQAEILAKLESFNPSASVKDRIASAMVLEAEQSGTIIPGRTVLVEPTSGNTGIALAMVAAARGYRLILTMPDTMSTERRAMLRAYGAELQLTDGAQGMNGAIALAKELVDEIPNAYLLQQFDNPANPAVHERTTAEEIWRDTEGQIDAFVAGVGTGGTITGCARLLKQRQPQLQVIAVEPEASAVLSGKPPGAHRIQGIGAGFVPAVLELDRIDSILTVSDEEAMQVGRRLAREEGLLCGISSGAAMAAALRVGQDPAMVGKRLVVMLASYGERYLSTPMFSAASQLPARRDGQL

SEQ ID NO: 18007 - protein, 82 aa, Glycine max
HEKVLTYSAQDSIYKVFDLENYTLLYSISDKNVQEIKIRLFFLPSLYYDYFKKTLPSIDEMFYSQMIMHNLYEIISHQLLNF

SEQ ID NO: 18008 - protein, 605 aa, Bacillus cereus
MIFHRGPDDEGYFRDEHVQFGFRRLSIIDLEAGHQPLTYENDRYVIIFNGEIYNYVELREMLLEKGATFATQSDTEVIIALYAHMKEKCVDYLRGMFAFMIWDREEKKLFGARDHFGIKPLYIAQQGDTTFFASEKKSIMHVMEDKGVNPTSLQHYFTYQYGPEPETLTIDVNKIEPGHYFVKEIGKEMEIHRYWKPYFNASSATKEEHIQAIRDVLYDSVKVHMRSDVPVGSFLSGGIDSSIIASIAREMNPNLLTFSVGFEQRGFSEVDVAKETAEKLGVKNHNVFISAKEFMDEFPKIIWHMDDPLADPAAVPLYFVAKEARKHVTVVLSGEGADELFGGYNIYREPNSLKMFSYIPSPGKSVLKALSGALKEGFKGKSFLERGCTPIEERYYGNAKIFREEEKAELMKYYNESVNYMDITKPLYNEIKDYDDVSKMQYIDMFTWLRGDILLKADKMTMANSLELRVPFLDKEVFDVASKIPTEFKIANGTTKAILREAARGIVPDHVLDRKKLGFPVPIRHWLKDEMHDWAINIINESKTEHLIDKQYVLNLLEAHCADKGDYSRKIWTVLAFMVWHQIYVEHKYDTNKFHEETKRAYSLV

SEQ ID NO: 18009 - protein, 468 aa, Burkholderia pseudomallei
MQKGHSETDLHRGLGQRQMRLIALGAAIGVGLFLGSANAIKMAGPGIILSYIIGGAVIFVIMRALGEMAVHEPVAGSFSRYARNYLGPLAGYLTGWNYWFLWLVTCIAEITAVGIYMGIWFPDVPRWIWALAALATMGSVNLLTVKAYGEFEFWFALIKVVTIVVMIAVGIAMIAFGIGNHGVPMGISNLWAHGGFFPNGAQGVLMSMQMVMFAYLGVEMIGLTAGEAANPQKTIPGAINSVFWRILLFYGGALFVILSIYPWNEIGTQGSPFVMTFERLGIKTAAGIINFVVLTAALSSCNGGIFSTGRMLYNLAQQGHAPRTFGETTASGVPRRAIVVSMAALLVGVLLNYLVPEKVFVWVTSISTFGAIWTWGVILVTQMKFRASLAPAEERALRFRMPFWPYASWVALAFLVLVIGLMAYFPDTRIALYVGPAWLVLLVVLYFVLKLEPEGGKAAGLERRYGRG

SEQ ID NO: 18010 - protein, 295 aa, Rickettsia conorii
MSKIPSVNIKALLDAGVHFGHKTSRWNPKMASYIYGERDDVHIIDLRQSVALMSVALNAIYETVKKDGKILFVSTKIQASDIIAEYAEKCGQYYVNHRWLGGMLTNWKTIAGSIEKLNKLDKTLENEEALMGYTKKEILNMSRKKDKLLLSLAGIRNLNSKPDLLVVIDTNKEHIAINEAVKLNVPIVAVVDTNSNPDNVDYPIPGNDDSIRAIRLYCSLFADAALQGLEESMKASGVDMGAMQEHTDKGLTSKNVSKLKQTKKFSKTKNIDEETNTEFEQALNDADENKNSDNA

SEQ ID NO: 18011 - protein, 300 aa, Unknown
  Frankia sp. EAN1pec
MAVVTMKQLLESGVHFGHQTKRWNPKMKRYIFTERNGIYIIDLQQTLSYIDRAYDFVKETVAHGGTVLFIGTKKQAQEAIEEQAQRVGMPFVKERWLGGMLTNFSTVYKRLQRLKELEEIELTGGTEVRTKKEQLVLTREKAKLERTLGGIRDMARVPSAVWVVDTKKEHIAVGEARKLGIPVVAILDTNCDPDEVDYPIPGNDDAIRSAALLTRVVADAVAEGLMSRAGASSNAEAKPEQSTGEEPLAEWEQALLRGDAAAEAPAAPVAAEAAEPTEAVAAVETATEEQPQPDAVGTAV

SEQ ID NO: 18012 - protein, 384 aa, Campylobacter lari
MKLRNFQNFLSLEILGGLLLLLATIFALLLKNSPYGQHYMDFLSVEMGVKVGAWELFKPSLLWINDGLIAIFFFAIGLELKKEFVQGEFKTLSNITLPLMAAIGGIVVPALIFCAINFNDAYVLKGWAIPTATDTAFALVILAMLKQRIPSSLKIFLVSLAIFDDVGAILIIAIFYTGELSTLAFIVAFCCIVGLFLLNRLSNERKSFYYILGALLWLSVLKSGVHATLAGIITALFIPVYTKNNHALLEEIEHGLKFWIAFIILPLFAFANAGVDLSKIEAHMLFSGVSVGIFLGLFIGKQLGVFGFAYMAIKLKLAKLPKDANFKQLYGVCILTGIGFTMSFFIDALAYEVSDIFNFVDNFAILLASLASGVFGYFYLRFIK

SEQ ID NO: 18013 - protein, 286 aa, Hordeum vulgare
MASSVAAAASTFLGTRLADPRPQNGRIVARFGFGKKKAPPKKAKAPPTTDRPLWFPGAQAPEYLDGTLVGDYGFDPFGLGKPAEYLQYDVDSLDQNLAQNLAGEIIGTRFEDADVKSTPFQPYAEVFGLQRFRECELIHGRWAMLATLGALTVEWLTGVTWQDAGKVELVDGSSYLGQPLPFTITTLIWIEVLVIGYIEFQRNAELDPERRLYPGGSYFDPLGLAADPEKKETLQLAEIKHARLAMVAFLGFAVQAAATGKGRLNNWATHLSDPLHTTIFDTFGSS

SEQ ID NO: 18014 - protein, 386 aa, Campylobacter lari
MQKLQTFVKSETFPGVLLIFFTVLALILQNSSLTDQYTNFLNIPFGFQAGSLEIFKPLLLWINDGLIAIFFFAIGLELKYEVTRGQLNSIKAMSLPVFAALGGMVVPALIFAFFNYKDPFALQGWAIPTATDVAFAVGILMLLGKRVPTSLKLFLLSLAIFDDLGAIIVIALFYTSELSVFAMIAALVCILALYLLNHFHVTKKSFYIIIAIVFWISMLKSGVHATLAGVITALFIPLQTKSGESFLKEIEHDLAPWVSYFILPIFAFANAGVDLKDMDPSFMFSSVSLGIILGLFLGKQIGVFLFSYISIKLGLAKLPQNVNFKQLYGVCILTGIGFTMSFFIDGLAYQNSDIFAYSDKLAILIASLLSAIVGYAYLKLIYSFKK

SEQ ID NO: 18015 - protein, 456 aa, Bacillus licheniformis
MANKELKRGLGARHIQMIALGGTIGVGLFMGSSSTIKWTGPSVLLAYAICGIFIFFIMRAMGEMLYVEPSTGSFATFGHQYIHPLAGYMTAWSNWFQWVIVGMSEIIAVGEYMKYWFPDLPAWIPGIIAMAILGGANLVSVKSFGEFEFWFAMIKIVTIVLMIAAGFGIIFFGFGNGGQAIGFSNLWSHGGFFTGGFSGFFFALSLVIAAYQGVELIGITAGEAKDPQNTLRHAIQSIIWRILIFYIGAIFVIVTVYPWDELNAIGSPFVSTFAKVGITAAAGIINFVVMTAAMSGCNSGIFSAGRMLYTLGVNGQAPKFFTKISRNGVPLYGTIAVLIGLAIGVVLNYIAPPNIFVYVYSASVLPGMIPWFVILLSHIGFRKAKGAEIDKHPFKMPFAPVTNYLTIGFLLMVLVGMWFNNDTRVSLIVGVIFLAVVAASYYVFGIGKRASADGNK

SEQ ID NO: 18016 - protein, 314 aa, Debaryomyces hansenii
MLIEAPQIDLKSFQHACINVIDNKYWFHETSAEGFPGQAFALEIDQILYHVHSQYQDILIFKSTTFGNVLVLNGIIQCTERDEFAYQELITHLPIMCHASPRRVLVIGGGDCGVVRELIKHLDEGVDEITMVEIDDMVIKLLAKFLPEMAKFHDHPRVKMIIDDGFKYLKSLSAQAHEKYDVIITDSSDPDGPAEDFFQTNYFKLLSNALNPDGIVIMQSSENIWLNINYLSQLMQKANRVFNNVAYSQCYMPSYTSGQLGLIVATNDTSNVLSIPSRKFSPEKELHLFKYYSSSVHQASFVLPTWAHKTLNNN

SEQ ID NO: 18017 - protein, 285 aa, Schizosaccharomyces pombe
MGRSSKDKRDAYYRLAKEQGWRARSAFKLLQLNEQFNLFEGAKRVVDLCAAPGSWSQVLSRELLKNIDTSIAADEKPMIVAVDLQPMAPIDGVCTLQLDITHPNTLSIILSHFGNEPADLVVSDGAPDVTGLHDLDEYIQAQILLAAFNLAVCVLKPGGKFVAKIFRGRDVSLLYSQLRLMFRKVSCAKPRSSRASSIESFVVCEDFNPPSNFQPDLTKPLCVIDPTNAHEIAPFIACGDLDGYDADATYPVEINMKKATLDVIQPPTAPPYKRAIELKHSKMMS

SEQ ID NO: 18018 - protein, 325 aa, Schizosaccharomyces pombe
MQVVDEKTILELENERFDESSQFKTPEKLIVEASDMTAFRQSKAYYRIFDFLQRLNIASVGVNDYHVEYSTRVEKLVRILCRVKEITKTVPPASGRHRFGNPAFRIWHEKLRDSASQIMDIIIPDSLSKAKVELLDYFLGSFGNSQRIDFGTGHELNFLGFIKGLDLLGLLDAADYKAIALYITHVYLEVCRELVQTYRLEPAGSHGVWGLDDHFFIPYIFGSAQLADKASSSIIKPDAILNKKIVDEKANSNLYFSAIKFINVMKKGPFYEHSPILYDITAVPIWSKVNQGLIKMYDVEVLSKYPVVQHFHFGNLFPFNPLVAK

SEQ ID NO: 18019 - protein, 372 aa, Pseudomonas putida
MRSKVTGAKRWVVKIGSALLTADGKGLDRGAMAVWVEQMVALREAGVELVLVSSGAVAAGMSQLGWTKRPSAMNELQAAASLGQMRLVQAWESSFGEHGKHTAQILLTHDDLSDRKRYLNARSTLRTLVDLGVVPVINENDTVVTDEIRFGDNDTLAALVANLVEADLLVILTDRDGMFDADPRNNPEAQLIYEARADDPSLDAVAGGTGGALGRGGMQTKLRAARLAARSGAHTIIIGGRIERVLDRLKAGERLGTLLSPERGMLAARKQWLAGHLQTRGTLVLDAGAVQALRQANKSLLPVGVKTVQGSFRRGEMVVCVGPDGVEVARGLANYSALEAQKIIGQSSEAIESILGYSAEPELVHRDNLVLV

SEQ ID NO: 18020 - protein, 424 aa, Mycobacterium smegmatis
MSVEAQSRSGAVDTQEPADLREQVHSAARRARVAARTLATLSAEAKNRALHAAADSVLANVDAVLAANAADVDAARQGGTPEAMIDRLALNPQRVDGIAAGLRQVAALPDPVGEVLRGKTLPNGLQLRQQRVPLGVVGMVYEGRPNVTVDAFGLTLKSGNAALLRGSSSAARSNQALVDALRSALAEEGLPLDAVQLLPSQDRASVTHLIQARGLVDVVIPRGGAGLIDAVVRDAQVPTIETGVGNCHVYVHSSADIDMAEKILLNAKTRRPSVCNAAETLLVDRALTDTALPRLVKALQDAGVTVHADPTEDELRAEFLSMDIALAVVDGLDAAIDHINTYGTGHTEAIVTTDLAAAQRFTERVDAAAVMVNASTSFTDGEQFGFGAEIGISTQKLHARGPMGLPELTSTKWIVWGDGQIRPA

SEQ ID NO: 18021 - protein, 343 aa, Solanum habrochaites
MEMDLPVSAIGFEGFEKRLEISFVEPGLFADPNGKGLRSLTKAQLDEILGPAECTIVDNLSNDYVDSYVLSESSLFVYSYKIIIKTCGTTKLLLAIPPILRLAETLSLKVQDVRYTRGSFIFPGAQSFPHRHFSEEVAVLDGYFGKLAAGSKAVIMGNPDKTQKWHVYSASAGTVQCNDPVYTLEMCMTGLDREKASVFYKTEESSAAHMTVRSGIRKILPKSEICDFEFEPCGYSMNSIEGAAVSTIHITPEDGFSYASFESVGYDPKTTELGPLVERVLACFEPAEFSFALHADVATKLLERVCSVDVKGYSLAEWSPEEFGKGGSIVYQKFTRTPYCESP

SEQ ID NO: 18022 - protein, 96 aa, Petroselinum crispum
ATYNVKLITPDGEVEFKCDDDVYVLDQAEEEGIDIPYSCRAGSCSSCAGKVVSGSIDQSDQSFLDDEQMDAGYVLTCHAYPTSDVVIETHKEEEIV

SEQ ID NO: 18023 - protein, 730 aa, Oryza sativa
MDFGDEPEGSDSQRRRKRYHRHTPRQIQQLEAYAFSLFFFLLLFFYVLLAFVRHGGGAMDGGMKWMFKECPHPDENQRAQLSRELGLEPRQIKFWFQNRRTQMKAQHERADNCFLRAENDKIRCENIAIREALKNVICPTCGGPPVGEDYFDEQKLRMENARLKEELDRVSNLTSKYLGRPFTQLPPATPPMTVSSLDLSVGGMGGPSLDLDLLSGGSSGIPFQLPAPVSDMERPMMAEMATRAMDELIRLAQAGDHIWFKSPGGGVSGGDARETLNVDTYDSIFSKPGGSYRAPSINVEGSRESGLVLMSAVALADVFMDTNKWMEFFPSIVSKAHTIDVLVNGMGGRSESLILMYEELHIMTPAVPTREVNFVRYCRQIEQGLWAIADVSVDLQRDAHFGAPPPRSRRLPSGCLIADMANGYSKVYAMDNVPHAMVFWFRLADDVAHARVEEKSPINVLYRDLVLSGAAFGAHRWLAALQRACERYASLVALGVPHHIAGVTPEGKRSMMKLSQRMVNSFCSSLGASQMHQWTTLSGSNEVSVRVTMHRSTDPGQPNGVVLSAATSIWLPVPCDHVFAFVRDENTRSQGLNASQNSMLILQESCTDASGSLVVYSPIDIPAANVVMSGEDPSSIPLLPSGFTILPDGRPGSAAGASTSSAGPLAAARGGGGGGAGGGSVVTVAFQILVSSLPSSKLNAESVATVNGLITTTVEQIKAALNCSAHGHHP

SEQ ID NO: 18024 - protein, 181 aa, Solanum lycopersicum
MASSIVSSAAAATRSNVAQASMVAPFTGLKSAASFPVTKKNNNVDITSLASNGGRVRCMQVWPPINMKKYETLSYLPDLSDEQLLSEIEYLLKNGWVPCLEFETERGFVYRENNSSPGYYDGRYWTMWKLPMFGCTDATQVLAEVQEAKKAYPQAWVRIIGFDNVRQVQCISFIAYKPEGF

SEQ ID NO: 18025 - protein, 305 aa, Mycobacterium smegmatis
MTKWTTARIPDQTGRVAIVTGANTGLGLETAKALAAKGAHVVLAVRNLDKGKAAVDWIARSAPTADLELQQLDLGSLASVRAAADDLKGKFDRIDLLVNNAGVMWPPRQTTADGFELQFGTNHLGHFALTGLLLDRMLTVPGSRVVTVSSQGHRILAAIHFDDLQWERRYNRVAAYGQSKLANLLFTYELQRRLTGHQTTALAAHPGASNTELARHLPGALERLVTPLAQDAALGALPTLRAATDPGALGGQYFGPDGIGETRGYPKVVASSAQSHDADLQRRLWAVSEELTGVTFPVGEALQQA

SEQ ID NO: 18026 - protein, 227 aa, Glycine soja
LGNNLPTPQEVVALYNQANIRRMRIYGPSPEVLEALRGSNIELLLDIPNDNLRNLASSQDNANKLVQDNIKNYANNVRFRYVSVGNEVKPEHSFAQFLVPALENIQRAISNAGLGNQVKVSTAIDTGALAESFPPSKGSFKSDYRGAYLDGVIRFLVNNNAPLMVNVYSYFAYTANPKDISLDYALFRSPSVVVQDGSLGYRNLFDASVDAVYAALEKAGGGSLNIV

SEQ ID NO: 18027 - protein, 285 aa, Oryza sativa
MSEELKRDFEIGEEIGRGRFGVVHRCASRSTGEAYAVKSVDRSRLSDDLDRSLAALEPKLARLAAAGNPGVVQVHAVYEDDDWTHTVMDLCTGPDLLDWVRLRCGQPVPEPDAAAVVAQIAEALALCHRRGVAHRDVKPDNVLLDATGDGPPRVRLADFGSAAWVGDGISAEGLVGTPHYVAPEVVAGGEYGEKADVWSAGVVMYVLLTGGALPFGGETASDVFAAVLRGNLRFPPRLFSGVSPAAKDLMRRMMCRDVYRRFSAEQVLRHPWIVSGGGARDVQPT

SEQ ID NO: 18028 - protein, 320 aa, Erwinia carotovora
MIRRIGVLTSGGDAPGMNAAIRGVVRAALSEGLEIYGIYDGYQGLYEDRMEQLDRYSVSDVINRGGTFLGSARFPQFRDEAVRQVCVENMQRRGLDALVVIGGDGSYMGAKRLTEMGFPCIGLPGTIDNDVAGTDYTIGYFTALETVLEAIDRLRDTSSSHQRISIVEVMGRHCGDLTLAAAIAGGCEFIVLPEVPFSPEDLVSEIKAGIEKGKKHAIVAITELVCDVDELAKYIEKETGRETRSTVLGHIQRGGSPVAYDRILASRMGAYSIELLQQGYGGRCVGIQNEKMVHHDIVDAIENMKRPFKGDWLETAKKLF

SEQ ID NO: 18029 - protein, 521 aa, Enterobacter sakazakii
MLDTNMKTQLKAYLERLTKPVELVATLDDSAKSAEIKELLLEIAELSDKVSFREDNTLAARKPSFLITNPGSDQGPRFAGSPLGHEFTSLVLALLWTGGHPSKEAQALLEQIRDLDGDFEFETYYSLSCHNCPDVVQALNLMAVLNPRIKHTAIDGAVFQNEITERNVMGVPAVFMNGVEFGSGRMTLAEIVAKVDTGAEKRAAEELNQRDAYDVLIVGSGPAGAAAAIYSARKGIRTGLMGERFGGQVLDTVDIENYISVPKTEGQKLAGALKAHVDDYDVDVIDTQSATKLIPAASEGGLHQIETASGAVLKARSVIVATGAKWRNMGVPGEDQYRTKGVTYCPHCDGPLFKGKRVAVIGGGNSGVEAAIDLAGIVEHVTLLEFAPEMKADQVLQDKLRSLKNVDIILNAMTTEVKGDGTKLIGLDYQDRVTGSVKHLEVAGIFVQIGLLPNTTWLEGAVERNRMGEIIIDAKCETSVKGVFAAGDCTTVPYKQIIIATGEGAKASLSAFDYLIRTKTA

SEQ ID NO: 18030 - protein, 504 aa, Unknown
  Burkholderia sp. 383
MLHRRALVLSILVLASCGLGYELISSALSSYLLGDSILQFSSVIGCYLFAMGIGSWLAKFVEDDDVLDRFVDIELLVGLLGGVSAALLFAVFAWLAAPFRAALYALVLALGMLIGMEIPLVMRAFQQRRQAFRHTVSEVLTFDYLGSLAVSLIFPLVLAPRLGLLRTSFLFGLLNAFVALWTTHLFRDEIRNVRGKLMRASLVIGLLVAGFALSDRITHWAEHGVYGDETIYSETTPYQRIVLTQWHDDMRLYLNGNLQFSSRDEHRYHEALIHPTIDALPWAKRVLVLGGGDGLAVRELLKHRNLEQITLVDLDPAMTKLFSTSAPLVKLNQGSLKDPRVHVINDDAVRWLESNADVYDAIVVDFPDPTNFGLGRLYSVPVFRLLARHLSENGYAVIQSTSPYFAPHAYWTIIATLHEAGLNTWPYHCYVPSFGDWGFVIAGKRRDFTVPTHYSVPTRWLDAQTAAEMFHFPADMPALPMSPNELNDQPLVRRFDDDWKHVLR

SEQ ID NO: 18031 - protein, 214 aa, Glycine soja
NGNNLPTKQAVVDLYKSNRIGKIRLYYPDEGVLQALRGSNIEVILGVPNDQLQSLTNAGAATNWVNKYVKAYSQNVKFKYIAVGNEIHPGDSLAGSVLPALENIQKAISAANLQGQMKVSTAIDTTLLGNSYPPKDGVFSSSASSYIRPIVNFLARNGAPLLANVYPYFAYVNNQQSIGLDYALFTKHGNNEVGYQNLFDALLDSLYAALEKVG

SEQ ID NO: 18032 - protein, 502 aa, Clostridium difficile
MRIMKGKVYLVGAGPGDYKLMTLKGLECIRKSDVIVYDRLANSSYLREAKPDCELIYVGKASSNHILPQEDINRIIAEKAKEGKIVTRLKGGDPYVFGRGGEEAETLVDEGIEFEVVPGITSAIGGLCYAGIPITHRDHASSFHVITGHLKGDDSGELNWNALANNKGTLVFLMGISNLEKISENLMKEGKDKDTPVALISWATRYNQRVVTSTLENVYETAIKEEVKPPTLIVVGSVVGLREKLNFFESKPLFGKSIAVTRSRNQNSVLVEKIMDLGGNPIEIPTIKVEKIQNNINLENEIKNINKYNYLILTSKNAVEIFFEKIYEMNFDLRILSNLKVCAIGSATSNELKKRGIIADIVPKKFVAESLYEELAPILNDDDNILIPRAENARDYLVDKLKAICEVTEVHIYRTVIDEEKKGEILDILNSNDIDYITFTSSSTVNNLVEIIGKENIKILEKIKTLSIGPITTETINSLGIKLYKESATSTIDSLVDLIIKN

SEQ ID NO: 18033 - protein, 87 aa, Nostoc punctiforme
MVRVQEIPLNQIKRPLPRANDPNKVQALMESIAEIGQQEPIDVLEVDGQYYGFSGCHRYEACQRLGKETVLARVRKAPRSVLKMHLA

SEQ ID NO: 18034 - protein, 916 aa, Unknown
  Candidatus Kuenenia stuttgartiensis
MNSSLLFRNRKIKNPLLKNVHNRLDEAIEVIREKDPVFYKNCHKLFPVLKTPEHVWKIPLEFYTDGGVKLVLRITVVFHNLALGPPKGGILLIPPHILGDGFFELFDQLRKQKTSLDEIREFCFEWVSEGIEALSIVTTLKLALYSLPLGGGMCGIFLGKPEYDRGELFLKSIDLTNNEKRRLVREVGYLLTKEGIMGYDAYSPGPDIGTDGAMMDSIADGHFRALTEMEKIREKGLLEKLKSIRDAEIVWTVDLPYLKTAAAFAKEIKIPAEAKRSVPELGAVTFKTHGGLAGRGEATAFAAVEITNILVWHNEDPKDYLKVRIGRERKNYLAEKTVVIHGFDNIGLNASQFFSRKGAKVVAVSEYERREKKLVAVYNYEGIDVDALIRHKETCGGIYGFRGASVYAEPYQLLNEKVDIVFLAAIENQIHDHNAESIQARYVISAANAGISQEGYHILIKKGKIVARDSIVKSGGIIASYLEKIQNAQNDYWEKEYVFKDIISRIENVLKNNVFKNLVEKHSIDLSVAGDVAAIKRITSTMEAKNAPQKKMKDKKPLIIGIFDSGQGGIIVTEKLNRILPVGNIKLLLFTDKANFPFGQKSKEEINDITFRAVHEINERCKTMHQSNGFFYRFIYNTPYFLKTVFIWLGIIPRDVIVCFACNTVDTMVNHKKLRIRFPHIQFIGPVKKTLLKINALPKDARIGIIGTVGTIKSGIYEKRIREAGYHVLAKPTPLLAVLSEMLYKKSFDTEEKQKEFYKTARDLIYVNLKEFIKKNTISHLCLACTHYDYLKSTLKDLFGEVEFISTVETVIEEVQDIINQIPLQMGERELEFIKRARKGKDLDRLILEDIISSQNLSPEEKVKLGDREDQIKNILQNKLEGITADEIEEMKFFDSNSVKVKYNGKERLVSLFHLQ

SEQ ID NO: 18035 - protein, 112 aa, Glycine max
MILLLGGSQLPNCSASAIITYSSSPSMSGFYIVMQTASSIISFSAVVAVFRAAPGMVTPFSDIKTMVGFPSKKTNNDITSIPSTGGRVQCMQVWPPVGKKKFETLSYLPDLM

SEQ ID NO: 18036 - protein, 402 aa, Coprinopsis cinerea
MPEPFEGPEKLLELWFEPSETEIQGGLRGVPRESWEEMLDIVRCKVLSVVNGEDHDAYLLSESSLFVASHKLILKTCGTTLNLLGLPRIIEIAAQQAGLPIVHRCFYSRKSFMFPDRQQGPHRDWKEEVEFLDKIFSNGAAYTVGKMNGDHWLLYLTDPDELLSPSPISEKPSQSLNGDSPNSPVHLDYTIEILMSGLSPTAREHFFLPEDVESEDPQLASAHGLKLSEKIGISDIFPSHLTTLDAYSFTPCGYSSNALIKWGEDSLNSEDHPLARQSGEGYYTIHVTPEAGWSYASFECNVPLSVGQSTESKIIPDLQSLIKRVVSIFQPNRLTLTLFISSADSGDSVELAQRDFKRALDDLPESAFGYPLKGPPRRYRRTDKINYEFGGYDLAFASFELK

SEQ ID NO: 18037 - protein, 192 aa, Zea mays
MSSAPLQIAPVPEHVCYVRCNFCNTILAVSVPSHSMLNIVTVRCGHCTSLLSVNLRGLIQSLPVQNHHYSQQQENFTVQNMGFTENYPEYAPSYRMPTTLSAKGDLDHMLHVRAPEKRQRVPSAYNRFIKEEIRRIKACNPDISHREAFSTAAKNWAHFPNIHFGLGPCESSNNLDEATGAMCHPRKVQDLY

SEQ ID NO: 18038 - protein, 149 aa, Bacillus cereus
MGYIEELRKVVGSRPLNLAGVAVAVFNKQGQILLQQRQNGIWGVPGGFVELGESTEEAGRREVFEETGIEIGTLQLISVFSGKEFFVKLPNGDEFYPITIAYLCKDIKGGLLKADGIESLSVQFFDFDKLPENISPFIKKLIEQNLVSI

SEQ ID NO: 18039 - protein, 152 aa, Vibrio angustum
MYRTTRTMASSKHIALVAHDNCKVDLLRWVKEHKDKLASHELYATGTTGHLLSKEIGLPINCLISGPMGGDQQLGALISEGKIDMMIFFWDPLNAVPHDPDVKALLRISAVWNIPVATNRASANFMITSPLLDQEVSIEIPDYDAYLAERIN

SEQ ID NO: 18040 - protein, 153 aa, Oryza sativa
MAPKAEKKPAAKKPAEEEPAAEKAEKALAGKKPKAEKRLPAGKAEKSSGEGKKAGRKKAKKSVETYKIYIFKVLKQVHPDIGISSKAMSIMNSFINDIFEKLAGESAKLARYNKKPTITSREIQTSVRLVLPGELAKHAVSEGTKAVTKFTSA

SEQ ID NO: 18041 - protein, 587 aa, Unknown
  Candidatus Kuenenia stuttgartiensis
MKVLLLFPPSWHPSQPYLSLPSLTAFLKQNGVSDVIQRDLNIELLDMLLTQKTCGESYNKITDKLRGLEERLINSLNYHEERNALTEAVEALPWFIHQVERAKNILRSDAFYHLDSYMEAVHIVNEALRLMSSLFYPSVMTAVSNTMRFSVYSSNDILQAIHSERENIFLSLYKEYVLSSILEATPKIVGISITNTSQIIPGLTLAKLIKEQNREIHITVGGSVFTKLIEELKKVDSLFTLVDSFIVFEGEHALLELCAQVDGKNDFKKVPNLVYREKGVIKINDNYFSEDLNTLPTPDFKGFPLSLYFTPSLVLPIQTSRGCYYRKCAFCNLHLDHRNFRLRRTDLIMEDIQKLSREYQTKCFFFTDESVPMNKLREISQCLLESRDEIKWMGGVRFEKALTGDVLKKMAEAGCQKLVFGLESYCQRVLDKMKKGTKRDVVKKTLDECLKAGISFHLYVIVGFPTETENEAMETLDFVLNEEYLHSAGYSCLPSLFGMEKDSPIVNNPSEYGLASIRSPIGEDLGLGYLYAVKEGMSPQKAEEMYNYMISKLSGTLCPFPYNYSMADGLLYLVYRNKNNKEEVVLR

SEQ ID NO: 18042 - protein, 250 aa, Clostridium difficile
MNKVHFVGAGPGDKELITLKGYKLLSNADVVIYAGSLVNPELLEYCKEDCQIHNSAHMDLQEIIDVMREGIENNKSVVRLQTGDFSIYGSIREQVEDLNKLNIDYDCTPGVSSFLGAASSLGVEYTVPEISQSVIITRMEGRTPVPEKESIQSYAKHQTSMVIFLSVQEIEKVVSKLLEGGYPKDTPIAVIYKATWADEKIVKGTLSDIAVKVKENNINKTALIMVGRFLGEEYNNSKLYDKDFKHEYRG

SEQ ID NO: 18043 - protein, 474 aa, Listeria ivanovii
MRTDMNNLNLSEEIKRAINELGYKEATPVQKEVIPVALTGKDIVAKSQTGSGKTAAFAIPIAEQVIWEENKPQALIIVPTRELAMQVKAECTNIGRFKRIKAAAIYGQSPFAKQKLELSQKNHIVVGTPGRLLDHIEKGTLNVDKVAYLVLDEVDEMLSMGFIDQVEDILQFLPKKRQNLFFSATMPEEMQDLIKRYQDDPIVIEMAAEKTNPITHIEMQTENKEKTLQDVLITENPDSAIIFCNTKNQVDELSDLLQVNTAKIHGGLRQEERFRAMDDFKSGKSRFLIATDVAGRGIDVENVTLVINYDLPIEKENYVHRIGRTGRAGNSGKAISFVKTNENPLLRDMEDMLKITIEKKRKPTIIEVKASEEAFRKKQQKRPTIKKARGEKLNKNIMKLYFNGGKKKKIRAVDFVGTISKLEGITSEDIGIITIEDHVSFVEILNGKGPAVLEMMRSRKVKGRQLKVNEARKR

SEQ ID NO: 18044 - protein, 137 aa, Glycine max
MQTALTFAAPNVVPLAPTKSVSHITIFPTKLKAPRSSPRYSPIRVATVEPDTSTVDYNSAFSVFPAKACETVGGEACMAEMYPETKLQPEAKTPRVVTENVEREYLEYDDPKTVFRGEACDDLGGTFCETEYQKGVY

SEQ ID NO: 18045 - protein, 438 aa, Anabaena variabilis
MTNNMTTLQVASSLNDIAQQTRQAASLLAMLSTEAKNQAIAAVAQALESAKEEILQANIADCEAATAEGIAKPLYKRLQLDEHKLRDAIAGVRDVGKLADPIGQVQIQRELDTGLVLKRITCPLGVLGIIFEARPEAAIQIISLAIKSGNGVILKCGKEAVRSCEAIVKAVKQGLSTTDVNPDVVQLLTTREETLELLRLDKYVDLIIPRGSNSFVRFVQENTRIPVLGHADGICHVYIDKSADIEKAIAVSVDAKVQYPAACNAIETLLVHHSIAAEFLPKVAQALAERQVELKGDERTLQILPEIAAATAIDWETEYSDFILSIKIVDSLTEAIAHINQYGSRHTDAIITEDVAAVETFFGLVNSAGVFHNCSTRFADGFRYGFGAEVGISTQQMPPRGPVGLEGLVTYKYQMTGTGHIVATYTGENAKPFTHQDF

SEQ ID NO: 18046 - protein, 179 aa, Pasteurella multocida
MKKHHVGILISEQDVRARIQTLGREITQYYQQKAVEKVIVVGLLRGSFMFMADLVRELNLPVEIEFMTTSSYGSGMTTNHDVKISKDLDGDIKGEHVLIIEDIIDTGYTLQKVREILKLREPASLRICTLLDKPSRREVEVPVEWVGFSIPDEFVVGYGIDYAQRYRNLGYIGHVVLEE

SEQ ID NO: 18047 - protein, 387 aa, Oryza sativa
MLPAVKLSPGPVAFAGTNLRSRSASVSSVSSLKPSKFVVSSLRPLYLAPLDGPRAAGQKAQRQPLEFRCAASAADDKESKTEVVPVRSEAAQKLKISIYFATWWALNVIFNIYNKKVLNAFPYPWLTSTLSLACGSAMMLVSWATRLVEAPKTDLDFWKVLFPVAVAHTIGHVAATVSMSKVAVSFTHIIKSAEPAFSVLVSRFLLGETFPVPVYLSLLPIIGGCALAAVTELNFNMVGFMGAMISNLAFVFRNIFSKRGMKGKSVSGMNYYACLSIMSLVILTPFAIAMEGPQMWAAGWQKALAEVGPNVVWWVAAQSVFYHLYNQVSYMSLDEISPLTFSIGNTMKRISVIVSSIIIFHTPVRPVNALGAAIAILGTFLYSQAKQ

SEQ ID NO: 18048 - protein, 341 aa, Streptomyces avermitilis
MRIGVLTAGGDCPGLNAVIRSVVHRAVTMYGDEVIGFEDGYAGLLDGRYRALDLNAVSGILARGGTILGSSRLQRDRLREACENAQDMAREFGIDALIPIGGEGTLTAARMLSDAGLPVVGVPKTIDNDISATDRTFGFDTAVGVATEAMDRLKTTAESHQRVMVVEVMGRHAGWIALESGMAAGAHGICLPERPFDPAHLVKMVEERFARGKKFAVLCVAEGAHPVVGSMDYSHGAIDQFGHERFQGIGTALAAELEHRLGKEAKPVILGHIQRGGTPTAYDRVLATRFGWHAVEAAHRGDFGRMTALRGTDVQMVPLAEAVTELKTVPKDRMDEAESVF

SEQ ID NO: 18049 - protein, 152 aa, Arabidopsis thaliana
  misc_feature (64)..(64): Xaa can be any naturally occurring amino acid
  misc_feature (72)..(72): Xaa can be any naturally occurring amino acid
  misc_feature (75)..(75): Xaa can be any naturally occurring amino acid
  misc_feature (88)..(88): Xaa can be any naturally occurring amino acid
  misc_feature (93)..(93): Xaa can be any naturally occurring amino acid
  misc_feature (105)..(105): Xaa can be any naturally occurring amino acid
  misc_feature (126)..(126): Xaa can be any naturally occurring amino acid
  misc_feature (144)..(144): Xaa can be any naturally occurring amino acid
MASSMLSSNAVVKSQAQATMVAPFTGLKSSASLKVTRKANNDITSITSNGGRVSRMKVWPPIGXKKYQTLTXLTXLGESERLRKLAKXLRNKXVPSVELELQHGXMLRDHGYTPGYSDGWYWTMWXLHMFGILESAQVFKAVKXCNYEYPGA

SEQ ID NO: 18050 - protein, 299 aa, Glycine max
MHASSKMGEKYKPWIIFLHLLVITCSCNRSCRARGLIETEDKFFKATSNDHHETEHAHAHSHVDHIDPSVMVFFTIEDLKVGKTMPIHFPKRDPATSPKLWPREEADSLPFSLNKLPNLLKIFSVSQNSPKAKAMEDTLRECETKPIKGEVKFCATSLESMLDFTQSILGFTSDLKVLSTSHQTKSSVTFQNYTMLENIIEIPASKMVACHTMPYPYTVFYCHSQESENKIYRVPLAGENGDRVDAMVVCHMDTSQWGHGHVSFQVLKVKPGTTSVCHFFPADHLIWVPKLQPQGFATM

SEQ ID NO: 18051 - protein, 119 aa, Brassica napus
KDAWVFSCITCTPEGNAGVCTACCLTCHDGHELLELWTKRNFRCDCGNSKFGTLACKLLPGKDVQNPENSYNHNFKGLYCSCDKPYPDPNGEDHGEMIQCCICDDWFHEEHLARKPSDG

SEQ ID NO: 18052 - protein, 327 aa, Phaseolus vulgaris
MAGGKLHPGSNMSLLLQNDRLPCSSEVLESLWAHTSNAASFQGSKSMVDFENVSGGRVTDRPFFQALEKEDNCDDDYEGCFHQPGKKRRLTSEQVQFLERNFEVENKLEPERKVQLAKELGLQPRQVAIWFQNRRARFKTKQLEKDYGTLKASYDRLKGDYESLLQENDKLKAEVNSLESKLILRDKEKENSDDKSSPDAVNSPHKEPMDLISNSTSENGTKVSLPIMVTCKQEDANSAKSDVLDSDSPHCTDGNHPSSFVEPADSSHAFEPDHSDFSQDEEDNLSESLLTLPCLPKVEEACYDDPPENPCNFGFHVEDQTFCFWPY

SEQ ID NO: 18053 - protein, 186 aa, Brassica napus
  misc_feature (103)..(103): Xaa can be any naturally occurring amino acid
  misc_feature (110)..(110): Xaa can be any naturally occurring amino acid
  misc_feature (131)..(131): Xaa can be any naturally occurring amino acid
MAYSMLSSAAVVTSPAQATMVAPFTGLKSSSAFPVTRKANNDITSIVSNGGRVSCMKVWPPVGKKKFETLSYLPDLTEVELGKEVDYLLRNKWIPLCWNFELXEHGFVYXREHGKHPPDTTDGRYWTMWEXLPCSGCTDSAQVLKEVQECKTEYPNAFIRIIGFDNNRQVQCISFIAYKPPSFTGA

SEQ ID NO: 18054 - protein, 439 aa, Agaricus bisporus
MKPAIRFIILAISISLATADVPVWGQCGGRGWTGETACASGSSCVVQNEWYSQCLPGSTTPTNPPPTTTTSQTTAPPTTSHPVSTGFVKASGTRFTLNGQKYTVVGGNSYWVGLTGLSTSAMNQAFSDIANAGGTTVRTWGFNEVTSPNGNYYQSWSGARPTINTGASGLLNFDNVIAAAKANGIRLIVALTNNWADYGGMDVYVNQMVGNGQPHDLFYTNTAIKDAFKSYVRTFVSRYANEPTVMAWELANEPRCKGSTGTTSGTCTTTTVTNWAKEMSAFIKTIDSNHLVAIGDEGFYNQPGAPTYPYQGSEGVDFEANLAISSVDFATFHSYPEPWGQGADAKAWGTQWITDHAASMKRVNKPVILEEFGVTTNQPDTYAEWFNEVESSGLTGDLIWQAGSHLSTGDTHNDGYAVYPDGPVYPLMKSHASAMKNRA

SEQ ID NO: 18055 - protein, 513 aa, Candida glabrata
MSSDEEDFNDIYGDEHQDQQQTVSNESKPVDSTTAPSTESASVPMDPLAALQALSSNLNNSNNTDNNNDKDTSSGSQTTADGNAVSSEQNGSNVSSEPQVSNQTQNSEQRESIEEANRRQVKADLSRENCKMFIGGLNWETTEDGLREYFSKYGNVVELKIMKDPNTGRSRGFGFLSFDAPSSVDEVVKTQHILDGKVIDPKRAIPREEQDKTGKIFVGGLGTDVRPKEFEEYFSQWGTIIDAQLMLDKDTGRSRGFGFVTYDSPDAAEKVCESRYREFKGKQIEIKRAEPRHQQKQAGQQAVSPPVAGMGMNPMSNPMANPMAGMYQNPMMGGFNPMFNPQAMQDYYQKMQEYYQQLQQQTGMDYSQMFQQQMSMMMPGFQMPPMNADGSGSPLNNAGSENTPSGDDHNGSDNSSSSNVQTIGGDSNDSNSASNERNEDGSNRMKKNSLPKNIPRGPRGPSERNDRGSYHRDRSGGSRHGGYHGSSNGSYRRERGGYNGGRRSNGYHPYNRS

SEQ ID NO: 18056 - protein, 378 aa, Magnetospirillum magnetotacticum
MRGVPAEIAAGSVTLHERRWTPEDLQGAAFAIGAMEDEEDCIAFVAAARAAGAIVNAVDRPHLCDVKFGAIVNRSPLVVGISTEGAAPVFGQTVRARIEAMLPRGFKHWVAAARDWREAVSARFHGFSERRGFWERFTDRAFAEPDRTPTEADLADLLGQAEALPVGGAVTLVGAGPGDAELLTLKALRALRNADVILYDDLVAPEILDYARREARTMLVGKTGHGPSCRQDDINALMVSLAKSGKQVVRLKSGDPLVFGRAGEEIEACEAAGIPCTIVPGVSAAQGAAASLGVSLTHRDAARRLQFVTGHDRRGALPEDLNWGALADRSVTTVVYMPKRTLGALLDRAIAEGLAPETPALVVFNATRAKQATVSGTA

SEQ ID NO: 18057 - protein, 168 aa, Pseudomonas fluorescens
MTTQTETAILAGGCFWGMQDLLRRYPGVLQTRVGYTGGDVPNATYRNHGNHAEAIEIVFDPAVISYRQILEFFFQIHDPSTPNRQGNDLGPSYRSAIYYLNEQQRDIAEDTAADVDASGLWPGRVVTEIEPAGPFWEAEPEHQDYLERIPNGYTCHFIRPNWKLPKRG

SEQ ID NO: 18058 - protein, 99 aa, Nostoc punctiforme
MPTYKVTLINEAEGLNTTLDVEDDTYILDAAEEAGIDLPYSCRAGACSTCAGKLVSGTVDQGDQSFLDDDQIEAGYVLTCVAYPTSNVTIETHKEEELY

SEQ ID NO: 18059 - protein, 312 aa, Unknown
  Synechocystis sp. PCC 6803
MKIASNITELIGRTPLVRLNRIPLLEGCGAKIVVKLEGMNPAASVKDRIGINMINRAEQEGLIEPGKTLLIEPTSGNTGIALAMVAAAKGYQLILTMPETMSQERRAMLKAYGAKLELTPGSEGMGGCIRRAQELAESLPNAYMLQQFDNPANPQIHQQTTALEIWQDTDGAIDFLVAGVGTGGTITGVASVLKEKKPSFQAIAVEPQNSPVLSGGKPGPHKIQGIGAGFIPEVLDVNLIDEVIAVTDEEAIAYGRRLAREEGILSGISTGAALAAAIKVAKRPANKDKLIVMIQPSFGERYLSTPLFQDLE

SEQ ID NO: 18060 - protein, 223 aa, Medicago truncatula
MGRRPARCYRQIKNKPYPKSRFCRGVPDPKIRIYDVGMKKKGVDEFPFCVHLVSWEKENVSSEALEAARIACNKYMSKFAGKDAFHLRVRVHPFHVLRINKMLSCAGADRLQTGMRGAFGKPQGVCARVAIGQVLLSVRCKDNNSHHAQEALRRAKFKFPGRQKIIVSRKWGFTKINRAEYLKLKSENRIMPDGVNAKLLGCHGPLANRQPGRAFLNASCNEA

SEQ ID NO: 18061 - protein, 1030 aa, Photobacterium profundum
MALSDIIQRRDWENPQSVNIHCLKAHSPLASYRDINHARDGIHAQRQSLNGQWKFKLFDAPEQVEGEFIDVQFNDSAWGDITVPSNWQLQGYDKPIYANVKYPFEVNPPYVPADNPTGCYRTRLTLTEADLESTQRIIFDGVNSAFHLWCNGDWVGYSQDSRLPAEFDLSQYLTAGENTLAVMVIRWSDGSYLEDQDMWWLSGIFRDVTLLSKPKQCIEDVFITPDLDACYRDGSLSIVTHISAPETSQVHVQLFDGSQAVTEPSIARPHNRRIDERGSYDDVVFQTLHVREPQQWTAETPNLYRVVVSLLDAEGNHLESEAYQVGFRKVEVKDGQLQLNGKPLLIRGVNRHEHHPELGHVMTEEDMVRDICLMKQYNFNAVRTAHYPNHPRWYELCDQYGLYVCDEANIETHGMIPMNRLSADPQWAHAYMSRYTQMVMRDKNHPSIIIWSLGNESGHGSSHNAMYAWSKQFDPSRPVQYEGGGANTTATDIICPMYARVNTTVEDEAVPKWPIKQWISLPNEQRPLILCEYAHAMGNSLGNFNEYWDAFREFPRLQGGFIWDWVDQGLSQWDNDGKHFWAYGGDFGDTINDRQFCINGLIFPDRTPHPTLEEVKFCQRMITVALTQQDKQQCHLTVTNEYVFRSTDNEQLHWSVLENGVEVQSGQCTLAIDAGSQQTVDIALDFQPKADAKYHLNTDICLISATPWAQAGHVSATEQFTLSNTSSLTLPKISILSAPQLSEQGRDILVSNLDKKHQWQWNVESGLLTSWMVDGQSQLLHAPEDNFFRAPLDNDIGVSEIDNIDPNAWVCRWDAAGIGRWERECVSCTSESLSQAVKVTSTFAYHHNGGVQAITVWTYTLDNQGEMHIDVDVTLADHLPPMPRIGLELALPLPSDNTTVTWQGLGPFENYPDRLAAARFGQHTQSLDAMHTPYIFPTDSGLRSGTQWLNVGNLECTGDFLFSVSRFSQQQLTEAKHTNELTLEDKIYLRIDHQHMGVGGDDSWSPSVHEEFQLTDNTYRFSIMLKPRHN

SEQ ID NO: 18062 - protein, 214 aa, Glycine soja
  misc_feature (173)..(173): Xaa can be any naturally occurring amino acid
NGNNLPTKQAVVDLYKSNRIGKIRLYYPDEGVLQALRGSNIEVILGVPNDQLQSLTNAGAATNWVNKYVKAYSQNVKFKYIAVGNEIHPGDSLAGSVLPALENIQKAISAANLQGQMKVSTAIDTTLLGNSYPPKDGVFSSSASSYIRPIVNFLARNGAPLLANVYPYFAYVXNQQSIGLDYALFTKHGNNEVGYQNLFDALLDSLYAALEKVG

SEQ ID NO: 18063 - protein, 73 aa, Salinibacter ruber
MAKEEAIEKDGEVIEALPNAQFRVRLENGHEILGLLSGKMRMNYIKILPGDRVKVEMSPYDLSKGRIVYRYKN

SEQ ID NO: 18064 - protein, 228 aa, Zea mays
MAAKGGDELKLLGVWNSPYVNRVQIVLNLKGLSYEYVEEDLLSKSELLLKSNPVHKKVPVLIHAGKPVAESQAIIQYLDEAFPGGTFPSVLPADPYARATARFWAAFVDDKVGSPWHTVLFARDHGKKADAASRIVAALETLEGAFKDCSGGRDYFGGGAIGFVDVVLGSYLGWFKVFEKMVGVRVLDVARTPLLAAWGERFAAAEAAKDVLPDDVDKVLEFLQKFLD

SEQ ID NO: 18065 - protein, 204 aa, Glycine soja
VDLYKSNRIGKIRLYYPDEGVLQALRGSNIEVILGVPNDQLQSLTNAGAATNWVNKYVKAYSQNVKFKYIAVGNEIHPGDSLAGSVLPALENIQKAISAANLQGQMKVSTAIDTTLLGNSYPPKDGVFSSSASSYIRPIVNFLARNGAPLLANVYPYFAYVNNQQSIGLDYALFTKHGNNEVGYQNLFDALLDSLYAALEKVGA

SEQ ID NO: 18066 - protein, 605 aa, Oryza sativa
MSALTTSQLATSATGFGIADRSAPSSLLRHGFQGLKPRSPAGGDATSLSVTTSARATPKQQRSVQRGSRRFPSVVVYATGAGMNVVFVGAEMAPWSKTGGLGDVLGGLPPAMAANGHRVMVISPRYDQYKDAWDTSVVAEIKVADRYERVRFFHCYKRGVDRVFIDHPSFLEKVWGKTGEKIYGPDTGVDYKDNQMRFSLLCQAPRILNLNNNPYFKGTYGEDVVFVCNDWHTGPLASYLKNNYQPNGIYRNAKVAFCIHNISYQGRFAFEDYPELNLSERFRSSFDFIDGYDTPVEGRKINWMKAGILEADRVLTVSPYYAEELISGIARGCELDNIMRLTGITGIVNGMDVSEWDPSKDKYITAKYDATTAIEAKALNKEALQAEAGLPVDRKIPLIAFIGRLEEQKGPDVMAAAIPELMQEDVQIVLLGTGKKKFEKLLKSMEEKYPGKVRAVVKFNAPLAHLIMAGADVLAVPSRFEPCGLIQLQGMRYGTPCACASTGGLVDTVIEGKTGFHMGRLSVDCKVVEPSDVKKVAATLKRAIKVVGTPAYEEMVRNCMNQDLSWKGPAKNWENVLLGLGVAGSAPGIEGDEIAPLAKENVAAP

SEQ ID NO: 18067 - protein, 382 aa, Glycine max
MAIDCITSIPMMPQPPTQETTKEQEQQQPLVFDASVLRHQLHIPSQFIWPDEEKACLDEPELFVPFIDLGGFLSGDPVAATEASRLAGEACQKHGFFLVVNHGIDQRLICDAHLYMEHFFGLPLSQKQRAQRKPGEHCGYASSFTGRFSSKLPWKETLSFQYSADKNSSPALVKDYLCSKMGKEFEQFGKVYQDYCDAMSNLSLGIMELLGMSLGVGRACFREFFEENSSIMRLNYYPPCQKPDLTLGTGPHCDPTSLTILHQDQVGGLQVCVDNEWHSIKPDLNAFVVNVGDTFMALSNGRYKSCLHRAVVNSQTTRKSLAFFLCPRSDKVVSPPCELVDNLSPRLYPDFTWPMLLEFTQKHYRADMKTLEAFANWLRKSN

SEQ ID NO: 18068 - protein, 340 aa, Bacillus cereus
MTKITVVGAGSWGTALAMVLADNGHDVRIWGNRSELMDEINTKHENSRYLPGITLPSTIVAYSSLEEALVDVNVVLLVVPTKAYREVLQDMKKYVAGPTTWIHASKGIEPGTSKRISEVIEEEIPEDLIKDVVVLSGPSHAEEVGLRQATTVTSAAKRMEAAEEVQDLFMNSYFRVYTNPDIVGVELGGALKNIIALAAGITDGLGLGDNAKAALMTRGLTEIARLGRKMGGNPLTFAGLTGMGDLIVTCTSVHSRNWRAGNLLGKGHSLEEVLESMGMVVEGVRTTKAAHELAEKMEVEMPITAALYDVLFNGNNVKDAVGSLMGRVRKHEVEAIPDLL

SEQ ID NO: 18069 - protein, 215 aa, Glycine soja
NGNNLPTKQAVVDLYKSNRIGKIRLYYPDEGVLQALRGSNIEVILGVPNDQLQSLTNAGAATNWVNKYVKAYSQNVKFKYIAVGNEIHPGDSLAGSVLPALENIQKAISAANLQGQMKVSTAIDTTLLGNSYPPKDGVFSSSASSYIRPIVNFLARNGAPLLANVYPYFAYVNNQQSIGLDYALFTKHGNNEVGYQNLFDALLDSLYAALEKVGA

SEQ ID NO: 18070 - protein, 605 aa, Oryza sativa
MSALTTSQLATSATGFGIADRSAPSSLLRHGFQGLKPRSPAGGDATSLSVTTSARATPKQQRSVQRGSRRFPSVVVYATGAGMNVVFVGAEMAPWSKTGGLGDVLGGLPPAMAANGHRVMVISPRYDQYKDAWDTSVVAEIKVADRYERVRFFHCYKRGVDRVFIDHPSFLEKVWGKTGEKIYGPDTGVDYKDNQMRFSLLCQAPRILNLNNNPYFKGTSGEDVVFVCNDWHTGPLASYLKNNYQPNGIYRNAKVAFCIHNISYQGRFAFEDYPELNLSERFRSSFDFIDGYDTPVEGRKINWMKAGILEADRVLTVSPYYAEELISGIARGCELDNIMRLTGITGIVNGMDVSEWDPSKDKYITAKYDATTAIEAKALNKEALQAEAGLPVDRKIPLIAFIGRLEEQKGPDVMAAAIPELMQEDVQIVLLGTGKKKFEKLLKSMEEKYPGKVRAVVKFNAPLAHLIMAGADVLAVPSRFEPCGLIQLQGMRYGTPCACASTGGLVDTVIEGKTGFHMGRLSVDCKVVEPSDVKKVAATLKRAIKVVGTPAYEEMVRNCMNQDLSWKGPAKNWENVLLGLGVAGSAPGIEGDEIAPLAKENVAAP

SEQ ID NO: 18071 - protein, 427 aa, Yarrowia lipolytica
MLRSIRRYSTKSPFAKVGSKTQSYDYLRALRVTPAETFADVPLSPELEQELSTKFQEFQKALKAGEKLEQVKEIARQARGTKNAAAGGDPQADLSSLMGRIDSKNIRVGNDQSKIAAIFPLLKRTARDEEYTKQELFLRRQHRHDMLSKLGAEVKGVYDPLHIIKHPKSGTEATVTSLLAAGAHLGHAVELGHVNNQPFIYGVRDGISIIDLEQTVTQLRRAARITEAVAKQNGLILFVGTRDGQKLALEAMSRRCGASYVHSKWIPGAITNFSNIAANWKRYEVVDGESGTSFADINQHTGREFDAEISGPNMRPDLVIILNPDENPALIRECLKSCIPTVGVADTNFNPSKLSYPIAANDDSLRTTDLITGVLARAAEKGHKLRRFEEQQRRNAELLHMKKNLVQAADENDVTEDPFSSGEAHKE

SEQ ID NO: 18072 - protein, 486 aa, Saccharomyces cerevisiae
MVHLGPKKPQARKGSMADVPKELMDEIHQLEDMFTVDSETLRKVVKHFIDELNKGLTKKGVNIPMIPGWVMEFPTGKESGNYLAIDLGGTNLRVVLVKLSGNRTFDTTQSKYKLPHDMRTTKHQEELWSFIADSLKDFMVEQELLNTKDTLPLGFTFSYPASQNKINEGILQRWTKGFDIPNVEGHDVVPLLQKEISKRELPIEIVALINDTVGTLIASYYTDPETKMGVIFGTGVNGAFYDVCSDIEKLEGKLADDIPSNSPMAINCEYGSFDNEHLVLPRTKYDVAVDEQSPRPGQQAFEKMTSGYYLGELLRLVLLELNEKGLMLKDQDLSKLKQPYIMDTSYPARIEDDPFENLEDTDDMFQKDFGVKTTLPERKLIRRLCELIGTRAARLAVCGIAAICQKRGYKTGHIAADGSVYNKYPGFKEAAAKGLRDIYGWTGENASKDPITIVPAEDGSGAGAAVIAALSEKRIAEGKVSGIIGA

SEQ ID NO: 18073 - protein, 347 aa, Bacteroides fragilis
MSENKKKIIFIVNPISGTQSKELVLSLLDEKIDKEMYTWEVVYTERAGHAIEIAADAADKNTDIVVAVGGDGTINEIARSLVHTNTALGIIPCGSGNGLARHLQISMDPRKALEILNDGIIDIIDYGKINGTDFFCTCGVGFDAFVSLKFANAGKRGLLTYLEKTLQESLKYQPETYELETEDGTSKYKAFLIACGNASQYGNNAYIAPQATLTDGLLDVTILEPFTVLDVPALAFQLFNKTIDQNSRIKTFRCKKLCIHRSSPGVVHFDGDPMQADEDIKIELIQKGLRVVVPGDKKKDNPNVLQKAQEYVNGIKLINEAIVEDIAHKNKVILKKNKQLIQKLTKK

SEQ ID NO: 18074 - protein, 486 aa, Saccharomyces cerevisiae
MVHLGPKKPQARKGSMADVPKELMQQIEIFEKIFTVPTETLQAVTKHFISELEKGLSKKGVNIPMIPGWVMDFPTGKESGDFLAIDLGGTNLRVVLVKLGGDRTFDTTQSKYRLPDAMRTTQNPDELWEFIADSLKAFIDEQFPQGISEPIPLGFTFSFPASQNKINEGILQRWTKGFDIPNIENHDVVPMLQKQISKRNIPIEVVALINDTTGTLVASYYTDPETKMGVIFGTGVNGAYYDVCSDIEKLQGKLSDDIPPSAPMAINCEYGSFDNEHVVLPRTKYDITIDEESPRPGQQTFEKMSSGYYLGEILRLALMDMYKQGFIFKNQDLSKFDKPFVMDTSYPARIEEDPFENLEDTDDLFQNEFGINTTVQERKLIRRLSELIGARAARLSVCGIAAICQKRGYKTGHIAADGSVYNRYPGFKEKAANALKDIYGWTQTSLDDYPIKIVPAEDGSGAGAAVIAALAQKRIAEGKSVGIIGA

SEQ ID NO: 18075 - protein, 367 aa, Yarrowia lipolytica
MFIGGLNWETTDESLTNYFAQFGEVLECTVMRDHFSGKSRGFGFLTFRDPKCVNAVMAKEHYLDGKIIDPKRAIPREEQDKTSKIFVGGVGSDVTEEDYKQFFEQYGTVIDAQLMIDKDSGRPRGFGFVTFDSEQAMNTILAQPLLILKDKPIEVKRAENRSKGAGASAVANAVAGPSHGGGNHNYNNNHSHGGTADAAAAPAQNSYGGMTPQAMTQWWQQYMQYMQQVQQMQGGAAADPEAQQAMMAQMMAQMQQQQQPQGQSHQQRDNHHQQSRERDHHNDESSDDNEMRRVDRGRDDRSGRRGRGYNQSDRRSRSPGVPTGPRDGRQRGRRHGGGRGRDRRDGGRAPGYHPYGGSRDRQQGRRD

SEQ ID NO: 18076 - protein, 547 aa, Aspergillus oryzae
MSASLTKVLHRMQELFSNVVAALEAMLLFPSLFRDSSGKRKSFHRASWRRRTLDDLADEIDHVFTAPLSLQNMAMMSEKIREQLRICLQSSPVSMLPSYNHALPSGTEKGTFLALDVGGSTFRVALIELRGNGDMEILRVNSSPIDEQVKLLEGTLFFDWMAEKIDSMLSEVGAQYGRELAPLSMGLSWSFPVEQTSINSGLVIQMGKGFLCSNGTVGQELGDLIVQSCRKRSLNLQMGAIVNDSSATLLSRAYVDPKTRMSLILGTGTNMAIHFPVHAIGLTKFGTRPVGWFDYAKHVIINSELSMFGGKVLPMSRWDDVINRTHLRPDYQPLEYMITGRYLGEILRLIIVEAVETAQLFGGELPRSMRDAYSFDTSIVAAIEADTSSSFSSSAALLQKEHTFHRAPTVDDLKFLRRVCEIVSNRSAGYLATAIHSMWSLRNEAEFPEVTASATSSIKETQEVTVVESEHSQSLTIACDGSVINKYPGFRDRCQGYINQLLQETNASKGTLEATPSPSVRLDPAPESGILGAAVAVAVAVAEKTSA

SEQ ID NO: 18077 - protein, 306 aa, Streptococcus pneumoniae
MSIYNNITELIGQTPIVKLNNIVPEGAADVYIKLEAFNPGSSVKDRIALSMIEKAEQDGILKLGSTIVEATSGNTGIGLSWVGAAKGYKVVIVMPETMSVERRKIIQAYGAELVLTPGSEGMKGAIAKAQEIAAERDGFLPLQFDNPANPEVHERTTGAEILAAFGKDGLDAFVAGVGTGGTISGVSHALKSENSNIQVFAVEADESAILSGEKPGPHKIQGISAGFIPDTLDTKAYDGIVRVTSDDALALGREIGGKEGFLVGISSAAAIYGAIEVAKKLGTGKKVLALAPDNGERYLSTALYEL

SEQ ID NO: 18078 - protein, 298 aa, Bacillus cereus
MKLGLIGLGKMGFPLAEHLYEDKHEVVVYDVNKELVEKAGALGITARHTLKEMIAELEAPRTIWVMVPAGEVVESVLKDVYPLLEEGDIVIEGGNSFYKDTLRRAEEAKSFGLHYVDIGTSGGVEGARYGACLMVGGEKEIYDQLEPLFKDLAVENGYSYAGRVGSGHFLKMVHNGIEYGMMQAIAEGFEVLDKSDFDFNYEDVAKVWANGSVIRGWLMDLTEKAFAEDPKLDGIKGVMNSSGEGKWTVETALELQAAAPVIAMSLFMRYRSQEDDTFHGKVVSALRNQFGGHEVVKK

SEQ ID NO: 18079 - protein, 224 aa, Phaseolus vulgaris
EQMPEKKHRLSSEQVHLLEKSFEEENKLEPERKTQLAKKLGLQPRQVAVWFQNRRARWKTKQLERDFDVLKSSYDTLLSSYDSLMKDNEKLKSEVVSLNEKLQDQAKEVPEEPFYDKKVDPLPVEDIATIFSTRVEDHQSSGSVGSAVVDEGSPQLVVDSVDSYLPADNPGGCVGPVERIQSEEEDGSDDGRSYMDVFVVSETENQNHEEGEALVWWTNMYYVE

SEQ ID NO: 18080 - protein, 407 aa, Medicago truncatula
MSNSYLTCSFLSSIFVLSLIFIFIKRKKTRYNLPPGKMGWPFIGETIGYLKPYTATTMGEFMENHIARYGTIYKSNLFGGPAIVSADAELNRFILQNDGKLFECSYPKSIGGILGKWSMLVLVGDMHREMRNISLNFMSYARLKTHFLKDMEKHTLFVLSSWKENCTFSAQDEAKKFTFNLMAKQIMSLDPGNLETEQLKKEYVCFMKGVVSAPLNLPGTAYRKALKSRNNILKFIEGKMEERVKRNQEGKKGMEENDLLNWVLKHSNLSTEQILDLILSLLFAGHETSSVAIALAIYFLPSCPQAIQQLREEHREIARSKKKAGEVELTWDDYKRMEFTHCVVNETLRLGNVVRFLHRKAIKDVHYKGYDIPCGWKVLPVISAVHLDPSNFDQPQHFNPWRWQAGV

SEQ ID NO: 18081 - protein, 109 aa, Salmonella typhi
NYPKEIKAFYMRLNEDGKTVAAMDVLAPGIGEIIGGSQREERLDVLDARMAEMGLNKEDYWWYSDLRRYGTVPHSGFGLGFERLIAYVTGVQNVRDVIPFPRTPRNASF

SEQ ID NO: 18082 - protein, 240 aa, Glycine max
MKTPISGFYRNPVKFRMPTAENLVPIRLDIEIEGQRYKDAFTWNPSDPDSEVVVFAKRTVKDLKLPPAFVTQIAQSIQSQLSEFRSYEGQDMYAGEKIVPIKLDLRVNHTLVKDQFLWDLNNFESDPEEFARIFCKDTGIEDPEVGPAIAFAIREQLYEIAIQSVVSARESRMSKKGRRGAEYTPVSKGGAAAVDLVKLFGPKSSVVRKRKEWDVYEPIVDLLSNEEVDALEAKEERNFR

SEQ ID NO: 18083 - protein, 207 aa, Vicia faba
DYLFKVVLIGDSGVGKSNLLSRFTKNEFSLESKSTIGVEFATRSIRVDDKVVKAQIWDTAGQERYRAITSAYYRGAVGALLVYDVTRHVTFENVERWLKELRDHTDANIVVMLVGNKADLRHLRAVSTEDSTAFAERENTFFMETSALESLNVESAFTEVLTQIYRVVSKKALEIGDDPAALPKGQTINVGSRDDVSAVKKGGCCSA

SEQ ID NO: 18084 - protein, 368 aa, Acidobacteria bacterium
MSDIKKIAINTGGGDAPGLNAVIHGAVYAARRLGWEVFGIRDGYDGILEPHRYPNGGLIQLNRGVVRDISHVGGTILGTTNRGNPFRRVITAADGTKHETDCSDQILNFFRDRGIDALISIGGDGSLTIANGLAKKGLRVVGVPKTIDNDLESTAMTFGFNTAVSFATECIDRLHSTALSHQRILVVEVMGRYAGWIALHCGVAGRADAILIPEIPYKIENVANALKLRHQDGKPYSIVVVAEGAKAHGKDVTIREREVGKAERLGGIGEQVTQQLQSLTGKESRTVVLGHLLRGGSPTALDRNLGVTFGAGAVEALAEGRSTVMVALHPPHLAFVPLEEAIAKLRLVPPDSDLVLTARAIGIAFGDE

SEQ ID NO: 18085 - protein, 331 aa, Aspergillus nidulans
MSGTVVITGANGSLALGFVESFLALYSQHTLIATVRNPSPERDPNTAKLVHLISRYPSAHVLVEGLDLGSLAAVRSFADSLAARISTKELPPILAIVCNAFTWSLESGQKFTADGFEATFQVGHLAHYLLVLKLIESMDPRAGRVVMLGSTTHYPDKPNPLSSLRPGIPQDIEELVKPRPDPPHLVHDRGFQRYGTAKLANVIFMEDLNQRLRQIPKLSTITATAMDPGGLVESRAQSGQKASVQRLFAAIKLLMPILKHITTTFRTNKDAGRDLLALSLDPAFQGKRGYYVGQKEEAAASVTGDAAVQRRLWEACWQWAGLAPEETVLCR

SEQ ID NO: 18086 - protein, 883 aa, Desulfotalea psychrophila
MTVKNDGSEAQSKKSEGNEAKSKLKIKASTGAWWKSKVETEAKAPVAAKKVSSQVKTPSPEAVQPTKPAKPAQAAKPVKAAKPAKAAEAAQTAKPAKPAKPAKAAETAKPAKAAKPAKVAESAKPAKPAKPAKPAKSAGATKVAEPAKPAKTTKPAKAVEVAEKVVGGAVEQKAPVAKESAPKPPARKKRATRPARPVAKASSEEAKVASEPAKKAVEAKSGEKPVQDVEKAPVSSAESPAPESEVAPKKRPARRRSRSNKKTSARPETDSVAEKAPMDPAPVSEKAVAAEASSGEEKDEKASKGPNRRRSRRPRKRRPATDEQEAVAKDAPVATAEVAAQVAPQVAPQVADDDFGSGSRKAKRDDDIVFTGLEKSKNVRLLINAEEPEECRLALLEDGRLESIHVSTVTRAQTKNNIYKAKVVAVEANLQAAFVDYGTVKNGFLPFSEIHPEYYRADLSESARKNVEERRWRRLKIEDVMARGQELLVQVVKEEVGKKGANMTTYLSLPGRCVVLMPGSDSAGISRKIVGEERRSQLRDTMRSLGIPEGTGWIVRTASVDINEEALARDVTYLLKLWEDVREKGQEIKDVGLIYEDHRSVMRFLREHYDPSIQEILVDAPLALEQVNEFVSMLPANQQNVKVRLHKGSRPIFNQFSVEDQIESIYQPQVSLPSGGSIVIDPTEALVAIDVNSGSTSKGKNFDESIFQANMEAASEFARQLRLRDLGGLVVVDFIDMRNKKHINAVEKQVKIAMKRDKAKVDFTRISKFGLMQISRQKLGSPIEAGAYRVCQHCKGRGIVRAVETLALFYLRRIQTGASRKPVVKIECHFPLDVASYLLNNKRQEITEMENNNEVEIMIVVESRFKPAENEIVFHRAEKEKEV

SEQ ID NO: 18087 - protein, 112 aa, Archaeoglobus fulgidus
MKKIEAIVRAEKFPEVKAALEERGFYGMTVTDVKGRGQQGGMQIQFRGRTMEVTLLPKVKLEIVVKDDAVEEVIGLIVNSAFTGSPGDGKIFIIPVEDVVRIRTGERGDDSL

SEQ ID NO: 18088 - protein, 398 aa, Unknown
  Erythrobacter sp. NAP1
MISKVSAALKDFLKQESAGGIVLIAAAALALLIANSPLAPFYFGTLETKLNVSFGDFAINKGLILWINDGLMAIFFFLIGLEVKREIINGQLSSWDKASLPLAAAIGGMGIPAAIYVAFNWNSPESIGGWAIPAATDIAFALGILSLLGPRVPVAMKALLLAIAVIDDIGAITVIALFYTGEIKTDMLIGGGVMLALLFALGRARIASVIPYVLFTVIMWVFILKSGVHATLAGVTAAMMVPMVARDGSHLLEHMEHALHKWVAFVIIPIFGFANAGVTLIGLSPADLLQPLPLGIALGLLIGKQIGIVGFAWVAVKAGFAKLPEGVGWRKIHGLSLLAAIGFTMSLFIGNLAFEDQAQVDAVKLGVLSGSLIAAFAGYFMLKAALPDEPAPEDEEIE

SEQ ID NO: 18089 - protein, 120 aa, Archaeoglobus fulgidus
MRRLPTREVVDMKMVVAVIRPEKLECVKKALEERGFVGMTVTEVKGRGEQKGIRLQFRGREVEVDLLQKTKVEVVVSDDAVDEVVEAIVSSARTGKFGDGRIFVIPVEKSVKIRTGDEEV

SEQ ID NO: 18090 - protein, 773 aa, Arabidopsis thaliana
MVKEIASWLLILSMVVFVSPVLAINGGGYPRCNCEDEGNSFWSTENILETQRVSDFLIAVAYFSIPIELLYFVSCSNVPFKWVLFEFIAFIVLCGMTHLLHGWTYSAHPFRLMMAFTVFKMLTALVSCATAITLITLIPLLLKVKVREFMLKKKAHELGREVGLILIKKETGFHVRMLTQEIRKSLDRHTILYTTLVELSKTLGLQNCAVWMPNDGGTEMDLTHELRGRGGYGGCSVSMEDLDVVRIRESDEVNVLSVDSSIARASGGGGDVSEIGAVAAIRMPMLRVSDFNGELSYAILVCVLPGGTPRDWTYQEIEIVKVVADQVTVALDHAAVLEESQLMREKLAEQNRALQMAKRDALRASQARNAFQKTMSEGMRRPMHSILGLLSMIQDEKLSDEQKMIVDTMVKTGNVMSNLVGDSMDVPDGRFGTEMKPFSLHRTIHEAACMARCLCLCNGIRFLVDAEKSLPDNVVGDERRVFQVILHIVGSLVKPRKRQEGSSLMFKVLKERGSLDRSDHRWAAWRSPASSADGDVYIRFEMNVENDDSSSQSFASVSSRDQEVGDVRFSGGYGLGQDLSFGVCKKVVQLIHGNISVVPGSDGSPETMSLLLRFRRRPSISVHGSSESPAPDHHAHPHSNSLLRGLQVLLVDTNDSNRAVTRKLLEKLGCDVTAVSSGFDCLTAIAPGSSSPSTSFQVVVLDLQMAEMDGYEVAMRIRSRSWPLIVATTVSLDEEMWDKCAQIGINGVVRKPVVLRAMESELRRVLLQADQLL

SEQ ID NO: 18091 - protein, 615 aa, Zea mays
  misc_feature (282)..(282): Xaa can be any naturally occurring amino acid
  misc_feature (311)..(311): Xaa can be any naturally occurring amino acid
  misc_feature (402)..(402): Xaa can be any naturally occurring amino acid
  misc_feature (418)..(418): Xaa can be any naturally occurring amino acid
  misc_feature (508)..(508): Xaa can be any naturally occurring amino acid
MQRSRRALLRRTAAAQEQSAVAEAAANGRRRRLYGFSASLVVASWVAVLLLHSLVGHGDGQRDGGGSTVDLTVVEPAVNVGPINPVVQEEHGEDLEMPGDTCVNSDENAVLSEDTLVQADQLCSSDEVQNENTEAVTIDSQVELSGDQGGYLPQSGVDSGVQPGEKVESKDLPRPPRLSRVAPPDLDEFKTRAIAERGPGISSQPGNIIHRREPSGKLYNYAAASKGAKVLDVKKVDAGPFNILDKDKDKYLRNACSAEGKFVIIELSEETPVSTLAIGNFXQNSYSSKSFSVRCPIPCRTGGCGILARMXVVAGGIGRNFIHLEPMCLRRLNMCLVGEYRCGFYCGQRKEEVYGRHVCVQRLDILIPVENSTTDPEGKIKEAIEQIPVKESVGGKHNSQDXEDYSSNPKEFELLRNXHIPKNGANDPVSETRTLQAGRIPGDTVLKVLMQKVQSLDVSFSVLERYLVELNNRYAQIFKDFDSDIDSKDALLEKIKTELKNLESSKDXSIMNEIEGIISWKVVASSQLNQLVLDNALLRSEFETFRQKQADMENRSLAVIFLSFVFACLALAKLSIGIMSRFCRFYDFEKFHNVRSGWLVLLLSSCIISTILIIQ

SEQ ID NO: 18092 - protein, 536 aa, Aspergillus niger
MPSFSQATELSAWKELQEHHNSVGRNIVLKDCFQKDPQRFEKFSRTFKNTVDNSEVLFDFSKNFLTEETLALLVKLAKEANVEELRDAMFKGEHINFTEDRAVYHAALRNVSNEPMQVNGKSVVEDVNAVLEHMKEFTEQVRSGEWKGYTGKKIDTVINIGIGGSDLGPVMVTEALKPYGAPDMKLHFVSNIDGTHIAEALKNSNPETTLFLIASWFLETAKEDSHIAKHFVALSTNEEEVTKFGIDKKNMFGFESWVGGRYSVWSAIGLSVALYIGYDNFHQFLAGAHAMDKHFREAPLEQNIPVLGGLLSVWYSDFFGAQTHLVAPFDQYLHRFPAYLQQLSMESNGKAITRTGEYVKYTTGPILFGEPATNAQHSFFQLLHQGTKLIPSDFIMAAESHNPVEGGKHQRMLASNFLAQSEALMVGKTPEQVKAEGAPENLVSHKTFLGNRPTTSILAQKITPSTLGALITYYEHLTFTEGAIWNINSFDQWGVELGKVLAKKIQKELETADAGSDHDASTSGLLLAFKKKANLA

SEQ ID NO: 18093 - protein, 1102 aa, Rhodobacter sphaeroides
MNQNVSPSTVAVRRTDGIDRSQTDWYKDAIIYQLHIKAFQDANGDGIGDFAGLMQRLDYVQALGVTAIWLLPFYPSPLRDDGYDISDYRSINPSYGAMRDFKLFVQEAHKRGLRVITELVINHTSDQHPWFQRARRAKKGSAARDWYVWSDTDQKFPETRIIFLDTEKSNWTWDPVAGAYYWHRFYSHQPDLNFDNPRVLEEVLKIMRMWLEMGVDGLRLDAIPYLVEREGTNNENLPETHDVLKKIRANLDQHFPDRMLLAEANQWPEDTRPYFGEGDECHMGFHFPLMPRMYMALAQADRHPITDIIRQTPEIPEGCQWGIFLRNHDELTLEMVTAEERDYMWRFYAEDSRARINLGIRRRLAPLMKNDRRKIELLNQMLMSMPGTPIVYYGDEIGMGDNYYLGDRDGVRTPMQWSADRNGGFSRCNPQQLYLPTILDPVYGHQAINVEAQAADPSSLLNWTRRLIAVRKQHPAFGRGSMSLLYPRNRKVLAYVRSHEGTDILCVANLSDTAQAVELDLARFRGAVPVELTGRSEFPPVGDLPYMLTLPPYGFYWFILSDQQALPSWHQPMPETLPDFITLTTRDGRAETALTGRETRQFEADVLPNWLPLQRWFGAKEEKISAVKLAVLGSLSADHALVRLDADVGGEAQQYFLPASALWGEEQLRAGAPKLSFTLAKVRRGPQVGALIDGAYDEQMAQAMLEALREGRRLSGAGGEVVFEPGSGLAEIADPGEPRYLGAEQSNISIAFGDRLILKLYRRLRAGEQPDVEVARFLTEVAGYTHTPRYLGVVSLRPAEGEATVLAAAFAFVANMGDAWRGLFDALVRDLGEFGGWSTAEAPEVEKEGFSFPLTIPGLLGQRTAELHQAFATETDEAAFRMEPLRAEHLTGWAEGARREAETMLSVLERQRTHLPEEVLPLAEALLARRDDLLARLDRVTGFEPSGALTRIHGDYHLGQVLLAQDDVAIIDFEGEPRRTLEERREKSSPLRDVAGMLRSFDYAAAAALARHEESFGPASERAVERAEAWRQQAVADFLSAYEGASAGTASLPSDPALKEALLDLFLVQKAVYETSYELGSRPAWVGIPLRGLLELLDRTPA

SEQ ID NO: 18094 - protein, 64 aa, Chromobacterium violaceum
MQGEVLENLPSATFKIKLENGHVVLGHISGKMRMHYIRILPGDKVTVELTPYDLSRARIVFRAK

SEQ ID NO: 18095 - protein, 491 aa, Aspergillus niger
MADQAVADFGLIGLAVMGQNLILNAADHGFTVCAYNRTTSKVDRFLENEAKGKPIVGAHSVEEFCAKLKRPRRIMLLVMAGKPVDQFIESLLPHLEKGDIIIDGGNSHFPDSNRRTKYLAEKGIRFVGSGVSGGEEGARYGPSLMPGGNEEAWPYIKDVFQSISAKSDGEACCDWVGDEGAGHFVKMVHNGIEYGDMQLICEAYDILKRGLGLPAKEIADVFAKWNKGVLDSFLIEITRDVLYFNDNDGTPLVEKILDKAGQKGTGKWTAINALDLGMPVTLIGEAVFSRCLSALKDERIRASSLLDGPTPEFTGDKQAFIDDLEQALYASKIISYAQGFMLIQEAAREYGWKLNKPSIALMWRGGCIIRSVFLKDITNAYRKNPDLENLLFDEFFNTAIKKAQSGWRNVVSKGALWGIPTPAFSTALSFYDGYRTRDLPANLLQAQRDYFGAHTFRIKPEHANETYPEGKDIHVNWTGRGGNVSASTYIA

SEQ ID NO: 18096 - protein, 479 aa, Glycine max
MNPDQFQKNSMFVETPEDGGKNFDDDGRVKRTGTWITASAHIITAVIGSGVLSLAWAIAQMGWVAGPAVLFAFSFITYFTSTLLADCYRSPDPVHGKRNYTYSDVVRSVLGGRKFQLCGLAQYINLVGVTIGYTITASISMVAVKRSNCFHKHGHHDKCYTSNNPFMILFACIQIVLSQIPNFHKLWWLSIVAAVMSFAYSSIGLGLSVAKVAGGGEPVRTTLTGVQVGVDVTGSEKVWRTFQAIGDIAFAYAYSNVLIEIQDTLKSSPPENKVMKRASLIGILTTTLFYVLCGCLGYAAFGNDAPGNFLTGFGFYEPFWLIDFANICIAVHLVGAYQVFCQPIFGFVENWGKERWPNSHFVNGEHALKFSLFGTFPVNFFRVVWRTTYVIITALIAMMFPFFNDFLGLIGSLSFWPLTVYFPIEMYIKQSKMQKFSFTWTWLKILSWACLIVSIISAAGSIQGLAQDLKKYQPFKAQQ

SEQ ID NO: 18097 - protein, 103 aa, Zea mays
  misc_feature (18)..(18): Xaa can be any naturally occurring amino acid
  misc_feature (44)..(44): Xaa can be any naturally occurring amino acid
CNLPGLVHPTFITNGILXPRPSNLMGLTAAVEATVSFLDKAVKXKLVMVAGPKIRVAKAVDAFVELAEASGYTVAAMLSPNELANTNNLVVALFLLPFPVNLM

SEQ ID NO: 18098 - protein, 412 aa, Pseudomonas fluorescens
MSLQNFDPAIARLIDRERNRQETHLELIASENYVSEEVLQAQGSLLTNKYAEGYPGRRYYGGCKVVDEIENLAIERARKLFGCEYVNVQPHSGSQANQAVFLAVLEPGDRILGMSLAHGGHLTHGASVNFSGKFFQAFTYGLEKDSETLDYDQMEDLAREHRPKMIIAGASAYSRVIDFPRFRKICDEIGAYLMVDMAHYAGLIAAGVYPSPVGIADFITSTTHKTLRGPRGGLILAKAEYAAVLDKTIFPVYQGGPLMHVIAAKAVAFNEALGDEFKHYQQRVINNARTMADVLTRRGLRVVSGGTDCHMFLLDLRAMNITGKDAEALLESAHITLNKNAIPDDPQKPAITSGIRIGTPALTTRGFGEAECAEVANLIADLLEQPDNTARVENIRRRVMHLCECFPVYLLT

SEQ ID NO: 18099 - protein, 294 aa, Bacteroides fragilis
MRKIKVGIIQQANTSDIRINLMNLAKSIEACAANGAQLVVLQELHNSLYFCQTENTDLFELAEPIPGPSTGFYSELAAANRIVLVTSLFEKRAPGLYHNTAVVFDRDGSIAGKYRKMHIPDDPAYYEKFYFTPGDIGFEPIQTSLGKLGVLVCWDQWYPEAARLMALKGAEILIYPTAIGWESTDTDDEKKRQLNAWIISQRAHAVANGLPVISVNRVGHEPDPSGQTNGILFWGNSFVAGPQGEYLAQAGNDRSENMIVEVDLERSENVRRWWPFLRDRRIDEYGNLTKRFID

SEQ ID NO: 18100 - protein, 273 aa, Unknown
  Candidatus Kuenenia stuttgartiensis
MLLVPQLKYLSLLNSCSATNLVALQRTIFRFKRLKCYPFFSTIFTRCQTVKFVAFGSLISLSYIILLQHPQHINTSYMKKRIAKIERKTKETQIELVLNIDGEGICNVSTGIGFLDHMLELLTKHALFNLDITAHGDIQVDGHHTVEDIGICLGLGIKEALGDKKGIRRFSNASIPMQETLANVAIDISGRSALVFNANFHNEKIGNFDVELIREFLEAFTTNAGVNLHINISYGTNSHHMAEAVFKGMAKVLCEAVRLDERITGIPSTKGVL

SEQ ID NO: 18101 - protein, 605 aa, Oryza sativa
  misc_feature (141)..(142): Xaa can be any naturally occurring amino acid
MSALTTSQLATSATGFGIADRSAPSSLLRHGFQGLKPRSPAGGDATSLSVTTSARATPKQQRSVQRGSRRFPSVVVYATGAGMNVVFVGAEMAPWSKTGGLGDVLGGLPPAMAANGHRVMVISPRYDQYKDAWDTSVVAEXXVADRYERVRFFHCYKRGVDRVFIDHPSFLEKVWGKTGEKIYGPDTGVDYKDNQMRFSLLCQAPRILNLNNNPYFKGTSGEDVVFVCNDWHTGPLASYLKNNYQPNGIYRNAKVAFCIHNISYQGRFAFEDYPELNLSERFRSSFDFIDGYDTPVEGRKINWMKAGILEADRVLTVSPYYAEELISGIARGCELDNIMRLTGITGIVNGMDVSEWDPSKDKYITAKYDATTAIEAKALNKEALQAEAGLPVDRKIPLIAFIGRLEEQKGPDVMAAAIPELMQEDVQIVLLGTGKKKFEKLLKSMEEKYPGKVRAVVKFNAPLAHLIMAGADVLAVPSRFEPCGLIQLQGMRYGTPCACASTGGLVDTVIEGKTGFHMGRLSVDCKVVEPSDVKKVAATLKRAIKVVGTPAYEEMVRNCMNQDLSWKGPAKNWENVLLGLGVAGSAPGIEGDEIAPLAKENVAAP

SEQ ID NO: 18102 - protein, 809 aa, Fusobacterium nucleatum
MKKVLIVGGVAGGASTAARLRRLDENLEIIMFERGEYVSFANCGLPYHIGGVIQNRESLLIQTPESLKARFNLDVRVNSEVVGVNGKDKKVKVKTKNGEEYEENFDFLVLAPGAKSILPVVKGIENKKIFTLRNINDMDKIKAEIKNYNVKKATVVGGGYVGIETAENLKHLGIDTTLIEAVPHILASFDSEISNILEYELINNGINLLTSEKVIEFQEDKDEVIIKLESGKSVAADMVILSIGVNPDTKFLQNSGINLGERGHILVNEKLETNIDGIYALGDSIIVKNYITNQDVAIPLAGPANRQGRIVAGNIVGRNEKYKGSLGTAIIKIFELTGASTGLNERSLKQLNIPYEKVYLHPNNHATYYPGATAISIKALYNKENRQILGAQAVGISGVDKFIDVIAISIKFKATIDDLTELELAYAPPFLSAKSPANMLGFIGQNIEDNLLEQVFMKDLENYNEKETIILDVREKLELISGKLNNSINIPLSELRKRYAELPKDKEIWTYCAVGLRGYIASRFLTQKGYKVKNLAGGIKIEEKELIKTQEETFSNKENSDYNVDKEDEYLDLSGLSCPGPLVKIKEKIDKLQESKKLKVKVSDPGFYNDIQAWSKVTKNSLLSLDKKDGLTYATLQKEQASKVVVKEQENVIIEDNSNMTMVVFSGDLDKAIAAFIIANGALTMGKKVTMFFTFWGLSILKEQDLAKKSLLKNIAMMLPKNSQDLPVSKMNFFGIGAKMIRSVMKKKNIMSLEELMKKAKDLGVNITACTMSMDVMGISKEELIDGISYGGVGQYLGEAEKSNNNLFI

SEQ ID NO: 18103 - protein, 420 aa, Unknown
  Frankia sp. CcI3
MHQPPIPHLAVADPELAGLVEAEATRQFSSIRLIASENYVSTAVLEASGSVLTNKYSEGYVGRRYYEGQQVIDPIETLAVDRAKALFGVEHANVQPYSGSPANLAVYLAFAEPGDTVMGLSLPMGGHLTHGWSVSATGTWFRSVRYGVRADTGRIDLDEVRDLALAERPRIIFCGGTAIPRTIDFPGFAAIAREVGAVLVADIAHIAGLIAGGAHPSPVGHAPVISTTTHKTLRGPRGAMLLSDAEHATAIDKAVFPGLQGGPHNHTTAAIAVALREAAAPAFRDYAHAVVANARALAEALVERGFDLVTGGTDNHLILIDLTSRDIGGKPAARALDQAGIELNYNAVPFDQRRPFDPSGIRLGTAAITTRGLGVGHMPVLAGWIDDVVKAAVVGDTATITRVREQVTELTAAFPMPGFA

SEQ ID NO: 18104 - protein, 219 aa, Glycine soja
NGNNLPTKQAVVDLYKSNRIGKIRLYYPDEGVLQALRGSNIEVILGVPNDQLQSLTNAGAATNWVNKYVKAYSQNVKFKYIAVGNEIHPGDSLAGSVLPALENIQKAISAANLQGQMKVSTAIDTTLLGNSYPPKDGVFSSSASSYIRPIVNFLARNGAPFLANVYPYFAYVNNQQSIGLDYALFTKHGNNEVGYQNLFDALLDSLYAALEKVGAPNVK

SEQ ID NO: 18105 - protein, 259 aa, Streptococcus pneumoniae
MAVISMKQLLEAGVHFGHQTRRWNPKMAKYIFTERNGIHVIDLQQTVKYADQAYDFMRDAAANDAVVLFVGTKKQAADAVAEEAVRSGQYFINHRWLGGTLTNWGTIQKRIARLKEIKRMEEDGTFEVLPKKEVALLNKQRARLEKFLGGIEDMPRIPDVMYVVDPHKEQIAVKEAKKLGIPVVAMVDTNTDPDDIDVIIPANDDAIRAVKLITAKLADAIIEGRQGEDAVAVEAEFAASETQADSIEEIVEVVEGDNK

SEQ ID NO: 18106 - protein, 303 aa, Zea mays
  misc_feature (223)..(223): Xaa can be any naturally occurring amino acid
ARGYTLAGDWANLNSDTLLFDVCCGTGTIGLTLAQHVGMVVGIEMNESAVSNACKNGVVNGIKNCRFVCGKAEDVMGPLLTEYLGSPQQQAAASKSNSEIDDASKNEDTIGCASYDGENIDSSKQRNDNAEGQQPMGASVDHPTCASEVDENNVASGEQNCGEASLVNDKPIETASDNSLEQGKACKDGSSSPNNNVLAANACQFKNVVAIVDPPRVGLRPTXYVSCNPDSLVANAIELCTPTSEKQEKNKGNRGWRSMSSAGLARQRTKSMPNFEPFIPKRAMAVDLFPHTPHCEMVMLFER

SEQ ID NO: 18107 - protein, 424 aa, Dehalococcoides ethenogenes
MEKALLEIEEKARLAKAASRPLSYASSAQKDAALKNIAACLLNNAPAILEANLKDQTEAKAAGMTAAMLDRLIITQSRLEGIAKDTLAIAALPDPVGEIFDMNTMPNGLVIGKKRVPLGVIAAIYESRPNVTVDIAALCLKAGNAVILRGGKETIHSNTILARLIRQAVEEAGLPQEAVQFIENTEHSLVNHLLKLSDQIDLVIPRGGAGLISYVKQNSFIPVVAGGIGVVHIYVDADANIADAVNIAYNSKVQRPTVCNAMDTLLVHKDIAAAFLPVVAAEWSKAGVEIRADKTAMEILENASSCKLIPAAADDWGKEFLALVAAVKVVDSLDEALSHIARYGSGHTESIVTQNYTSSQRFLNEVDAAAVMVNASTRFTDGSQFGLGAELGISTQKMHARGPMGLKEITSYKWIVYGNGQIRG

SEQ ID NO: 18108 - protein, 716 aa, Burkholderia xenovorans
MTMFNKIVKEFQWGQHKVRLETGEIARQASGAVIVDVEDTVVLATVVGARTAKPGQDFFPLTVDYLEKTYAAGKIPGGFFRREGRPSEGETLISRLIDRPLRPLFPEGFYNEVQVVIHVLSLNPEIPADIPALIGASAALAVSGLPFNGPVGAARVAYINNEYVLNPTRPQMKESALDLIVAGTERAVLMVESEAQQLSEEVMLGGVVFGHEQMQIAIDAIHDLVREGGKPEWDWQPAAKNEPLIARVTELAQADLLAAYQLRDKQARSAKLKEIYAATSAKLEEDAAAGGTVAADKATVGNVLFDIEAKIVRTQILNGEPRIDGRDTRTVRPIEIRTGVLPRTHGSALFTRGETQALVVATLGTKGDEQNIDALEGEYRERFMLHYNMPPFATGETGRVGSPKRREIGHGRLAKRALAACLPSADEFGYSIRVVSEITESNGSSSMASVCGGCLALMDAGVPMKAHVAGIAMGLILEGNKFAVLTDILGDEDHLGDMDFKVAGTEQGVTALQMDIKIQGITREIMQVALAQAKEGRLHILGKMTSAVSGANTVLSDYAPRMITIKINPEKIRDVIGKGGSVIRALTEETGTTIDISDDGVVTIASTSSEGMAEAKKRIENITLEVEVGQVYEGTVLKLLDFGAIVNILPGKDGLLHISEIANERIKDINDYLKDGQQVKVKVIQTDEKGRVRLSAKALLNDAANGAPQGEPTPQQ

SEQ ID NO: 18109 - protein, 238 aa, Picea glauca
MEHLNTAAAQASSSLYGVGMAEYGDAGVSSMMALITQHEPHDSESIMSTRMPSSFSSFHGHADCLLSAAMFQASQGDHKLKRQPGMDQLVSEQAGMSDSSMPLVKTEVCSGLRNQFEFHREQTGNCYTDQSSNTPVNPLVTSLASQARGEAQTIPSLDANSPHFNVDNEEYAIKSKILAHPQYPSLLGAYIDCQKIGAPPEAVARLDALTREYQNQQRRTVSIGMDPELDQFMEAYCE

SEQ ID NO: 18110 - protein, 1110 aa, Unknown
  Candidatus Kuenenia stuttgartiensis
MPPKEMLHAEEPLWYKDAIIYELHVKAFYDSNSDGIGDFKGVTEKLDYLENLGVTALWLLPFYPSPLKDDGYDIADYFGIHPDYGTLRDFKLFIKEAHKRGLKVITELVLNHTSDQHKWFHAARRPKQKSKMKDFYVWSDTSEKYKDARIIFKDFEHSNWTWDPVAKAYYWHRFYSHQPDLNFTNPAVQKEMLRIIDYWIDMGVDGFRLDAVPYLFEKEGTNCENLPETHDFLKKLRAHVESTHNNVMLLAEANQWPEDAVVYFGNQDECHMSFHFPLMPRLFMSIWMEDRFPIIDIFDQTPLLPETCQWALFLRNHDELTLEMVTDEERDYMYQVYASDPVARINLGIRRRLAPLLGNNRRKIELMNALLFSLPGTPIIYYGDEIGMGDNFYLGDRNGVRTPMQWNVDRNAGFSRVNPQKLYLPIVTDPEYHYEAINVENQEKNHASLLWWMKRVIAMRKRYKAFGRGSIEFLFPDNPKVLAFIRHYQDEHILVVMNLSRFSQVVELDLSTFSDCTPEDVFSGNKFPKITKSPYVLTINRHDYFWFLIQKEAEELRLAKDESIPELSINGKWETVFQGKTAVKLEKMILPVYLKKSRWFGGKASDIQEVKIIENISLQKDTHTTQLILIEVKYNGKESDRYVLSFSYLSGSEAETMLHENPQKIVMKLKTDDTEGIVYDGIYDEEFQKFILKMAVNRLSVKGTQGRLVVHTGKMHKQYKLKELLSEKSSVLKAEQSNSSLLYGKELIFKLYRRLCEGINPEWEIGRFLGEYTSFANVPAFIGEIAYVRKGNQPISIGILQRFIPNHGDAWSYTLDSLMTYFDRVFAKKNEILEMPVMSFSLLETTSHEIPLLFKELIGGVYLEMTSLLGKRTAELHIALSKETDNNEFRPEPFSRLYQRSLYQSMQSYLKKVFTLLRKNMKKLPENTKESVDKLLLQENRIIELYKNIFKKKISALKIRIHGDYHLGQVLYTGNDFFIIDFEGEPARSLSERRLKKSVLKDVAGMIRSFHYVSNTALLKHITIRPEDIPVLEPWTNLWYQYVAGIFLKSYIETAKNTHLFPENNEDFTMLLTSFLLEKAVYELGYELNNRPEWTSIPIKGILQLLETNK

SEQ ID NO: 18111 - protein, 146 aa, Unknown
  Candidatus Protochlamydia amoebophila UWE25
MSIEEFYVPPSGPPQGITPDSRIYSLMGEDNIYKMLEDFYLELEKSSIRHLFPADMKAASKKSAAFFVFICGGPPLYQQQFGSPRMRQRHLPFAIDEEARQVWLHSFKHILQGAEQKYCFPMEYMGSFYRFLDQFSTWMINTQSEK

SEQ ID NO: 18112 - protein, 412 aa, Desulfovibrio vulgaris
MDELLLQDPEVGKAIILEIERQTGKLELIASENFVSAAVRQAQGSVLTHKYAEGYPGKRYYGGCEFVDIAENIAIERARTIFGCEYANVQPHSGSQANMGVYFACLKPGDTILGMNLSHGGHLTHGSPVNFSGRLFNVVFYGVEKETGRIDYEQVAALAREHKPSLIVAGASAYPRTIDFARFRAIADEVGAKLMVDMAHIAGLVAAGYHPSPVQHAHYTTTTTHKTLRGPRGGMILSTEDNGKTLNSQIFPGIQGGPLMHVIAAKAVAFGEALRPAFKEYQKQVVDNAAALAGVLTAAGFDLVSGGTDNHLMLVDLTSKDVTGKDAEIALDKAGITVNKNTVPFETRSPFVTSGVRLGTPALTTRGMKAAEMEKVGGWIVDAIANTTNETRLAEISREVERFARQFPLFAW

SEQ ID NO: 18113 - protein, 208 aa, Unknown
  Polaromonas sp. JS666
MHNLWTPLSRPLPRIALLTGLALSTIAANSAAPAPSASVAGSVAADASACPGLLQHNFLRLQDEKPQSLCQYQGKVVVAVNTASFCGFTSQYQGLEELYAKYKDRGLVVLGFPSNDFSQETGSNKEIADFCENTFGVKFPMFAKTSVSGKDANPLFRQLAAKTGTTPRWNFYKYVIARDGTSVASFNSLTAPGSRQFVKEIEKQLARP

SEQ ID NO: 18114 - protein, 566 aa, Escherichia coli
MEMLSGAEMVVRSLIDQGVKQVFGYPGGAVLDIYDALHTVGGIDHVLVRHEQAAVHMADGLARATGEVGVVLVTSGPGATNAITGIATAYMDSIPLVVLSGQVATSLIGYDAFQECDMVGISRPVVKHSFLVKQTEDIPQVLKKAFWLAASGRPGPVVVDLPKDILNPANKLPYVWPESVSMRSYNPTTTGHKGQIKRALQSVVAVKKPVVYVGGGAITAGCHQQLKETVEALNLPVVCSLMGLGAFPATHRQVLGMLGMHGTYEANMTMHNADVIFAVGVRFDDRTTNNLAKYCPNATVLHIDIDPTSISKTVTADIPIVGDARQVLEQMLELLSQESAHQPLDEIRDWWQQIEQWRARQCLKYDTHSEKIKPQAVIETLWRLTKGDAYVTSDVGQHQMFAALYYPFDKPRRWINSGGLGSMGFGLPAALGVKMALPEETVVCVTGDGSIQMNIQELSTALQYELPVLVVNLNNRYLGMVKQWQDMIYSGRHSQSYMQSLPDFVRRGAYGHVGIQISHPHGWKANLARRWNRCAIIAWCLLMLPSMAASTSTRCRFAGAEWMKCG

SEQ ID NO: 18115 - protein, 112 aa, Neisseria meningitidis
MKKIEAIVKPFKLDDVREALTEIGITGMTVSEVKGFGRQKGHTEIYRGAEYAVDFLPKIKIELVLADDAVERAIDVIVEVARSGKIGDGKIFVLPVEEAIRIRTGERSDAAV

SEQ ID NO: 18116 - protein, 1383 aa, Cryptococcus neoformans
MSLPDAYPPVIATEGSTAFQSHILSLLSVISQHPSPDYPFPTSGDSTLQDNASVAAKKSATLSTFPGKKTPAEDAIERAIIALGDRVWTSERTQAHLVKDTKRDVPAQPGSDLLTPDWTPPVPTLSDSSPDPVCPTCARPVSSTESSSFTPQQIASFYHPFTAALSTPPPPLPEQMFFPQSVLAAYVSATSDSESAGDSGMSAEKELELLKAQVQDIARVCKAVATGDLTQKIIVPVKGQTMTELKNIINAMVDRLQTFAVEVERVSLEVGTEGKLGGQAVVPNVEGTWKVLTAVVNKLAANLTNQVRSIAKVTKAVAKGDLSETIDVEASGEIAELKTTVNGMVMSLRTLADEVSRVSLEVGSQGKLGGQANVPDVEGVWKDLTVNVNRMCESLTTQVRSIGSVTTAVARGDLSKMIEIEAEGEMAVLKNTVNSMVRQLTVFAKEVTRVALEVGTHGQLGGQAVVPGVEGVWDDLTTNVNKMARNLTDQVREIAMVTKAVARGDLSKTVNADVQGEILDLKCTVNEMVAQLTVFAAEVTRVSLEVGTEGKLGGQAVVPNVEGTWMVLTDNVNLMALNLTTQVRSVAEVTTAVAAGDLSKKINVAAFGEILELKNTVNNMVDSLRSFSSEVTRVAREVGTDGRLGGQAKVPGVAGTWKDLTDCVNIMAANLTEQVRTIAHATTAVARGDLTQKVVGVKVSGEILDLVNTINNMIDQLAIFAAEVTRVAREVGTEGKLGVQAEVENIEGTWQEITSNVNTMASNLTSQVRAFAQISAAATDGDFTRFITVEASGEMDSLKTKINQMVYNLRESIEKNTKARQEAEMANRSKSEFLANMSHEIRTPMNGIIGMTVLTLESELTRQQRENLMIVSSLAGSLLTIIDDILDISKIEAGRMTMEQIPFSLRVAVFSVLKTLCVKAAQNKLDLIFDVDPTMPDQLIGDPLRLRQVITNLIGNAVKFTTKGQVALSCRVKRYVAVADAVELEFCVADTGIGIKQDKLDVIFDTFAQADGSTTRKYGGTGLGLTISKRLVNLMSGDLWVESEYGQGSRFYFTTVAEMTSVPRDQIIERLSPWSGRSVLFIDTLGDQTGIVEMLQELGLKPIVIHSVNDVYLLQDQGLTVFDTMIVDSLKAAGELRGIEYLRYIPIVLLAPSNKPSGPSNPSFISLPESRRRLLALPSASEQLLSPIPVKDCLEMGINTYYTTPLSLQELSNAIVPALESHQIQPGDTVRDTILSVLLAEDNLVNQKLAVKLMEVAGHKIEVADNGEIALEKYKRRQLARTPFDVILMDVSMPVMGGMEATGLIREFEANEGVPRTPIIALTAHAMIGDKERCLAAGMDEYVTKPLRRGDLLASIAKVLAPKQSASGLEMPAVSIPANIYGR

SEQ ID NO: 18117 - protein, 578 aa, Coccidioides immitis
MAPSAPNTIYIDEDVGRDDESAAGTDLSPYKTLVYAFLQHPPSTEDIQYLTRKSETGPVGEDGDPSVRLEWKPATKSALKKATNLFEARKKKAAKEHELALRQKEEAEKRQLVLEAAKKVVIKEDASLPKPVRIRLYEKDPAKVKLRDGDTPGTRVRVLGRVHRLRSQKDVIFVTLSDGYGFLQCVFTGDLVKTYDAMTLTLETSIAVHGEMCAVPPKQHAPDNRELHADFFTVIGRAAGDKEAITTRVAPDADPQTLYDNRHLVLRGEIASSVMKVRAAVIRAFRSAFEEQRMLEVTPPAMVQTQVEGGSTLFSFDYYGEPAYLTQSSQLYLETCLPSLGDVFCICPSFRAEKSLTRRHLSEYTHIEAELDFITFDDLLDHLEVIICRVLDLVLADPQIAGYIKSLNPDFKPPSRPFKRMKYAEAIDWLREHNIPNEEGNPHTFGDDIAEAAERKMTDTMNQTIFLTHFPVEIKAFYMRKDPEDLRVTESVDVLMPGVGEIVGGSMRMEDWDELMGAYASRGMDPTPYYWYTDQRKYGTSPHGGYGLGVERFLAWMCGRYTVRECCLYPRFTGRCTP

SEQ ID NO: 18118 - protein, 414 aa, Xanthomonas axonopodis [sequence omitted]

SEQ ID NO: 18119 - protein, 219 aa, Glycine soja
NGNNLPTKQAVVDLYKSNRIGKIRLYYPDEGVLQALRGSNIEVILGVPNDQLQSLTNAGAATNWVNKYVKAYSQNVKFKYIAVGNEIHPGDSLAGSVLPALENIQKAISAANLQGQMKVSTAIDTTLLGNSYPPKDGVFSSSASSYIRPIVNFLARNGAPLLANVYPYFAYVNNQQSIGLDYALFTKKGNNEVGYQNLFDALLDSLYAALEKVGAPNVK

SEQ ID NO: 18120 - protein, 656 aa, Oryza sativa
MDELNLLRQHQHQHQHHLVVRGLGEEIDLEIGPGDDPSFPGAALVGVTPGAHDPADDHKSLLIPCSQPVAEGQPQPTPPQVEEHDGLLRLPGQTKKKKKVVKKWREEWADTYKWAYVAVHDNTSRIFCTVCKEYGRKHRRNPYGNEGSRNMQMSALEEHNNSLLHKEALRLQTASKENAQPPEIERPVYVKALSKTAASILESILKKDPHEAEFIQSIQEVVHSLEPVLVKNSQHVQILERLLEPERCFIFRVPWVDDRGEAHVNRGFRVQFSQALGPCRGGLRFHPSMTLSVAKFLAFEQTLKNALSQYKLGGAAGGSDFDPKGKSESEIMRFCQSFMDELYRYLGPDQDFPAEDVGVGPREMGYLFGQYRRLSGHFQGNFTGPKIFWSGSSFRTEATGYGLVFFARVVLADMNKELKGLRCVISGSGKIAMHVLEKLLSCEAIPVTVSDSKGYLLDTEGFDYMKYSVLRNIKAQQRSLKEYLKSYPNAKYIDDAKPWSEKCDVAFPCASQNEIDQAEALAIINSGCRVLIECSNMPCTAQAVDILRTAKVVVAPAKATAAGGVAVGELELNPEFSLMQWSVEDFENKIQDAVKQTYDRSIKAAQDYGIMKENPELVFFLCSEDVFLCFRLVSTQKLIDLSMQVVGAWCKHMCVS

SEQ ID NO: 18121 - protein, 321 aa, Shigella flexneri
MGTTKHSKLLILGSGPAGYTAAVYAARANLQPVLITGMEKGGQLTTTTEVENWPGDPNDLTGPLLMARMHEHATKFETEIIFDHINKVDLQNRPFRLNGDNGEYTCDALIIATGASARYLGLPSEEAFKGRGVSACATCDGFFYRNQKVAVIGGGNTAVEEALYLSNIASEVHLIHRRDGFRAEKILIKRLMDKVENGNIILHTNRTLEEVTGDQMGVTGVRLRDTQNSDNIESLDVAGLFVAIGHSPNTAIFEGQLELENGYIKVQSGIHGNATQTSIPGVFAAGDVMDHIYRQAITSAGTGCMAALDAERYLDGLADAK

SEQ ID NO: 18122 - protein, 243 aa, Arabidopsis thaliana
MGTPETSREPCPDRILDDIGGAFGMGAVGGSAFHFIKGTYNSPKGSRFVGGTQSVSMNAPRTGGSFAVWGGLFSTFDCTMVYLRQKEDPWNSIIAGAATGGFLSMRQGAGAASRSAIFGGVLLALIEGAGIMLNEVLAQPQNMMMEDPGMQGMPGMQGMQGMPGMPGMQGMPGMQGMQMGQMQSQAQIRSESQNQNTASSSSSSSWFGGLFDKKKEEVQPGSESKTEVLESFDAPPVPSFEFK

SEQ ID NO: 18123 - protein, 219 aa, Glycine soja
NGNNLPTKQAVVDLYKSNRIGKIRLYYPDEGVLQALRGSNIEVILGVPNDQLQSLTNAGAATNWVNKYVKAYSQNVKFKYIAVGNEIHPGDSLAGSVLPALENIQKAISAANLQGQMKVSTAIDTTLLGNSYPPKDGVFSSSASSYIRPIVNFLARNGAPLLANVYPYFAYVNNQQSIGLDYALFTKHGNNEVGYQNLFDALLDSLYAALEKVGAPMVK

SEQ ID NO: 18124 - protein, 399 aa, Arabidopsis thaliana
MALQAAYSLLPSTISIQKEGKFNASLKETTFTGSSFSNHLRAEKISTLLTIKRRQKPRFSTGIRAQTVTATPPANEASPEQKKTERKGTAVITGASSGLGLATAKALADTGKWHVIMACRNFLKAEKAARSVGMSKEDYTVMHLDLASLESVKQFVENFRRTEQPLDVLVCNAAVYQPTAKEPSFTAEGFEISVGTNHLGHFLLSRLLLDDLKKSDYPSKRMIIVGSITGNTNTLAGNVPPKANLGDLRGLASGLNGQNSSMIDGGEFDGAKAYKDSKVCNMLTMQELHRRYHEETGVTFASLYPGCIATTGLFREHIPLFRLLFPPFQKYITKGYVSEEEAGKRLAQVVSDPSLGKSGVYWSWNNNSSSFENQLSKEASDAEKAKKLWEVSEKLVGLA

SEQ ID NO: 18125 - protein, 417 aa, Shigella flexneri
MADNKPELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMTVGISEITAIGVYVQFWSPEMAQWIPALIAVALVALANLAAVRLYGEIEFWFAMIKVTTIIVMIVIGLGVIFFGFGNGGQSIGFSNLTEHGGFFAGGWKGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAMAKVSRHGVPVAGVAVSIAILLIGSCLNYIIPNPQRVFVYVYSASVLPGMVPWFVILISQLRFRRAHKAAIASHPFRSILFPWANYVTMAFLIAF

SEQ ID NO: 18126 - protein, 133 aa, Arabidopsis thaliana
MDTKKKSKEHGLYRIVNAIGYAFGAGAVGGSVYHFVRGAYNSPIGTRYVGGTQAASMNAPRLGGTFAVFGGLLSTFDYALVRIRKKEDPWNSIVAGAAAGGVLSIRKGVVAASTSAVMFGFFLAVLNPPFGSK

SEQ ID NO: 18127 - protein, 238 aa, Picea glauca
MEHLNTAAAQASSSLYGVGMAEYGDAGVSSMMALITQHEPHDSESIMSTKMPSSFSSFHGHADCLLSAAMFQASQGDHKLKRQPGMDQLVSEQAGMSDSSMPSVKTEVCSGLRNQFEFHREQTGNCYTDQSSNTPVNPLVTSLASQARGEAQMIPSLDANSPHFNVDNEEYAIKSKILAHPQYPSLLGAYIDCQKIGAPPEAVARLDALTREYQNQQRRTVSIGMDPELDQFMEAYCE

SEQ ID NO: 18128 - protein, 372 aa, Yarrowia lipolytica
MSFRNVSLRGSQLLGKLDSRGWGWYVAKKWNIGLVYTMCKVFLRCKKVDIKGLDNLLEAHRQARLEGRGLLTVMNHTSVLDDPVVWGMLPNDNGWIPYLMRWATGAKDICYKNKLYSLFFGAGQVLPITRFGIGGPFQPGMDMCVRLLNPNNKIKYSAKYTPYLVHTNATSYPFWRESNWVHFFPEGYVHQALEPHEGTMRYFRWGTSRAVLEPVTPPIIVPMFSHGLQKVFQEIPKGYEMEGNNTNKDRTISIRIGEPISETTVAGFRNEWINLCHKENVGLNAETMPDVLKNGQEAKDLRSKVAAYLREEVEKLRLTVPNMNPELPEFKEPEFWSDIDKVHKGVYNHRGKVRMLRNPTKGLIEVVEANKD

SEQ ID NO: 18129 - protein, 214 aa, Glycine soja
NGNNLPTKQAVVDLYKSNRIGKIRLYYPDEGVLQALRGSNLEVILGVPNDQLQSLTNAGAATNWVNKYVKAYSQNVKFKYIAVGNEIHPGDSLAGSVLPALENIQKAISAANLQGQMKVSTAIDTTLLGNSYPPKDGVFSSSASSYIRPIVNFLARNGAPLLANVYPYFAYVNNQQSIGLDYALFTKHGNNEVGYQNLFDALLDSLYAALEKVG

SEQ ID NO: 18130 - protein, 552 aa, Helicobacter hepaticus
MLVNLEHDDFITEEEDFAALFEASEKKADAGAIQIGEIVAITDEYAMVALANEKSEAMLRLGEIQDDNGNLLFNINDKIEVFVTPGRGGRPNASYKKALKSKRIVEKIAQIADNYQDKIIEAKVIKKNKGGFILEYDGIDVFMPRRDSAIREDDKAIGKIYKVAIVNINKESNSIIVSRKRFFEIDDKNRQNVSAKLLENDGVQKGIVKKIAPFGVFVDVYGVEGLVHYTELSHKGPINPAKNFKEGDEVVVKVLGYDEKKRRLSLSMKALGDDPWKEIEKELEVGYSIKVSVSNIEPYGAFVDLGNDIEGFLHISEISWDKNIKHPSSYLNVGQEIDVEIIEIDTDNKRLRVSLKKLLDKPFVYFAKTHQVGEIIKGKIATLTDFGAFVNLGGVDGLLHNEDAYWDKKSKCKDGFKVGDEIEVKIIKIDKEHERVSLSKKLLEHSPAREFGKTHKVDDVARGSIIDIKDFGIFIKIDEMEALIRNEDIQPLKKEDLKAGEEIECVITHIDEENNKVRASIKRLERQKEKETLKAFNSEEKMTLGDKLKNRL

SEQ ID NO: 18131 - protein, 160 aa, Brassica napus
MSSFTTKTPPPYLRRPNHHRRVNPLFPVICCLGESQQDSFTRRRTLTSLITLTVIVPTSSALAQEKWGTRSFIKEKYFQPGLSPEDAAARIKQTAEGLRDMREMLDHMSWRYVIFYIRLKQAYLSQDLTNAMNILPESRRNDYVQAANQLVENMSEVKVN

SEQ ID NO: 18132 - protein, 311 aa, Helicobacter hepaticus
MSKVSVFGGGAWGRALAFALAEKNEVRIISRRDISSLLEPLNQKLKTLNCTSIIQVSHKEALDAQYFVMAIATSALREWLAVADLPQKIKILCASKGIESGSGAFVSDIMEERIAHKSIAYLCGPSFASEVVHSLPCALVIHSRNLELSREFGTLMPHFIKTYASPDVVGGEVAGAYKNVIAIAGGICDGLAFGMNAKASLLARGLVEMSRFGEHFGAKMETFLGLSGAGDLFLTSNSTMSRNYRVGLGLAKGKAINEILKELGEVAEGVITAKAITEIGQRENIYTPIAREINLIINGKNVRESSKALMA

SEQ ID NO: 18133 - protein, 564 aa, Zea mays
MASSHIILPKEEEEEAAAAAVAEVGLGAAVEADHDHRPYQEQGPGKAALPFSATCVRISRDSYPNLRALRNASTMTLHDDDAAFVKLEEGDYGYVLDDVPHLTDYLPDLPTFPNPLQDHPAYSTVKQYFVNADDTVPEKVVVQKNSPRGVHFRRAGPRQRVYFESEEAKACIVTCGGLCPGLNTVIRELVCGLSHMYNVSNVFGIQNGYKGFYSSNYLPMTPKSVNDIHKRGGTVLGTSRGGHDTKKIVDNIQDRGINQVFIIGGDGTQKGAYEIYKEIRRRGLQVAVAGIPKTIDNDIAVIDKSFGFDTAVEEAQRAINAAHVEASSAENGIGLVKLMGRYSGFIAMYATLASRDVDCCLIPESPFYLEGEGGLFEYIDRRLKENNHMVIVVAEGAGQDLIAQSIPAADQQDASGNKLLLDVGLWLTHKIKDYCKSKKMEMTIKYIDPTYMIRAIPSNASDNVYCTLLAHSAIHGAMAGYSFTVGMVNGRHAYIPFHRVTSTRNKVRITDRMWARLLSSTNQPSFLSQKDIDAAREADKAANRMKSREDAKKQSTPVLANGEK

SEQ ID NO: 18134 - protein, 605 aa, Oryza sativa
MSALTTSQLATSATGFGIADRSAPSSLLRHGFQGLKPRSPAGGDATSLSVTTSARATPKQQRSVQRGSRRFPSVVVYATGAGMNVVFVGAEMAPWSKTGGLGDVLGGLPPAMAANGHRVMVISPRYDQYKDAWDTSVVAEIKVADRYERVRFFHCYKRGVDRVFIDHPSFLEKVWGKTGEKIYGPDTGVDYKDNQMRFSLLCQAPRILNLNNNPYFKGTYGEDVVFVCNDWHTGPLASYLKNNYQPNGIYRNAKVAFCIHNISYQGRFAFEDYPELNLSERFRSSFDFIDGYDTPVEGRKINWMKAGILEADRVLTVSPYYAEELISGIARGCELDNIMRLTGITGIVNGMDVSEWDPSKDKYITAKYDATTAIEAKALNKEALQAEAGLPVDRKIPLIAFIGRLEEQKGSDVMAAAIPELMQEDVQIVLLGTGKKKFEKLLKSMEEKYPGKVRAVVKFNAPLAHLIMAGADVLAVPSRFEPCGLIQLQGMRYGTPCACASTGGLVDTVIEGKTGFHMGRLSVDCKVVEPSDVKKVAATLKRAIKVVGTPAYEEMVRNCMNQDLSWKGPAKNWENVLLGLGVAGSAPGIEGDEIAPLAKENVAAP

SEQ ID NO: 18135 - protein, 731 aa, Unknown
  Synechococcus sp. WH 7805
MSDLKCPFSGHTGAVTPAGRTDNSDWWPNQIDLGILHQHHPASNPLGDDFDYPSAFTALDYSALKADLQALMTDSQDWWPADWGHYGALFIRLAWHSAGTYRTGDGRGGAGHGNQRFAPLNSWPDNTNLDKARRLLWPVKRKYGNAISWADLIILSGNVALESMGFRTFGFAGGRVDIWQPEEDVFWGTETGWLSDERHNEKGELEQPLAAVQMGLIYVNPEGPGGEPDPVASGRDVRETFARMGMTVEETVALVAGGHTFGKCHGAAPDSNLGAEPEGAALHEQGLGWRNSYETGKGEHTISSGIEGAWKPNPTRWDQGYFQMMFTYDWELTKSPAGAWQWTAKDVKPEHMVPDAHVAGKSSAPIMTTADLSLRHDAIMEPVARRFYQDQEAFADAFARAWFKLTHRDLGPRALYLGQEVPEEVQIWQDPIPDVNHALIDDADISNLKQQILASGQSMSALVATAWASASTFRGSDRRGGANGGRIRLLPQRTWEVNEPEQLNGVLAALETIQSEFNSSRTDGKSVSIADLVVLGGCAAVEKAAADGGQSVMVPFSPGRTDAGPEQTDTASFNVLKPLADGFRNWKRSGLPLRAEELLIDQAQLLTLSAPEMTVLLAGLRVLGANTGGNRQGVFTTNVGVLSNDFCVNLLDMTTRWTPTNEAQDAYVGHDSASGAERWSASRADLVFGSNSQLRAIVEVYAQNDGSSRFVADFVKAWVKVMELDRFDLHG

SEQ ID NO: 18136 - protein, 103 aa, Arabidopsis thaliana
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 18137 - protein, 251 aa, Aspergillus oryzae
MEQSTQSASQQQGRQQPVYDTRNGGHYAELYTGTWANVNQGLQGTARDILTTYWQHIINHLESDNHDYKIHQLPLARIKKVMKADPEVKMISAEAPILFAKGCDIFITELTMRAWIHAEDNKRRTLQRSDIAAALSKSDMFDFLIDIVPREEATSHAKRSSQAAGAPSGAPGPTGAAGQLPPSQHGVQHPSHHMAPPDYSLGQHGLQDQEYRQPAMYAGPVQSDPTAAYGQPQSQMFEGMYAAYPHLPPQQ

SEQ ID NO: 18138 - protein, 373 aa, Dehalococcoides ethenogenes
MNGNCYKRIVIKLGTSLLTGGTGKLDHERMADLCRQIADLTRLGTEVIIVSSGAIAAGRAKMGLRHIPKDVPFKQVLAAIGQSQLMNYYDQLFSPHGLTVAQGLLTKSDLSDRSGYLNARNTLLALMELGVITIVNENDVVAVDEIQQAKFGDNDNLSAMVANLIEADLLLILTNIRGLYTADPTLHPDARLITEVKEITEELEKLAAGSSNKLGTGGMVTKLEAARLATSSGVNVIIADGHIPDIILKLASGETEGTRFMPSLHKPDSRQRWMMSGLCTRGNICIDDGAVKAIRENQKSLLAAGVQQSEGKFGRGDIVKLSDSRGKRLGYGITNYSSDDVSKIKGLHTDEINTVLAGNQGPEIIHRNNLVVI

SEQ ID NO: 18139 - protein, 456 aa, Oryza sativa
MESRTAVSGLDDRAKEDGDGVAEEKDITSLLASRRSTLASRFVMSCTCVFPSILNPDWTYRYVGVEEETGTELFYYFVESERSPHSDVVLLWLSGGPRCSVFSGFVYEIGPVMFVAERYSGGTVPRLEYNPYSWTKWLDDHPKYLSNPFYIGGDSYAGKVVPLITQYLSEVSYVDKLIYNHLDDKIEIIYVSSLLTLVSFIQGYLVGNPSAGDKIDVNSRVPYSHSFGVISDQLYEAALANCKGDYENPTNKPCTDVMQTINNLMSEVLEPACPFDWPWPMPGRDASNRKSLTEEHYWLGDPPVEPPFSCFAAYRYYLSYFWANDNATRAALGIKEGTVTEWIRCATGLPYTRDLPSSIECHFNVTTRGYRALVYSGDHDPIVPFSGTQAWIRSLNFSIVDDWRAWHLDGQAAGFTIKYANNLTFATIKGGCHIPPENRPKESFIMAKRWLAGGPL

SEQ ID NO: 18140 - protein, 331 aa, Ashbya gossypii
MQNEHSEFAKMSQTLTNVQELRLRASTTRHALSDIVREKDWSDFQFAPIREATVSRAMTTRYFEDLYRYAVSDVVIVGAGSSGLSAAYVLAKNRPDLRIAIIEANVAPGGGAWLGGQLFSAMIMRKPTHLFLDELEIPYEDEGDYVVVKHAALFTSTVLSKVLQFPNVKLFNATAVEDLVTKPSANGGVTIAGVVTNWTLVTMAHDVQSCMDPNVIELEGYKDDGTRDPKKKHGVVLSTTGHDGPFGAFCAKRLAALDAQHAIKGMQSLDMNTAEAGVVKESGATAGVEYMYFAGMETATKKGVSRMGPTFGAMAVSGIKAAEEILRHFAE

SEQ ID NO: 18141 - protein, 1044 aa, Coccidioides immitis
MNEIDRTHRTLPIYHLGSSKEDIESEPNWQEVPHHRVGYRDQHGRIAGISHLENDLDKDKEFLEHARQLADELRRRKERGDLLTVVDFMRDQEDYHLRMPAKHPSGWRYVLHTTENFIKNEEEWPVNIQKREKERQQEKRNEEERPKQEHEWRRERGQITTHHEAYSTTGLPQEKEQEKGRLDKQELEEERKPKWKRLQQKYSPQELAFLHSLKVENDYMHGLEVDSGTRVSPKADEPLITTIDEADQYTPDNWIPRDQALVRLTGKHPLNAEPDLTTLFDAGLITPSSLHYVRNHAAVPHILWETHTVDINNGKKILTMDELAEFNAINIPIAMACDGNRRKELNMIRRSKGFDWGAGGVSCAFWKGALLRDVLVSAGVRLMPSAHSHARLWVNFEGADNPSEGKYSTCIPLEYAMDPTNDVILAYEMNNRPLPPDHGYPVRIMIPGYVGGRCVKWLSRIWISDKENTSYYHTYDNRVLPSFVIEKDSEFARTMFHHPSTACNEQNLNSVIVRPAQNEKIELQNAKFGQTYRIQGYAYDGGGCEVQRVEVSLDDGKTWLYCTRKFPEAPVRHGKKFWTWLFWHVDVEIAHLISAKSIAVRCFNVFKNTQPEKPVWNLMGMMNNCWYVVRTETINDENSGALCLNFQHPVEPGISKGGWLKPSAEVQMESIKHEVSAPQKQFTREEIEKHNKEGVCWIVINGKVYDATSVLSWHPGGKAAIMAHAGKVHADTTEEFESIHDDYAEQKLSGVVTDKAKAFIKRQKEQAAKDAAAVSEKAGDIALNRRRWVPVKLIKTTHISEDTQSYKFALPEGAKSLGLHTGEHIQIGFHFLDRMVTRSYTPVRPILEEEKDGTFDLVVKSYFPSKDMPGGTISNILHELRPGEEIEIKGPMGEIHYLGHGKLRVDGKTLQFQNISLVLGGSAITPGWQLIKDILKSENPHDNTKIVLVDANKTEGDILLRDEMEKLMKEHPDQFKINHILSDPGKIWKGDTGFVTEDYLKTHCYPPADGNVALICGPPAMIAKAVLPALKNWGYREEENLFGF

SEQ ID NO: 18142 - protein, 430 aa, Listeria monocytogenes
MKITINQASEFVGKEVTIGAWLANKRSSGKIAFLQLRDGTGFMQGVVVKAEVGDDIFATAKALTQETSLYVTGTINEDTRSPFGYEMAVSGVEVISESHDYPITPKEHGTEFLMDHRHLWLRSNRQHAIMKIRNEIIRASYEFFNKEGFLKIDPPILTGSAPEGTTELFHTKYFDEDAFLSQSGQLYMEAAAMAFGKVFSFGPTFRAEKSKTRRHLIEFWMIEPEMAFYKLEDSLQVQENYVAFLVKAVLDNCRLELDRLGRDVSHLEKMVAPFPRITYTEAIERLHELGFDDIVWGDDFGAPHETAIADSFEKPVFITHYPKAIKPFYMPEDPENDQVVLCADMIAPEGYGEIIGGSERIHDLETLQARMEDFDLDQEAYSWYLDLARYGSVPHSGFGLGLERTVAWISGTEHVRETIPFPRLLNRLYP

SEQ ID NO: 18143 - protein, 397 aa, Unknown
  uncultured archaeon
MVVELKKGVYWVGVVDWNIKKFHGHEYSTHRGSTYNSYLIVDEKIALVDTVLGTYSNEMIENIKKIVDIEKIDYVIANHAESDHSGGLPALMELIPDATVVVSEKGKESIPGHYHEDWNFKVVTTGDTISLGKDGLVFVKAPMLHWPDSMLTYLTGKNILMPNDAFGQHFASSKRFNDEVDETEVYQEAIKYYANILTPFSDLVTKKLDEFVKLDVPVDIIAPSHGIIWRKDPMQIVEKYYEWASGKNDGSVVIIYDTMWKGTEQMAAAIGGGIGNEGVKYNLFNIADHDRNDVLTEVFKAKGILLGCPTMNNGLLPTIMPILEDLKGLRFKNKVGAAFASYGWSGESLKQLEDRLKGAKIEILLEGIKFKWQPTMEELDLCVEFGSDFAKKMKSSE

SEQ ID NO: 18144 - protein, 156 aa, Glycine max
MGRRPARCYRQIKGKPYPKSRYCRGVPDPKIRIYDVGMKKKGVDEFPFCVHLVSWEKENVSSEALEAARIACNKYMVKSAGKDAFHLRIRVHPFHVLRINKMLSCAGADRLQTGMRGAFGKALGTCARVAIGQVLLSVRCKDNHGAHAQEALRRAK

SEQ ID NO: 18145 - protein, 105 aa, Brassica napus
MGKVRDFGAEDHIPSNILHAVTAISICLSAIYLNLALVLFSLFFLPPSLSLLVLGLLSLFIIIPIDDRSKYGLKLARYICKHAASYFPVTLHVEDYEAFKPDRSY

SEQ ID NO: 18146 - protein, 570 aa, Oryza sativa
MGNQCQNGTLGSDYHNRFPREHAVGYVQGDSYLDLKKFDDTWPEVNNFKPTAASILRRGLDPTSINVLGRKTADLREHYIIGRKLGQGQFGTTYLCTEINTGCEYACKTIPKRKLITKEDVEDVRREIQIMHHLSGHKNVVAIKDVYEDGQAVHIVMELCAGGELFDRIQEKGHYSERKAAELIRIIVSIVAMCHSLGVMHRDLKPENFLLLDKDDDLSIKAIDFGLSVFFKPGQVFTELVGSPYYVAPEVLHKRYGPESDVWSAGVILYVLLSGVPPFWAETQQGIFDAVLKGHIDFQSDPWPKISDSAKDLIRKMLSHCPSERLKAHEVLRHPWICENGVATDQALDPSVISRLKQFSAMNKLKKLALRVIAERLSEEEIAGLREMFKAVDTKNRGVITFGELREGLRRFGAEFKDTEIGDIMEAAHNDNNVTIHYEEFIAATLPLNKIEREEHLLAAFTYFDKDGSGYITVDKLQRACGEHNMEDSLLEEIISEVDQNNDGQIDYAEFVAMMQGSNVGLGWQTMESSLNVALRDAPQCQAAEATDEPVKVKVKVKCSNQIRRRRRQV

SEQ ID NO: 18147 - protein, 537 aa, Schizosaccharomyces pombe
MEPEYVSFSDKDTKSILNESKSSLKDVKPSLEEKSYITPGLVDDVEPKGKNFVVRFFDDFKPAKATGEDGTALKRSLKSRHMQMISIGGAIGTGLYVGSGSSLADGGPASVIINYSLIGIMMFFIVYALGEMAVAYPVAGGFNTYATRFIDPAWGFAVSWNYFINYFVTFPLELTTCAITFRYWTDINSAAWISIFLVVIIIVNLFGVRAYGEVEFILSTVKVVATFGFIILAIIINCGGVPTDHRGYIGGSIIKHKPFRHGFKGFCSVFTTAAFSFSGTEVIGLAAAEVDNPQKALPHAVKQVFWRIAIFYVVSLILIGLLISPDDPNLMGNGSTSVSPFVLAIKEANIKGLPSVFNAVIIISVVSVTNSSTYTAGRTLHGMANLKQAPSFFKYTDRLGRPLLAMIVVLLFGFFAYINEADKNGNDVSDTVFNWLLALSGLSNFFTWGSICLCHIIFRLAFKKQGHSLKELGFVSPMGIWGSCIGLFFNILCLMAQFYVSLFPIGGKPNANDFFQGYLAAPVTLAFFIGYKIYDRS

SEQ ID NO: 18148 - protein, 188 aa, Mougeotia scalaris
VYEDDGQPFTTFSQFWTRWQDMPFQPDNPLSTPNRLVLPPAVELQSMRVDELGLEERQEKSSNALLARAWTPGWANADRSLLVFIQGPLQRYSSSKNKADKHTTSLLSPHLHFGEILRTLKCTIKVRRMKAQWKSQGAEGASQGVDAFVRSLGLREYSRYLSFNFPFTHERSLLSNLKSFPWRLDEAG

SEQ ID NO: 18149 - protein, 241 aa, Shigella flexneri
MATVSMRDMLKAGVHFGHQTRYWNPKMKPFIFGARNKVHIINLEKTVPMFNEALAELNKIVSRKGKILFVGTKRAASEAVKDAALSCDQFFVNHRWLGGMLTNWKTVRQSIKRLKDLETQSQDGTFDKLTKKEALMRTRELEKLENSLGGIKDMGGLPDALFVIDADHEHIAIKEANNLGIPVFAIVDTNSDPDGVDFVIPGNDDAIRAVTLYLGAVAATVREGRSQDLASQAEESFVEAE

SEQ ID NO: 18150 - protein, 483 aa, Arabidopsis thaliana
MSGVVRSSPGSSQPPPPPPHHPPSSPVPVTSTPVIPPIRRHLAFASTKPPFHPSDDYHRFNPSSLSNNNDRSFVHGCGVVDREEDAVVVRSPSRKRKATMDMVVAPSNNGFTSSGFTNIPSSPCQTPRKGGRVNIKSKAKGNKSTPQTPISTNAGSPITLTPSGSCRYDSSLGLLTKKFVNLIKQAKDGMLDLNKAAETLEVQKRRIYDITNVLEGIDLIEKPFKNRILWKGVDACPGDEDADVSVLQAEIENLALEEQALDNQIRQTEERLRDLSENEKNQKWLFVTEEDIKSLPGFQNQTLIAVKAPHGTTLEVPDPDEAADHPQRRYRIILRSTMGPIDVYLVSEFEGKFEDTNGSGAAPPACLPIASSSGSTGHHDIEALTVDNPETAIVSHDHPHPQPGDTSDLNYLQEQVGGMLKITPSDVENDESDYWLLSNAEISMTDIWKTDSGIDWDYGIADVSTPPPGMGEIAPTAVDSTPR

SEQ ID NO: 18151 - protein, 349 aa, Thermoanaerobacter tengcongensis
MKALLLAGGLGTRLRPLTDDLPKPMVPIMGKPLLERIILNLKKSGVDEVVISTHYKSDYIENYFKGKSKELGVKIHYVTEETPLGTGGAIKNAEKFFDDTFLILNSDIVSDIDYADLVKYHKRRRAQVTIASIEVRDTSQYGVIEFDSKGFITAFKEKPKPGESNSKYINAGVYVFEPEVLKEIPANTQVSVERETYPLLLSKGYKMAIYKFTGYWMDIGTVDKYKKVHEDILKGKSRFVAGLSTRGIILGENVKIHPTASVIGPAYIGDNTEVDAYATVGPYTVIGSNCRIGQESKVSNSVLWDNIKVRRFARLENSVVTSECVVEVNMEIKNTVFTANKLADITLTP

SEQ ID NO: 18152 - protein, 131 aa, Bacillus cereus
MKIALIAHDKKKNDMVSFAYAYKPIFEQHELFATGTTGLRIMEATGLVVTRYQSGPLGGDQEIGAMIAKNDLDMVIFFRDPLTAQPHEPDVNALLRLCDVYAIPLATNMASAEMLMHALERGDLDYRKLRK

SEQ ID NO: 18153 - protein, 534 aa, Solanum lycopersicum
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTRKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGDL

SEQ ID NO: 18154 - protein, 753 aa, Zea mays
HQLQTSEKRRVGGKLLLYDSCAHSSTVLGNLGGEEEESSGSQRTTHYSWLHGFLTSLCGGDPAMRIVVWFRRDLRVEDNPALAAAARAGGEVVPAYVWSPEEEGPYYPGRVSRWWISQSLNHLDASLRRLGAGKLVTRRSADAAVALLQLVRDTGATHVYFNHLYDPISLVRDRRLKEMLAAEGIVVQSFNSDLLYEPWEVVDDEGQPFTMFDPFWNRCLSMPYDPPAPLLPPKRINSGDLSMCPSEDLIFEDESERGSNALLARAWTPGWQNADKALTAFLNGPLADYSVNRKKADSASTSLLSPHLHFGELSVRKVFHLVRMKQLVWSNEGNHAAEESCTLFLRSIGLREYSRYLSFNHPSSHERPLLAHLRFFPWVVDESYFKIWRQGRTGYPLVDAGMRELWATGWLHDRIRVVVASFFVKVLQLPWRWGMKYFWDTLLDADLESDALGWQYITGSLPDGRELDRIDNPQFEGYKFDPHGEYVRRWIPELARLPTEWIHHPWDAPVSVLQAAGIELGSNYPLPIVELDAAKGRLQAALSEMWQLEAASRATMNNGTEEGLGDSSEVLFPQELQMEVDRQPAPAEAAANVHVHVHVPMPARRRGDQMVPTMTTSSLNRAGTEVSADLVVANSEEEDTRAQVPFHAHLHLHPRAEAPPAARRTNNGARQHDAFQQPRNHRRDALLAPSASEASSSWTGREGAVVPVWSPPAASGHSDAFAADEADVSSRSYLGRHPQSHRLMNWSQLSQSS

SEQ ID NO: 18155 - protein, 723 aa, Medicago truncatula
MKLFFFLLCFHFFFSSVFSLSSDGLALLSLKAAVDQSIDGAFSDWNGGDSYPCGWSGISCANISGVPEPRVVGIALAGKSLQGYIPSELGMLRYLRRLNLHDNEFYGVVPVQLFNATALHSIFLHRNNLSGPFPASVCTVPRLQNLDLSDNSFSGDIPNDIQKCRQLQRLILARNKFSGEVPTGVWSELDTLVQLDLSGNDFKGSIPDDIGDLGSLSGTLNLSFNHFSGRIPSSLGKLPPTVNFDLRSNNLVGEIPQTGTFSNQGPTAFLGNKNLCGLPLRKSCTGSDRGSSSSSSHRNESDNRSKGLSPGLIILISAADVAGVALVGLVIVYVYWKKKDGHNVWCCIRKRIGFGNDNEDEKGSACTLLPCINSLKNEEGNDESEVDVDGGGKGEGELVTIDKGFRIELDELLKASAYVLGKSALGIVYKVVLGNGMPVAVRRLGEGGEEKYKEFVAEVQTIGKVKHPNIVRLRAYYWAHDEKLLISDFISNGNLNNALRGRNGQPSTNLSWSTRLRIAKGIARGLSYLHEFSPRKFVHGDIKPTNILLDNDLEPYISDFGLNRLISITGNSPSTGGFMGGALPYMMKSSHKDSRFSSDNGRGNNYKAPEARVPGCRPTQKWDVYSLGVVLLELLTGKSTESSPTSASSSASVEVSDLVRWVRNGFDQESPLSEMVDPSLLQEVRAKKEVLAVFHVALSCTEGDPEVRPRMKTVFENLEKIGR

SEQ ID NO: 18156 - protein, 563 aa, Saccharomyces cerevisiae
MSEITLGKYLFERLKQVNVNTVFGLPGDFNLSLLDKIYEVEGMRWAGNANELNAAYAADGYARIKGMSCIITTFGVGELSALNGIAGSYAEHVGVLHVVGVPSISAQAKQLLLHHTLGNGDFTVFHRMSANISETTAMITDIATAPAEIDRCIRTTYVTQRPVYLGLPANLVDLNVPAKLLQTPIDMSLKPNDAESEKEVIDTILVLIKDAKNPVILADACCSRHDVKAETKKLIDLTQFPAFVTPMGKGSIDEQHPRYGGVYVGTLSKPEVKEAVESADLILSVGALLSDFNTGSFSYSYKTKNIVEFHSDHMKIRNATFPGVQMKFVLQKLLTAIADAAKGYKPVAVPARTPANAAVPASTPLKQEWMWNQLGNFLQEGDVVIAETGTSAFGINQTTFPNNTYGISQVLWGSIGFTTGATLGAAFAAEEIDPKKRVILFIGDGSLQLTVQEISTMIRWGLKPYLFVLNNDGYTIEKLIHGPKAQYNEIQGWDHLSLLPTFGAKDYETHRVATTGEWDKLTQDKSFNDNSKIRMIEVMLPVFDAPQNLVEQAKLTAATNAKQ

SEQ ID NO: 18157 - protein, 718 aa, Marchantia polymorpha
MPQNKKPPTGAASKAYSVHQPNIFSREVQLSRNTRGSLEIFGGGPQTSSLLFSRTRSAWKDALHCAEPVSEGSVSCNKDTIRPTLAEASSSPKIPTVSLTEDLMDGGPIDNLAVDSREDDVSKWLADAGKSVESPKSSMSYQARLSDCLGEDSEFSDSYMRSVVSIMSDSSVAPDRSVRDLEWDGVLPTQMETNVTRTPDWSNEVVSQRAVQWGYGVVLKPTLSRGSGSAETERISRLSWTTGASDASSGMGTSSRTTSEGSSGESTFSSIIPGVSRNVKEALTSFQLAFVVCDALNPEYPVLYASAGFFSMTGYTAKEVVGRNCRFLQGQYTDAKDIEMIRDALVNRKSFSGKLLNYKKDGIPFWNLLTISPIKDEEGRIIKYIGMQAEVTENGRTSSSMNEEPISAYASRISSAELRDGSLDISGSPLPSVKHGSATVCHPSCPSAREFDFDSPAVNRYSLSSSRHSMDARSKSISSQKSVRVSAENFASSPGIAPRVNIIDVEEPSVRSECGSIDTSKSGKRTSGIIRLFKKLNGKFSSPKGGLRDKNDGLLNSTKVFVDEVFNFDDEESETDDVERKERRSGIDFNTSSFTQSDGMCRGRGSSQSRTSPDKQPACGKSGDTAGIRGQNDLHLGIEQHCDFHTSQKPVQGNRRLALGTGRRSAQHVTTEGRLNELKVYTMEKDRRHSVASMPSSGTDVNVNGKSQFCIVHQKSPS

SEQ ID NO: 18158 - protein, 238 aa, Picea glauca
MEHLNTAAAQASSSLYGVGMAEYGDAGVSSMMALITQHEPHDSESIMSTRMPSSFSSFHGHADCLLSAAMFQAYQGDHKLKRQPGMDQLVSEQPGMSDSSMPSVKTEVCSGLRNQFEFHREQTGNCYTDQSSNTPVNPLVTSLASQARGEAQMIPSLDANSPHFNVDNEEYAIKSKILAHPQYPSLLGAYIDCQKIGAPPEAVARLDALTREYQNQQRRTVSIGMDPELDQFMEAYCE

SEQ ID NO: 18159 - protein, 712 aa, Marchantia polymorpha
MPLLKKPPTGASSKAYSVHQPNIFSREVELSRNTRGSLEIFGGGPQTSPLLFSRTRSAWKDALQCAESHLQEHDTGKVVPSVSGTSPPSSQRPLISGSGDHPSVVSSAALYPRCCVQDDVSKWLTDAEVSGDTSELPSSVSRPLEFVSDTRDNTDVNLEASSKTLSGYPVEPTKTRVEQDWDEVLKHRRGKKISGFSEISDEALSERAAQWGYGVVLKPSNNRGSGSAETEGISRLSWTTGSSDTSSALGKSSRTTSEGSSACSSFSPMIPGLSKNVKEALASFQLAFVVCDALNAEYPILYASAGFFSMTGYTAKEVVGRNCRFLQGQYTDAHDIAMIRGALREGNIYTGKLLNYKKDGSPFWNLLTISPIRDDGGRLIKYIGMQAEVTESAAIGKALDQNGVPADVKNLFEAGRKKTKDNRTAGGVTSETRVHRKISEESNCQRTSRSQYSLSSSRQSFEVSSNVTLALDVHTPLKTGTEVAAFSAEAVDSGGFLEVPKALRGESSCMVDTKNTKRTSSLLKMFKKLNGRFSKRGSRDYSHEDPIAVEDHNDVVSDPDDEDVDDFEGKQRRSSFYSSTESLVGKQELDQTSEFMRVGKTNRQSRQFSEERRDCAGRMDCEIPLRQERFSGDHSRPGSSEHGIGRKVVSYGRRSAEYPVGAVNAFLKNEGLASHAIDRRHSIATVPSVTRPSFSVDGKSQFCIVHPTAPGH

SEQ ID NO: 18160 - protein, 88 aa, Zea mays
  misc_feature (58)..(58): Xaa can be any naturally occurring amino acid
ACPSAAVPSLTTDSEKKGPVIMEIPLDQIRRPLMRTRANDPVKVQELMDSIRVIGLQXFSGCHRYEAHQRLGLPTIRCKVRRGTKETL

SEQ ID NO: 18161 - protein, 378 aa, Oryza sativa
MGGLSMDQAFVQAPEHRPKASVAEADGIPVIDLSPLLAAGDGDADGVDALAAEVGRASRDLGLLRGVAPRCARGGVGARGGGAEDVLRAAAGAEGGRGAERGGADGVLRVRAHQERQGLEGGVRPRPAPDAAAADDRRGRRRPGVRQQVARRPAGIQVRSPHRSIVFFILASIQFNLIEFLSREAMEEYGEAVEELAFKLLELIARSLGLRPDRLHGFFKDDQTTFIRLNHYPPCPSPDLALGVGRHKDAGALTVLYQDDVGGLDVRRRSDGEWVRVRPVPHSFIINVGDIIQVWSNDRYESAEHRVAVNVEKERFSIPFFFNPAGHTMVEPLEEVVSDESPARYNPYNWGEFFSTRKNSNFKKLDVENVQITHFRKN

SEQ ID NO: 18162 - protein, 333 aa, Enterobacter cloacae
NGVAGSYAEYVPLLHIVGAPCSGVQQRGELLHHTLGDGDFHHFYRMSEPVTAARAILTAQNACYEIDRVLEVMLMQSRPGYLMLPADVAKKPATPPVNALTTPPFPVNEACLNAFRQHAQAMLSVGSSVALLADFLAAFGFIQMLQCWMTDQLPTHTTVILGKGIVKRKHGGFSYPYHGAGGQRGPVPAIEGADTVICIGTRFTDTVTAGFTQQFARERTIEIQPFAARVGDVWFSGIPMREAINALIPLVRARAHAAANHRPPQAARAPVHQGTLNQETLWQTVQQFIRPDDILLADQGTAAFGAASLRLPAGAELLVQPLWGSIGYTLAAA

SEQ ID NO: 18163 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEESALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQGQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRSAVLPANLIQAQRDYFGAHTYKRIDKEGVFHTEWLD

SEQ ID NO: 18164 - protein, 240 aa, Asparagus officinalis
MDQPDLSQVGPVGLTQLSPLQIQQIQAQIQLNHQHQLMVSRTLQARNYHNTLGVKPQPMKLQASVAAPQSKPTKLYRGVRQRHWGKWVAEIRLPKNRTRLWLGTFDTAEEAALAYDKAAYKLRGDYARLNFPNLKHTHLAGNPLHSSVDAKLEAICQTLESPGKKKVSTGSKPEPVVSSPTVETEEESSSSSSVTGATNSPVSEIESLDFNEVPWDETEDFVLRKYPSYEIDWDSILSSA

SEQ ID NO: 18165 - protein, 422 aa, Acidobacteria bacterium
MTTAEQFDKELNPWEQQAARFDTATTKLKLDEGLISVLRVPAREVTVNIPVSMDTGKIRMFTGYRVQHSFARGPAKGGVRFSPEVSLDEVRALAAWMTWKCAVVNIPFGGAKGGIICDPKTMSMGELERMTRRYTAELMEFIGPEKDVPAPDVNTNEQTMAWMMDTYSMHMRMTVNAVVTGKPLNMGGSRGRREATGRGVMITADQCLKKFNMSRESTRVIVQGFGNVGSNAAQLMHQAGYKVIGIGEWDGGLHNVNGIDINALVDYKAHNGSIHGFPGAEKAATADLMIADCDVLIPAATENVITTKNAEKVKARIIVEGANGPTTSGADEILNDKKVFVMPDILANAGGVTVSYFEWVQDRQGYFWKESVVNEQLEHIMVSSFEDVVNMSEQHNVPNRIGAYMLAIDRVAYTIRQRGIYA

SEQ ID NO: 18166 - protein, 647 aa, Unknown
  Bradyrhizobium sp. BTAi1
MCGLAGVWCWDTPIDRPAIARALGLLDHRGPDGNGLWISEDGKVALGHTRLSIIDLVTGEQPLSHPNGKLQLVVNGEFYDYERIRNDLTARGARFRTRSDSEIALWLYDESGTRCFADLNGEFAFILWDAGAGRLIAARDRFGIKPLFYAVQSGRILLASEIKALLAMGVPAQWDVEGYLDAAHVLQNGTLFSGIRQVPPGCYLSATRHGITIQRYWDAPFASALSPIEDEHGALDQIRAQMSRATRWRMRADVPVAAYLSGGIDSMSVLALAAATTNRAPDAFTIAYEDAAYDESHRAESFATQLGTRFHRVPVNGAALADHFATSLWHSETACFNPHGTAKFILSKAVRDAGYKVVLTGEGADEIFAGYAPSRVDALGGSAAMQAMIATRDRATYAVTPQHTATDQLPLIAQRFGTVPTWLRHQMAHLLGVADLLRDDLRTAWSTDRPLAAFLKYLEPWTVPALDTVDLGIALMLKTTLPNYVLVTLGDRMEMAHSIEGRLPFLDHQVVELAWRLPSHLKIRDGVEKFALRQAMRNLLPADAVDRQKHPFIAPPTATDAKHPFGAMIRDVLHGPALAALPFFEPRKVRKLIDRLTSLPPEDRLRLEPLLVEIASLCIIHDLFKMSSSSDPSAQLSIQMPSTEALA

SEQ ID NO: 18167 - protein, 262 aa, Pyrococcus horikoshii
  misc_feature (1)..(1): Xaa can be any naturally occurring amino acid
  misc_feature (9)..(9): Xaa can be any naturally occurring amino acid
  misc_feature (73)..(73): Xaa can be any naturally occurring amino acid
  misc_feature (144)..(144): Xaa can be any naturally occurring amino acid
  misc_feature (174)..(174): Xaa can be any naturally occurring amino acid
  misc_feature (181)..(181): Xaa can be any naturally occurring amino acid
  misc_feature (248)..(248): Xaa can be any naturally occurring amino acid
XVKVGYIQXEPKILELDKNYSKAEKLIKEASKEGAKLVVLPELFDTGYNFESREEVFDVAQQIPEGETTTFLXELARELGLYIVAGTAEKSGNYLYNSAVVVGPRGYIGKYRKIHLFYREKVFFEPGDLGFKVFDIGFAKVGVXICFDWFFPESARTLALKGAEIIAHPANLVXPYAPRAXPIRALENRVYTITADRVGEERGLKFIGKSLIASPKAEVLSIASETEEEIGVVEIDLNLARNKRLNDXNDIFKDRREEYYFR

SEQ ID NO: 18168 - protein, 239 aa, Zea mays
MEEELTLVGYWSSPFALRARFALNLKGLPYAYVEEVGLFDGKSPLLLASNPVHKRVPVLIHNGKPVPESQLIVQYVEEAFPASSPRFLPPDPHERAVARFWASYVDGELLSAWLPVYGGRTGEERAEAAGRVGAALETLERAFGECSKGKGFFGGDTVGLVDVVLGGFVGWLQTSEAMCGVRLLDAAATPLLAAWAERFRALDGVKEVMPDAQRLLEYNLMRRARLGLPLTQPPPPQHQ

SEQ ID NO: 18169 - protein, 330 aa, Broussonetia papyrifera
MKALEPFMKSAHNNINNNISPISSSSSSSYLSSEPNFYPESETCSPSTTQMFSSGLFSSFNHMGSEQTGSLGLNQLTQSQILQIQAQIYFQQQQQQQQNLLMTTITPPQNSLNYLGPRAVPMKNVGANSKPNKLYRGVRQRHWGKWVAEIRLPKNRTRLWLGTFDTAEEAALAYDKAAYKLRGDFARLNFPHLRHEGAHVSGEFGEYKPLHSSVDAKLQAICQSLANSQKQGSAKEACSEPEVKPVIEPKMASDNSPKGELEVSSSSLSSSSSLSLSLSLSSPLSDESSAGSSSPESDVTLLDFSDSHWDGNENFGLGKYPSVEIDWDAL

SEQ ID NO: 18170 - protein, 476 aa, Bacillus clausii
MAQKGTVYLIGAGPGDCGLLTAKGLDILRQADVLLYDRLVNPLLLEETKPGAELLYAGKLPNRHILRQEAIHDEMVRHAQKGKCVVRLKGGDPSVFGRVGEEAAFLDEYAIPYEIVPGVTAGIAAPAYAGVPVTHRLHGANFAVATGHSRRDTGLPEIDWNGLASIDTVAFYMGIKHLPTIAENLITHGRPKDEKVLLIQWGTTSKQRTLTADLGTIARKAEAEQFTNPAIALIGDVAALNQGKSWFERKPLFGSFPLIANSDGAAQLASLLKEEGAETFVYPRFHEVEEEAPLIHWETATDIAFYEEKDVIVFFRWLQKRGLDIRTLSAQFSGETDSAVQALQQRGLAPVQGSRPIGSDRLFLSRGGLGGKPGWKHIQTRERTVAPSTQTTINRLLDEGHLTDLVFLSRESVECFCEAFAAIGREKEISELTVLCLSDEAEKAAISYGLSPQIKQSVLSAWMEGNYAGDFICGPR

SEQ ID NO: 18171 - protein, 573 aa, Candida albicans
MCGIFAAYRQPEVEDFKSKALQYSKLIRHRGPDWSGNVVQNSTILCHERLAIVGLDSGAQPIVSPDGNFTLAVNGEIYNHIQLREQFPDYKFKSLSDCEPIIPLFTKYDIDAPKHLDGMFAWVLYDKKNDRIVAARDPIGITTLYMGKSSKSPKTRYFASELKCLIEECDEIFAFPPGHVYDSNTDEITRYFQPSWWDASKVPEQHVDFKKVRETLELAVRKRLMAEVPYGVLLSGGLDSSLIASIASRETKKAAQASFNPEGIDANKELSGVDDKGSLHSTGVFNQLHSFAIGLPGAPDLLAAEKVAHFIGTIHHSHTFTLEEGLDALDDVIYHLETYDVTTIRASTPMYLLSRKIKAQGVKMVLSGEGSDEIFGGYLYFANAPSAKEFHEECVKRVKNLHYADCLRANKSTMAWGLEARVPFLDKQFLEVCMNINPEDKLIQPGKIEKYILRKAFDTSDEPDVKPYLPEEILWRQKEQFSDGVGYSWIDGLKDTAEKMVSDEEFAHPKPEWGDDIPTTKEAYWYRCKFDKMFNGSKAAASTVMRWIPKAEWGCHADPSGRYAATHDHKVAQ

SEQ ID NO: 18172 - protein, 582 aa, Caulobacter crescentus
MTGAEIVVRGLVDQGVEVLFGYPGGAVLPIYDALFHEPRLQHILVRHEQGAAHAAEGYARSSGKPGVVLVTSGPGATNAITGIMDALMDSIPMVVITGQVPTHLIGTDAFQEADTVGMTRSCTKHNYLVKDVRDLPQIIHEAFKIATTGRPGPVLIDIPKDVQFAKGEYFGPGEVASTHAYAPRTKGDAGRIAEAARMIAQARRPIFYTGGGVINAGPKASAALREFAALTGAPVTSTLMGLGAFPAADPAWLGMLGMHGTFEANNAMHDCDVMICVGARFDDRVTGRLDAFSPGSKKIHIDIDPSSINKNVRVDLPIVGDAGSVLEDLIAAWKAANLQPNKAALTDWWAQIDQWRARQCLSYRRSDSVIKPQYAIERLYELTKDKDVYITTEVGQHQMWAAQFFRFEEPNRWMTSGGLGTMGYGLPAALGVQLAHPNSLVVDIAGEASIQMCIQELSTAIQFDLPVKIFILNNEWMGMVRQWQQLLHGERYSHSYSDSLPDFVKLAEAYGAVGIRCDNPAELDAKILEMVNSDKPVIFDCRVEKHENCLPMIPSGKAHNEMIMGEVEDIGNVIGEDGAGLV

SEQ ID NO: 18173 - protein, 221 aa, Oryza sativa
MSRRGDWVYENNGGTCVAIAGADYCVVAADTRLSVGYNILTRDHSKICELADKCALASSGFQGDIKALHKNLAARELLYQHQHNKRMSCPAMAQLLSNTLYYKRFFPYYAFNVLGGLDSEGKGCVFTYDAVGSYERTGYSAQGTGSALIMPVLDNQLKSPSPLLLPARDAVTPLSETEAVDLVKDVFASATERDIYTGDKLEIVVINKAGTKREYIDLRKD

SEQ ID NO: 18174 - protein, 480 aa, Pseudomonas putida
MHLTWLRSDLRIDDNTALSASTERGPTIALWLVSPGQWQAHDDADCKVDFWLRNLHDLRQSLEKLNIPLLIRTIDTWDQAPQAVLDICRQHQVQSVHWNEEYGINEQRRDDATRAMLEKSAIQAHSHLDQLFFRPGTVLTRSGDYFQVFSQFKKTCLEHLHRSLPALARRVKRQAPLNIGSDPIPQHVEGFGKTTPALRDHWPAGEAEAQSRLSRFLDETIDDYHHLRDLPAKPGTSQLSPYLAAGVISPRQCLHGALAGNRGEFDSGSTGVQTWINELLWREFYKHILSGYPQVSRHRAFRAQTEALPWRDAPADLAAWEQGRTGFPIIDAAMRQLLHTGWMHNRLRMVVAMFLSKNLLIDWRKGERHFMRHLIDGDLAANNGGWQWSASTGTDAVPYFRIFNPVSQSQRFDPQGRFIRHWVPELQELDEKAIHQPIKSTDLFGNTSYLSPIVDLSSSRQRALEAFKGLPRRQNQGITS

SEQ ID NO: 18175 - protein, 207 aa, Brassica napus
STHASGNLPGVQKLLLDGNKFEGPIPSEVGKLQQLSKIDFSHNLFSGGIAPEISRCKLLTFVDLSRNELSGEIPKEITGMRILNYLNLSRNHLIGSIPGSISSMQSLTSLDFSYNNLSGLVPGTGQFSYFNYTSFLGNPDLCGPYLGPCKDGGAHQSHSKRPLSASMKLLLVLGLLVCSIAFAVAAIIKARSLKKASESRAWKLTAF

SEQ ID NO: 18176 - protein, 633 aa, Unknown
  Phalaenopsis hybrid cultivar
MEGCDCIEPQWPADELLVKYQYISDFFIALAYFSIPLELIYFVKKSSFFPYRWVLIQFGAFIVLCGATHLINLWTFTMHSRTLAIVMTVAKVSTAVVSCATALMLVHIIPDLLSVKTRELFLRNKAEELDKEMGLIRTQEETGRHVRMLTHEIRSTLDRHTILRTTLVELGRTLDLAECALWMPSRTGLNLQLSHTLNNQIPVGSVVSINLPVVNQVFNSSRAVRIPHTCQLARFQPHTGRYVPPEVVAVRVPLLHLSNFQINDWPELSAKNFAVMVLMLPSDSARKWHVYELELVEVVADQVAVALSHAAILEESMRARDQLMDQNVALDLARREAEMAIRARNDFLAVMNHEMRTPMHAIIALSSLLLETELTPEQRLMVETILKSSNLLATLINDVLDLSKLEDGSFELEVTVFNLHTVFREVVNLIKPIAAVKKLSLIVSLSPDLPSCAVGDEKRLMQTMLNVVGNAVKFTKEGSISITASIAKPDSLRDPRDPEFYPIPSDGHFYLRVQIKDTGCGISPQELPHLFTKFAHAQNGSDKGYNGSGLGLAICKRFVNLMKGHIWLESEGIGKGCTTIFIVKLGISEDPAHRYQHKLLPPIRAGQSEADAFGSKRMPTDLIPLKNRYQRSL

SEQ ID NO: 18177 - protein, 281 aa, Pyrococcus furiosus
MERAFIEWYPRGYGVAFKIKKKIYEKLSKYQKIEVYETEGFGRLLALDGTVQLVTLGERSYHEPLVHPAMLAHPKPKRVLVIGGGDGGTVREVLQHDVDEVIMVEIDEDVIMVSKDLIKIDNGLLEAMLNGKHEKAKLTIGDGFEFIKNNRGFDVIIADSTDPVGPAKVLFSEEFYRYVYDALNNPGIYVTQAGSVYLFTDELISAYKEMKKVFDRVYYYSFPVIGYASPWAFLVGVKGDIDFTKIDRERAKKLQLEYYDPLMHETLFQMPKYIRETLQRL

SEQ ID NO: 18178 - protein, 364 aa, Arabidopsis thaliana
MDNFLPFPSSNANSVQELSMDPNNNRSHFTTVPTYDHHQAQPHHFLPPFSYPVEQMAAVMNPQPVYLSECYPQIPVTQTGSEFGSLVGNPCLWQERGGFLDPRMTKMARINRKNAMMRSRNNSSPNSSPSELVDSKRQLMMLNLKNNVQISDKKDSYQQSTFDNKKLRVLCEKELKNSDVGSLGRIVLPKRDAEANLPKLSDKEGIVVQMRDVFSMQSWSFKYKFWSNNKSRMYVLENTGEFVKQNGAEIGDFLTIYEDESKNLYFAMNGNSGKQNEGRENESRERNHYEEAMLDYIPRDEEEASIAMLIGNLNDHYPIPNDLMDLTTDLQHHQATSSSMPPEDHAYVGSSDDQVSFNDFEWWG

SEQ ID NO: 18179 - protein, 389 aa, Streptomyces albus
MTAGQAGRGAGADEVRAVLLAGGEGRRMGPLGTGRLKPLIPFGGTSRLIDFSLANARRSGLSEVLLLSQYEEQRLMDDLHQVWNSSRGFRVHFGPYDEAYRRLPADELPEKLPEPGGPRERGTADAFLHKAAHVFGGRPSEILILHADHVYRFDYRDMLREHRASGAALTLAYQRIERRYVHLFGMVEFDAGGNLTNFVEKPAEPSSDLVFAAFCVFDSACLQRYLERLDGTDWQHDISRDVIPAMLAGGERIRGHLVRGHWEDIGTVDRYLRAHLALLADPPTLPLDRMPLTIRPEVPRRFLSSAAGVRSSLVPSDVRNAGLVERCVLFPGVRIGEGATVRDSVLLPGAEVPAGARIDASIVLEDGSVQPVGPDRPEDASARTCPGIG

SEQ ID NO: 18180 - protein, 73 aa, Thermobifida fusca
MAKKDGAIEIEGTVIESLPNAMFRVELDNGHKVLAHISGKMRMHYIRILPDDRVVVELSPYDLTRGRIVYRYK

SEQ ID NO: 18181 - protein, 775 aa, Cryptococcus neoformans
MSPPASPPPLWISLWMLFTTLIVSWDAGYCLMRPRSLPGGDLSWIWKPYNDFPYGEIDYLYGWKAFNEEDGFTAAQALLNVVEIFLAIGYLYLQHISPRDKPLHAVAPLIGFAGTVMTASKTILYFLQEYFCGWCNVGHNDRRTFWMVWVIPNGTWIILPTIVSIVLGRYIAVALKRDAVYSPVSTSLLRAEFLAEKLASTLTEEPTQLPAALPLTFHPRTLSVLIVGSNRLAASRALTFLEADAKVFLLTSSEEVAKEVKELEEGGRVSLLQNTASDSVAWSELLTKHDISLACVTDTLISTPSRRSLASATIIYQTCLSLHIPVNISDQPHFSTYTFPSVHRFAGADGPSHLQVAVSTNGQGCRMSGRIKREIVSRLPADISEEDDGPLNTPVPQLPTPSISRRNSEEVTQQLSDEEQQLRRMRWVYQMSEYYSFEHLAKISNEEMDKALDIWGQRNEGYLPHHDVKTVNASEKKGRILLIGSGPGHPGLLTMAAHTALRTATLILSDKLVPAEILALIPDSTKLHIAKKFPGNAEGAQNEMMELALEGAQRGETVVRLKQGDPFVYGRGGEEVLYFRQHGFESTVIPGISSALAAPLMMGIPVTQRGVAESLVLCTGVGRQGKAVQLPGYVKSRTLVMLMGVARISQIIEVLTSTTATTASGRDGAAYPPHLPIAVIERASSPDQRVILSTLEKIQPALKQVDERPPGMMLVGWAALALEGKGRVDVLDRSEDDEFEMVESWLAEGQEGEIKGWKVREGLNDEWRGILNGII

SEQ ID NO: 18182 - protein, 128 aa, Mycoplasma mycoides
MSREITREELSAAGVQYGHQTKRWNPKMKSYIYGVKNKNHIIDLEKTITHLNTAQKLLETLGSKQQKILFVGTKRSGKNAVKEAALRSGNFYINNRWLGGTLTNLKTILIRIKALWEIEEEKKKVVYL

SEQ ID NO: 18183 - protein, 372 aa, Mycoplasma mycoides
MKKKDYYEVLGVSKTASEQEIRQAYRKLAKQYHPDLNKSPDAHDKMVEINEAADVLLDKDKRKQYDQFGHNAFDGSSGFSSNFADFEDLFSNMGSSGFSSFTNIFSDFFGSNKSDYQRSTKGQSVSVDIYLTFKELLFGVDKIIELDLLTNCSVCFGSGAESNSDISICNNCHGTGEVLIQKNMGFFQFQQSAKCNVCNGAGKIIKNKCKNCKGKGKYLERKKIEVNIPKGIRPNQQIKLSQKGHASINNGVNGDLIIDIYLKESKVFEIVNNNDILMTYNISYLDAILGNEIIIKTLDGDIKYKLPKSINSNEFIIINNKGLYKSINKDKRGDLIIKVNIVVPKNLNKKEKELIEQIYEQTSFNPENNIDQ

SEQ ID NO: 18184 - protein, 67 aa, Zea mays
MAKFNVVQKKRRALIADKKRQLHGDPLTGKLKIKDQPLSLSGKRRRKLFKKWRRDHKDALQNGLVHM

SEQ ID NO: 18185 - protein, 559 aa, Unknown
  Mycobacterium sp. JLS
MRKIETGDLWWKNAVFYCADIETFYDWNGDGTGDIRGMTERIEYLFDLGVTCLWLMPFYPTARKDDGYDIIDFFGVDQRLGNLGDFVELVRTARSKGIRVIVDFVMNHTSDAHPWFKSARRSKDDPYRDYYVWSETEPKSSPADVVFPDQEDSIWEQEPKTGEWYLHHFYKHQPDLNIANPKVQEEISRTLGFWLQLGVSGFRVDAVPFLFARDGVPGDPGVFDPYEYLGDVRNFVNRRVGDAVLLGEVNVPYDDQKSFFGGPDGDGLNMQFDFIGMQNMYLSLARGDAGPIAAALRERPPLDETSQWANFVRNHDELTLDKLGDAERQEIFDAFGPEPDMQLYGRGLRRRLPAMLGGDERRMRMVYSLAFSLPGTPVLYYGEEIGMAENLDIPGRFAVRVPMQWTSDDNGGFSRAAARRLPRPITDGLYGPDRVNVADQRHDHQSFWWFIRDLIYTYRQQPEIGWSTAEVLDQPNPAVLAHCCREKSGWTMVGLHNFGADRCMVPIQIEDAPEGSTLVDLLDGLSVHELDAKGRLEIGLDGYGYRWLRLVRPGDDPII

SEQ ID NO: 18186 - protein, 449 aa, Triticum aestivum
SFNNLAGVVPTDNNFSRFSPDSFLGNPGLCGYWLASCRSSTHQEKAQISKAAILGIALGGLVILLMILIAVCRPHSPPVFKDVSVSKPVSNVPPKLVILNMNMALHVYEDIMRMTENLSEKYIIGYGASSTVYKCVLKNCRPVAIKKLYAQYPQSLKEFQTELETVGSIKHRNLVSLQGYSLSPVGNLLFYEYMENGSLWDVLHEGQSKKKKLDWETRLRIALGAAQGLAYLHHDCSPRIIHRDVKSKNILLDKDYEPHLTDFGIAKSLCVSKTHTSTYVMGTIGYIDPEYARTSRLNEKSDVYSYGIVLLELLTGKKPVDNECNLHHSILSKTASNAVMETVDPDIADTCQDLGEVKKVFQLALLCTKKQPSDRPTMHEVVRVLDCLVHPDPPPKAAQPQPPTGPSYANEYVSLRGAGTLSSSCANSSSTSDAELFLKFGQAISHNTE

SEQ ID NO: 18187 - protein, 715 aa, Streptomyces coelicolor
MTRARPNWKGSPVWSGHPYPLEAAYDGQGTNFALFSEVAERVDLVLVDDDGNHSTVPLPDVDGFVWHCYLPGVGPGQRYGYRVHGPWAPAVGHRCNPAKLLLDPYTRAVDGLVDNHASLFERARGKADPGDSAGHTMLGVVTDPFFDWGDDRPPRRPYSESVIYEAHVRGLSRTHPDVPEELRGTYAGLAHPAVVDHLTSLGVTAVELMPVHQFVHDGVLLDRGLSNYWGYNTIGFFAPHNGYAALGTRGQQVSEFKSMVKTLHEAGLEVILDVVYNHTAEGNERGPTLSFRGIDNASYYRLVDGDWQHYYDTTGTGNSLLMRHPYVLQLIMDSLRYWVTEMHVDGFRFDLAATLARQFHEVDRLSAFFDLIQQDPVISRVKLIAEPWDVGEGGYQVGNFPQLWSEWNGKYRDAVRDFWRAEDHSLGEFASRLTGSSDLYQHSRRRPRASVNFVTAHDGFTLRDLVSYNDKHNEANGEDNRDGESHNRSWNCGAEGGTKDPAVRELRGRQQRNFLATLLLSQGIPMICHGDELGRTQRGNNNAYCQDNEISWIDWRLDGEQRALLDFARRLIALRADHPVLRRRRFFHGETLTHADQPLPDLVWLLPDAREMTDDDWQRSDAHTVGVFLNGDAIAEPDPRGRPVVDDSFLLLLNSHWEPADFRLPDAGYGERWTALVDTGDPDGVPDEAEHKAGTRLTVEQRSLVLLSRPSRTGR

SEQ ID NO: 18188 - protein, 366 aa, Prochlorothrix hollandica
MNNSLNVSATLDLANGLRNFWYPVEFSKNLGMADPLGFELFDQCWVLFRDDQGTAACILDECAHRACPLSLGKVIQGRIQCPYHGWEYDRQGECVHMPSCQAISNPILTLPVMEQGGMIWVWPGTDEPGALPSLAPTLPDNFTLQAELVMDLEVEHGLMLENLLDLAHAPFTHTGTFAKGWPVPPFVRFANAATTPWTGHWDPYPIHMTFEPPCFVISTIGLRGKDCGRHLHQVHACLPRGQGRTRLLYRLALDFGHWLRWVPGTHCLWQHLANRVIQEDLRLVQGQQERLKGGANVWNQPVGYDKLGVAYRHWRNQVERHGSDWPESPADEGREPALNAIVTGSDAPITGSVVSLPPSQAPPTGH

SEQ ID NO: 18189 - protein, 710 aa, Streptococcus pyogenes
MSKQTFTTTFAGKPLVVEVGQVAKQANGATVVRYGESTVLTAAVMSKKMATGDFFPLQVNYEEKMYAAGKFPGGFMKREGRPSTDATLTARLIDRPIRPMFAEGFRNEVQVINTVLSYDENASAPMAAMFGSSLALSISDIPFNGPIAGVQVGYIDGEFIINPDKEQMEASLLELTVAGSKEAINMVESGAKELSEDIMLEALLKGHQAIQELIAFQEQIVAVVGKEKAEVELLQVDADLQADIVAKYNAQLQKAVQVEEKKAREAATEAVKEMVKAEYEERYAEDENLATIMRDVAEILEQMEHAEVRRLITEDKIRPDGRKIDEIRPLDAVVDFLPKVHGSGLFTRGQTQALSVLTLAPMGETQIIDGLAPEYKKSFLHHYNFPQYSVGETGRYGAAGRREIGHGALGERALEQVLPSLEEFPYAIRLVAEVLESNGSSSQASICAGTLALMAGGVPIKAPVAGIAMGLISDGTNYTVLTDIQGLEDHFGDMDFKVAGTREGITALQMDIKIAGITPQILEEALAQAKKARFEILDVIEATIAEPRPELAPTAPKIDTIKIDVDKIKVVIGKGGETIDKIIAETGVKIDIDDEGNVSIYSSDQAAIDRTKEIIAGLVREAKVGEVYHAKVIRIEKFGAFVNLFDKTDALVHISEIAWTRTTNVSDVLEVGEDVDVKVIKIDEKGRVDASMKALIPRPPKPEKKEEKHD

SEQ ID NO: 18190 - protein, 266 aa, Aegiceras corniculatum
KEKYEGLITFGDKSRVGRGGMTAKVKAAVYSAQAGIPVVITSGCAPDNIIKVLNGERIGTLFHRDANTWGPSGAVGARDMAVAARESSRQLQAMSPGARSKILLDIASALEANEQNITVENEADVAAAQQAGYEKSLISRLALKPGKISSLANSIRVLANMEEPIGHVLNRTEIASGFVLEKKSSSLGVLLVIFESRPDALVQIASLAIRSGNGLLLKGGKEARRSNAALHKVITSAIPENVGQKLIGLVTSRDEIPDLLKLDDVI

SEQ ID NO: 18191 - protein, 530 aa, Lotus japonicus
MVEIEGSPGTSMHGVTGREQTFISSVSSPMVPTDTTAKFDLPVDSQHKAKVFKLFSLANPHMTTFHLSWISFFTCFVSTFAAAPLVPIIRDNLNLTKSDIGNAGVASVSGSIFSRLTMGVICDLLGPRYGCAFLIMLSAPTVFCMSFVNDAAGYIVVRFMIGFSLATFVSCQYWMSTMFNSKIIGLVNGTAAGWGNMGGGATQLIMPIVYELIRRAGSTGFTAWRIAFFIPGFMHVFMGILVLTLGQDLPDGNLSALQKKGDVAKDKFSKVLWYAITNYRTWIFALLYGYSMGVELTTDNVIAEYFYDRFNLKLHTVGIIAASFGMANLVARPFGGYVSDVAARLFGMRGRLWTLWILQTLGGVFCIWLGRANSLPIAVLAMILFSVGAQAACGATFGIIPFISKRSLGIISGLTGAGGNFGSGLTQLVFFSTSRFSTGAGLSWMGVMIVGCTLPVTLVHFPQWGSMFLPPSKDINKSSEEHYYTAEWDEEERKKGLHSQSLKFAENSRSERGKRVSSAPTPPNTTPTHV

SEQ ID NO: 18192 - protein, 569 aa, Ustilago maydis
MSATNPYAAQAGSTFKEVASPSQPSSPDHQNVEKADSKSVSADGSNEPPAEELRRALGTRHMVMIAIGGIIGPGLLVGSGQALANAGPVGALIAFAITGAIVYFVLQALGEMATLFAIRGSFIEYAGRWVDPALGFVAGWIYWELWISVLANEYNAVAIVIRYWDGAQAVPTGAWIAIFWVLFMGLSMLGVLAYGEVEFVLATVKVIGIVVFFILSIVINVGGAGGDQGYIGFRYFKTPGPFNGSGLDALNGIAKILVVSATLYAGTEATAITAAEAKNPAKAVPIAIRSVFYRILVLYLGTIFFIGLNVPSDDPSLVSAKSKAAASPLTIALKRGGIGAAASLINALIILSVISAGNSSLYIASRTLQSLGATGRAPKIFGWTSATGKVPIPALVLSNLVALISLLSINAGASTVFTYIINISGVSTFVIFAIICLCHIRFRQAWLRQGKSLDELPFKAFLAPYGSWGAFILNIVLMFFQGYTTFLNPRKAADIVVAYIVIPVAVVLYFGWKLWHKTQVVALEDLDLDSGRRLIEDFEPLQDLPDDEVLEKNKPWYKNPKKIFGRILA

SEQ ID NO: 18193 - protein, 112 aa, Desulfovibrio vulgaris
MKKLEIIIRPFKLDEVKEVLASMDVKGMTVTEVKGFGRQRGHKEVYRGAEYQVDFMPKVKIEVVLEDAQVKAVVDAVCKAARTGKVGDGKIFVLPVDDAIRIRTGESGAEAI

SEQ ID NO: 18194 - protein, 218 aa, Candida glabrata
MSNEDYGYDYDYLFKIVLIGDSGVGKSNLLSRFTTNEFNIDSKSTIGVEFATRTIDVDGKKIKAQIWDTAGQERYRAITSAYYRGAVGALIVYDISKSSSYENCHHWLSELRENADDNVAVGLIGNKSDLAHLRAVPTEEAKQFASENQLLFTETSALNSDNVDLAFKELITAIHQKVSKHQVELSNANKPGAGPNGPTISLTPAPNEKKKSSSNNCC

SEQ ID NO: 18195 - protein, 465 aa, Pseudomonas aeruginosa
MDFLPLFHSLQGRLALVVGGGEVALRKARLLADAGARLRVVAPQIHIELRHLVEQGGGELLERDYQDGDQPGCALIIAATDDEPLNAEVSRAANARGIPVNVVDAPALCSVIFPAIVDRSPLVVAVSSGGDAPVLARLIRAKLETWIPSTYGQLAGLASRFRHRVKELLPDLQQRRVFWENLFQGEIAERVLAGRPAEAERLLEEHLAGGLAHIATGEVYLVGAGPGDPDLLTFRALRLMQQADVVLYDRLVAPSILELCRRDAERLYVGKRRAEHAVPQDRINRLLVELASQGKRVLRLKGGDPFIFGRGGEEIDELAAHGIPFQVVPGITAASGCAAYAGIPLTHRDHAQSVRFVTGHLKDGTTDLPWQDLVAPGQTLVFYMGLVGLPVICEQLVAHGRSAQTPAALIQQGTTAQQRVFTGTLENLPQLVAEHEVHAPTLVIVGEVVQLRDKLAWFEGAREDA

SEQ ID NO: 18196 - protein, 691 aa, Rhodopirellula baltica
MVGRLRSVHGFQITCHASRSSPVKQSSAGCPDQQTHCDEFPTLVGFSARRRGESAGTPPSGCSFTIHTTNPGDGSTGHLPEPDRYDFTIGNVFMVNRNLIRSLEDDDILGDLALLAPEDEAEEWLLDAIAAEQQDYNSGKIVDGRIVELNDEWALVDVGFKSEGTVGLDEWGPEEDQPKIGDTVKVLIEEMEDELGAADDPYGMISLSKRKAEKIIEWEAMMETVAEGQVVTGTVIRKIKGGLLVDIGVNVFLPGSQVDIRRPGDIGDFIGRVVQAEVLKIDDTRRNIVISRRSLIERQREEDRAYLMQELEVGQIRKGIVKNIADFGAFVDLGGIDGLLHITDMAWERIGHPTEMLSIDQEIEVKVLHIDREKQKIALGLKQKDRNPWENIETKYPVESVHPGEVVNVMSYGAFVKLEPGIEGLVHISEMSWTKRVNHPSELVNIGDKIDVMILGVDPEGQQLSLGMKQTLKNPWDEVLERYPEGKDVKGKVRNLTNYGAFIELEEGIDGLLHVSDMSWTRKIAHPSEVLEKGQEIECRILSVDEQRRRIALGLKQLDNDPWDGDIPDKYQPGQLVKGEVTKITNFGVFIGLEDGLEGLLHISELAEHKVEDPEEVVKVGDPIEVKVLRVDTDERKIGLSLKRVDWSEEQEKTAAAAEAAESGMPTPMDEGDLKGGLGSAGPLIPTSDSE

SEQ ID NO: 18197 - protein, 281 aa, Leptospira interrogans
MMELWLDEALELKNGRALKIKVKEFLHSRTTPFQKIDVFESVGFGRMFTLDGVVMMTEADEFAYHEMIVHVPMMSHPNPEKVLVIGGGDGGTVREVLKHPSVKEVHLCEIDKGVIDVCYEYFPEIANAMKDPRVKHAYEDGAKYVKDYQNYFDCIMVDSSDPVGPAEVLFKRPFYETMANCLKEGGICTTQGESFYYHGSIIRELFNFIPEIFKHCGYYYTVVPTYPSGIIGFTYCSKGPDPYTVVPDPQRVPQGLKYYSAEMHKAAFVLPQFAQKHIVRK

SEQ ID NO: 18198 - protein, 185 aa, Pseudomonas putida
MSADLEHIRQVMHEADCLYTEAEVEAAIAKVGEQICKDLHDKNPVVFCVMNGGLIFSGKLLTHLQFPLEASYLHATRYRNQTSGGELFWKAKPEVSFIDRDVLIVDDILDEGHTLSAIIEFCKHAGARSVYTAVLIDKDHDRKASPDLKANYVGLPCVDRYIFGYGMDYKGYWRNANGIFAVKGL

SEQ ID NO: 18199 - protein, 554 aa, Flavobacteria bacterium
MCGIVGMFQLKKDSQEQREKVLELSKKLRHRGPDWSGIYCGDKAILAHERLTIVDPQSGGQPLYSPDGKIVLAVNGEIYNHQKIRNHYKDTYEFKTKSDCEVILALYQDKGVDFMDELTGMYGFALYDSDKDVFLCARDHQGIIPLYYGTDDLGQFYVASELKALEGTCNEIAPFPPGHYYYSETGEFVKWYNREWKDYDAVKDNTSSVADLKQAMEDSVHRHLMSDVPYGVLLSGGLDSSIVSAVAKKYAAKRIESGDNKEAWWPQLHSFAIGLEGSPDLAAAQEVADHIGTVHHSVNFTIQEGLDAIKDVVYYLETYDVTTIRASTPMYLLARVIKSMGIKMVLSGEGSDEIFGGYLYFHKAPNAEEFHKETVRKLDTLHLYDNLRANKSLAAWGIEGRVPFLDKEFMDVAMRLNPEDKMCGGGKMEKHILREAFEDYLPHSVAWRQKEQFSDGVGYSWIDTLKEVVNDVVTDDMMEAAPFKFKINPPKNKEEYYYRSIFSEHFPSDTAASCVPSLKSVACSTPVALEWDEAFKNMNDPSGRAVSGVHDEGY

SEQ ID NO: 18200 - protein, 227 aa, Triticum aestivum
  misc_feature (37)..(37): Xaa can be any naturally occurring amino acid
MVDFPEGLRRLAALLLKCCDLDIPNRPKGLEDPERLXARETVFSVNEIEAWYELFKKISSAVVDDGVINKEEFQLALFKTNRKDSMFADRVFDLFDTKHNGILEFEEFVRALSVFHPNAPVDDKIDFAFKLYDLKQQGFIEKQEVKQMVVATLAESGMNLSDEVIEGIIDKTFEEADTKHDGKIDKEEWRNLVLRHPSLLKNMTLPYLRDITTTFPSFVFNSQVEDA

SEQ ID NO: 18201 - protein, 212 aa, Aeromonas hydrophila
MTIHVKNNIHWVGQRDWEVRDFHGTEYKTNKGTSYNSYLIREGKNVLIDTVDHKFSREFVQNLAAEIDLNLIDYVVINHAEEDHAGALTELMARIPGTPIYCTHNAIDSITGHHHHPEWNFHPVKTGDSLDIGNGKQLVFIETPMLHWPDSMMTYMTEDAVLFSNDAFGQHYCDEHLFNDEVDQTELMEQCQRYYANILTPFSPLVTAKIKE

SEQ ID NO: 18202 - protein, 116 aa, Rhodobacter sphaeroides
MRIVFVHPNYHSGGAEIAGSWPPAWVAYLCGALKKAGYTDYHFIDAMTDYVSHEKLAEKLRELQPDIVATTAITPSIYVAEETLKVAMEVVPNALRVLGGIHATFMFRQVLEEAPW

SEQ ID NO: 18203 - protein, 192 aa, Staphylococcus epidermidis
MNYQIKRNTEETQLNISLANNGTQSHINTGVGFLDHMLTLFTFHSGLTLSIEATGDTYVDDHHITEDIGIVIGQLLLELIKTQQSFTRYGCSYVPMDEALARTVVDISGRPYFSFNSKLSAQKVGTFDTELVEEFFRALIINARLTVHIDLLRGGNTHHEIEAIFKSFARALKISLAQNEDGRIPSSKGVIE

SEQ ID NO: 18204 - protein, 1094 aa, Vibrio angustum
MKRMLINATQKEELRVALVDGQKLFDLDIESPGHESKKANIYKGRITRIEPSLEAAFVDYGAERHGFLPLKEVAKDYFPANYSYQGRPNIKEVLKEGQEVIVQVDKEERGNKGAALTTFISLAGSYLVLMPNNPRAGGISRRIEGEERTQLKAALSTLDLPQGMGLIVRTAGVGKSGEELEWDLNVLLNHWNAVKEAADSQSAPFLIHQESNVIARAIRDYLRRDIGEILIDSPKIFDRARDHIKLVRPDFLSRVKRYEGEVPLFSHYQIESQIDSAFQREVRLPSGGSVVIDPTEALTSIDINSARATKGGDIEETALQTNLEAADEIARQLRLRDLGGLVVIDFIDMTPVRHQREVENRLREAVRMDRARVQIGRISRFGLLEMSRQRLSPSLAEASHHVCPRCSGTGVVRDNESLSLSILRLIEEEALKDNSSQVLAIVPVPVASYLLNEKRRSVQHIEKYHGVRVVIVPNSDMETPHFEVLRIREGEEQDTLSYHIPKTLEALKEAEAIEAPQPERVIKKREEPVLQGFTAPKQPAPVAKPAAKPTPKVTAKPATESTKKPGLLSRFFSALASFFSGSPEQQQEKPVEAKVEQNNNQNNRRNNNRRNDRSDNRRNNRDNSRDNNRRNNRQDNNDVENNDERQERNNEQRQNRRRNDRNDKNRQQQNDKAAKAPRQNRNNDEAKEQKRQSRKEEIQAQKQQRQQQGEQTAKATTEQPADAQRDSEEKAVKVKQRRQRRQLRKKVRITDNVEKSVEQQNATVDAVEKVEAVETAVEQTPSPLMALGTSIAKEAQDKPEKTQVVSDEQTDNEEQEGTQRRNRRSPRHLRASGQRRRRMRDTRVEKSDFVTNEEANAIEQAAIDAADSISEMVNVVSIVEKPKTMRPTSGVAIPEMAMGKVWSRIKPAVEAPVEKNITQEKADTADMIDEVETNDIIINTPVVEAKSEIVAVETTTLSGVAIPEMAMGKVIPRYTAEETTVEMKSEPAPEQVIEKPVIVEEVAAPVIKTEETVEIKSPVTAVVDLPAVAKAVMATSPRGFHAASAMTKAPAPEEHVSGSVVQAAPLRERSNTRAAGSQTATNSAAAPMTKPSFD

SEQ ID NO: 18205 - protein, 447 aa, Streptococcus pneumoniae
MTKRVTIIDVKDYVGQEVTIGAWVANKSGKGKIAFLQLRDGTAFFQGVAFKPNFVEKFGEEVGLEKFDVIKRLSQETSVYVTGIVKEDERSKFGYELDITDIEVIGESQDYPITPKEHGTDFLMDNRHLWLRSRKQVAVLQIRNAIIYVTYEFFDKNGFMKFDSPILSGNAAEDSTELFETDYFGTPAYLSQSGQLYLEAGAMALGRVFDFGPVFRAEKSKTRRHLTEFWMMDAEYSYLTHDESLDLQEAYVKALLQGVLDRAPQALETLERDTELLKRYIAEPFKRITYDQAIDLLQEHENDEDADYEHLEHGDDFGSPHETWISNHFGVPTFVMNYPAAIKAFYMKPVPGNPERVLCADLLAPEGYGEIIGGSMREEDYDALVAKMDELGMDRTEYEFYLDLRKYGTVPHGGFGIGIERMVTFAAGTKHIREAIPFPRMLHRIKP

SEQ ID NO: 18206 - protein, 605 aa, Oryza sativa
  misc_feature (435)..(448): Xaa can be any naturally occurring amino acid
MSALTTSQLATSATGFGIADRSAPSSLLRHGFQGLKPRSPAGGDATSLSVTTSARATPKQQRSVQRGSRRFPSVVVYATGAGMNVVFVGAEMAPWSKTGGLGDVLGGLPPAMAANGHRVMVISPRYDQYKDAWDTSVVAEIKVADRYERVRFFHCYKRGVDRVFIDHPSFLEKVWGKTGEKIYGPDTGVDYKDNQMRFSLLCQAPRILNLNNNPYFKGTYGEDVVFVCNDWHTGPLASYLKNNYQPNGIYRNAKVAFCIHNISYQGRFAFEDYPELNLSERFRSSFDFIDGYDTPVEGRKINWMKAGILEADRVLTVSPYYAEELISGIARGCELDNIMRLTGITGIVNGMDVSEWDPSKDKYITAKYDATTAIEAKALNKEALQAEAGLPVDRKIPLIAFIGRLEEQKGPDVMAAAIPELMQEDVQIVLLGTGXXXXXXXXXXXXXXYPGKVRAVVKFNAPLAHLIMAGADVLAVPSRFEPCGLIQLQGMRYGTPCACASTGGLVDTVIEGKTGFHMGRLSVDCKVVEPSDVKKVAATLKRAIKVVGTPAYEEMVRNCMNQDLSWKGPAKNWENVLLGLGVAGSAPGIEGDEIAPLAKENVAAP

SEQ ID NO: 18207 - protein, 372 aa, Chromobacterium violaceum
MHSVIHASDRIVVKVGSSLVTNDGRGLDLNALARWAEEVAELKRRGKQVVLVSSGAIAEGCQRLGWTVRPKGVHELQAAAAVGQMGLCQAYESAFRSFGLRTAQILLTHEDLADRTRYLNARSTLTSLLNLNVVPIINENDTVATSEIRFGDNDTLGALVTNLIEADALVILTDQRGLYSADPRKHPDAEFIHQAEAGDERLEDMAGGAGSSVGTGGMITKILAAKRAARSGAATVIASGREPHVLSRLADGEAIGTQLVAATNRMAARKQWLADHLKLAGRLLLDDGAALAIRERGTSLLPVGVSAVEGDFLRGEAVACVDAAGHEVARGLVNYSSDEARQIMRKSTREIEAALGYIVEPELIHRDNMVAL

SEQ ID NO: 18208 - protein, 93 aa, Arabidopsis thaliana
MSGRRSRSRQSSGTSRISEDQINDLIIKLQQLLPELRDSRRSDKVSAARVLQDTCNYIRNLHREVDDLSERLSELLANSDTAQAALIRSLLTQ

SEQ ID NO: 18209 - protein, 762 aa, Oryza sativa
MGTAHLSHLQYMGRLRGKVWVWRRSASGTRLGSERVLRRQVRRFDSVRSTTARAQNGNAGRSMTEERGCTMSDTEMPFKYSSGKAFPLGVSQVEGGLNFALFSQHASSVILCLKLPGRGTEDEKGADVVEFVLDQQKNKTGDIWHVIVEGLPASGVLYGYRVGGPQGWDQGHRFDSSTVLLDPYAKLVSGRKYFGVAEEKSSQHFGTYDFDSSPFDWGDDYRLPNLPEADLVIYEMNVRAFTADESSGLDSTSRGSYLGLIDKIPHLLELGVNAVELLPVFEYDELEFKRYPNPRDHMVNTWGYSTINFFAPMSRYASAGGGPVAASKELKQMVKELHKAGIEVILDVVYNHTNEADDAHPYMTSFRGIDNKVYYMLDLNKNAELLNFSGCGNTLNCNHPVVKELILDSLRHWVEEYHIDGFRFDLASVLCRGPDGCPLDAPPLIKEIAKDAVLSRCKIIAEPWDCGGLYLVGRFPNWDRWAEWNGKYRDDLRRFIKGDPGMKGVFATRVSGSADLYQVNERKPYHGVNFVIAHDGFTLCDLVSYNLKHNDANGEGGCDGCNDNFSWNCGVEGETNDLNVLSLRSRQMKNFHVALMISQGTPMMLMGDEYGHTRYGNNNSYGHDTCINNFQWEQLEQRRDGHFRFFSEMIKFRHSNPILRRDRFLNKNDVTWHEDCWENQESKFLAFTVHDHNSGGDIYLAFNAHDYFVDAVIPPPPHHKCWNRVVDTNLESPNDIVPEGVPFTGPKYRIAPYSSILLKAKP

SEQ ID NO: 18210 - protein, 148 aa, Astragalus sinicus
MGFTEAQEVLVNSSWEAFKQNLPHNSILFYTFVLEKAPAAKDLFSFLKNSDGVPKNNPALQAHAEKVFGLVRDAAVQLRAKGTVTLGDASLGGVHVQKGVVDPHFVVVKEALLQTIKEVAGGSWSAELSAAWEAAYDGLAAEIKKAMS

SEQ ID NO: 18211 - protein, 92 aa, Glycine max
MSSRRSRSRQTSSSRNITDDQINDLVSKLQQLLPEIRDRRSDKVSASKVLQETCNYIRSLHREVGDLSERLSELLDTTDTAQAAIIRNLLMQ

SEQ ID NO: 18212 - protein, 177 aa, Myxococcus xanthus
MAFYEQEVGVLISEDKLQARVRELAAEITRDYAGKDLTLICVLKGSAFFAIDLAKYIDLPVKLEFLGVSSYQGGTESTGEVRITTDVSKPMAGKHLLIIEDIIDTGLTMQFLLENLRARHPASLKVCTLLEKPSRARTKVDIDYKGFVIDDLFVVGYGLDFGEVYRNIPFIGVMKNK

SEQ ID NO: 18213 - protein, 722 aa, Prochlorococcus marinus
MQGQTKSVSFDGREIKLTTGRFAPQAGGSVMIECGDTSVLVTATKSSGREGVDFLPLMCDYEERLYAAGRIPGSFMRREGRPPERATLISRLIDRPMRPLFPGWMRDDIQIVATCLSLDERVPADVLAVTGASMATLMAGIPFQGPMAAVRVGLLGDDFVLNPSYREIERGDLDLVVAGTPDGVVMVEAGANQLSEQDVIEAIDFGYEAITELINAQKEVLKESGIKQEMPKAPEIDDTISTYLDKNCTKSISEVLKNFDQTKEERDNKIEEIKISISAKIDGLKDDNAVKKSLSLNNKLLENSYKALTKKLMREQIIKEGKRVDGRELNEVRAIDADAAVLPNRVHGSALFQRGLTQVLSTATLGTPSDAQEMDDLNPNTDKTYIHHYNFPPYSVGETRPMRTPGRREVGHGALAERALIPVLPAKDTFPYVLRVVSEVLSSNGSTSMASVCGSTLALMDAGVPLKAPVGGAAMGLIKEGKEVRILTDIQGIEDFLGDMDFKVAGTEKGITALQMDMKITGLPIETIGEAINQALPARTHILGKMLDAIETPKDNLSPHAPRLLSFRIDPELIGTVIGPGGRTIKGITERTNTKIDIEDGGIVTIASHDGAAAEEAQRIIEGLTRKVHEGEIFPGSITRIIPIGAFVEILPGKEGMIHISQLSEARVEKVEDVVKVGDQVTVRVREIDNRGRINLTLRGVSQNGGMSNYPEPTPTPVAPLT

SEQ ID NO: 18214 - protein, 210 aa, Candida glabrata
MAFVKRVTQETNIQLALDLDGGSVSVRESILGKEYASGDGQTIHVHTGVGFLDHMLTALAKHGGWSLILECIGDLHIDDHHTVEDCGIALGQAFKEALGSVRGIKRFGHGFAPLDEALSRAVVDFSNRPFAVVELGLKRERIGQLSTEMIPHFLESFATEARITMHVDCLRGTNDHHRSESAFKALAIAIREARTPTGRDDVPSTKGVLA

SEQ ID NO: 18215 - protein, 316 aa, Pseudomonas aeruginosa
MSEVKHSRLIILGSGPAGYTAAVYAARANLKPVVITGIQPGGQLTTTTEVDNWPGDVEGLTGPALMTRMQQHAERFDTEIVYDHIHTAELQQRPFTLKGDSGTYTCDALIIATGASAQYLGMSSEEAFMGKGVSACATCDGFFYRNQVVCVVGGGNTAVEEALYLANIAKEVHLIHRRDKLRSEKILQDKLFDKAENGNVHLHWNTTLDEVLGDASGVTGVRLKSTIDGSTSELSLAGVFIAIGHKPNTDLFQGQLEMRDGYLRIHGGSEGNATQTSIEGVFAAGDVADHVYRQAITSAGAGCMAALDAEKYLDDH

SEQ ID NO: 18216 - protein, 112 aa, Trichodesmium erythraeum
MKKVEAIIRPFKLDQVKIALVNAGIVGMTVSEVRGFGRQKGQTERYRGSEYTVEFLQKLKLEVVVEDDQVQTVIDKIINASRTGEIGDGKIFVSPVDKIVRIRTGEDNTDAI

SEQ ID NO: 18217 - protein, 466 aa, Streptomyces avermitilis
MSMSRTSRTKERLVVIGGDAAGMSAASQARRLKGPAELEIVAFERGHFTSYSACGIPYWVGGDVAERDQLIARTPEEHRARGIGLRIRTEVTEIDAEGARVRSRDLASGAESWTSYDKLVIATGARPVRPELPGVDAPGVHGVQTLDDGQALLDTLAATRGRRAVVVGAGYIGVEMAEALINRGYEVTVVNRSKEPMATLDPDMGRLVHKAMEGLGITMVNDAEVTGLPTGDDGRVRAVATEDAEYPADVVVLGIGVRPETTLAQAAGLPLGEHHGLLTDLAMRVRGHENIWAGGDCVEVLDLVSGSERHIPLGTHANKHGQVIGANVGGGYATFPGVVGTAVSKVCDLEIARTGLREKDARRAGLQFEAVTVESTSRAGYYPGADPMTVKMLAERRTGRLLGVQIVGGEGAGKRVDIAAVALTAGMTVEQMTALDLGYAPPFSPVWDPILVAARKAVAAVRANGV

SEQ ID NO: 18218 - protein, 72 aa, Pseudomonas aeruginosa
MSKEDSFEMEGTVVDTLPNTMFRVELENGHVVTAHISGKMRKNYIRILTGDKVRVELTPYDLSKGRITYRAR

SEQ ID NO: 18219 - protein, 313 aa, Xanthobacter autotrophicus
MTVPRPPHRRRALFLVNPGARHGTASLGGVRERLARDLDLTDVRWPGAAAISDTIRARAGDADLVILGGGDGTLNAATSGLFDTQLPLGVLPLGTANDFARTLAIPSDLAAAADVILAGAPRPMDLGEVNGHAFLNVASIGFSADLARALTHEAKRRFGVLGYGIVAARLLMQSRLFTAFIEHDGTVEQVRTLQVSVGNGRHYGGGMTVEATATADDGRLDFYSLEVDHWWRLLALLPALRRGTQGAWDDVRAFRTTEVVVRTSRPRPVNTDGELVTFTPAHFRIRPGAIHVYTPAPAGASAFSPNLLPEGSA

SEQ ID NO: 18220 - protein, 570 aa, Oryza sativa
MEASDEDRPLIHHLPPQEQCSKYTCDGTVNIDSKPALKQSTGNWRACFFILGVEFTECICFYGVSKNLVTYLTSVLHESNVNAAQSVSIWIGSCFFTPLIGAFLADTYWGRYWTVVMSILVIILGMIVLTVSASPLFLNASFYNGGISRLTVYLGLYLFALGTGGIKPNIPAFGADQFDGADPVERVTKGSFFNWYYFSINVGSLLSSTVVVWVQDNIGWSVGFAGPMLLLGFGLAMFIAGRRAYRYKKLGGSPLTRVFQVLVAAVRNHRLNLPDDSSLLHELPGVTEGDYRTQHTYQFRFLDKAAILSDKNCAPAAPSSPWRLCTVSQVEELKMLLRTFPVWASLVGFFMVTAQMTSTLIEQGVAMDGRVGRFTVPPASLATFDVVAVLALIPVYDAALVPLARRVTGRDRGVSHMQRIGVGLALSAVAMAYSALVEARRLAMAAAAAGTRMSIAWQVPSFFVLGAGEVFAVIGMLEFCYEQSPASMKSLGTALVQLAVAVANYLNSGMLRVVAAATARGGGAGWIPDKLDEGHLDYFFWMMAALSVLNLLQFLHCSIRFRGNNTLSSS

SEQ ID NO: 18221 - protein, 174 aa, Streptococcus pyogenes
MIPLTKLLITPRRCHMPNLYDFTVKAQNGNDLSLAAYKEKVVLIVNTATKCGLTPQYQALQALYDTYHDKGFEVLDFPCNQFLNQAPGDAEEINHFCSLTYHTTFPRFAKIKVNGKDADPLFTWLKEEKSGPLGKRIEWNFTKFLIDQNGQVIKRYSSKTDPKLIEEDLKALLG

SEQ ID NO: 18222 - protein, 496 aa, Xanthomonas axonopodis
MVKIQVSHSYFLRYDPKQWERGKPYPPLATLQVAALLRERGHAVSLFDAMLADDVEDYTAALCAAQPALVVFYEDNFNFLTKMCLSRMREAACRMIGQARAAGCRVLVAGSDASDNPDAFLAAGAHAVLIGEGIAPLISLLERIEAKPDVTTEHWLSGVAQIATSQPTAMRVHPGAQPPDARLSGLPAWDLVDMPRYRRFWQQRHGHFSLNMAASRGCPFRCNWCAKPIWGNHYKRRGAEEVAAEMIHLKRRYRPDHIWMADDIFGFHIDWVETFAQQLRDADGAVPFSIQTRADLASERMAAALARAGCVEAWIGAESGSQRILDKMTKGTQVGEVIAARERLGTQGIRVGFFIQLGYLGEELEDILATRALVTQANPDIIGVSVSYPLPGTKFYEEVKTQLGSKTHWQDSDDLAMMFRGAYDSGFYRAVRDLLHTQVDLQQARAAMTADAFAQASDQLEARWSALIASETQHRSEPMPPRAARQPRQLSTVLVG

SEQ ID NO: 18223 - protein, 301 aa, Oryza sativa
MSSGGVGGGSLGAGLLYHKFVSFALEETRLRTTLTPHPSQEKFKSIKPNDDNTVFNALSFSAPKIRLLRSLTIEKKNSYQVLDFAAFSEPEYDLPIFCANVFTTHAQSIVVLDLNPLYDTTVHKDYKDKYYRSIMPLVHKYNELLPWGGKITSESLKFFSPIVIWTIFESTEHNHHVLHSAFVDYYKVWLELMDQAIKENNKATIARNQEEQHKYLTWRAEKDPGYPLLKKLIGESRAEDLVMEFLFEGVNTLGTKSFLDYFPEYARDDGSVNKKRSMIGKSFETRPWDANGEFIGDAEAQ

SEQ ID NO: 18224 - protein, 427 aa, Unknown
  Bradyrhizobium sp. BTAi1
MSKDKSVSSLPRASRRGFLTAAGGLAATAIAAPARAGAGNPANQPPNVPEWTRTLGEGVAVRPYGKPSKFEKDVVRRDVEWLTASRESSVSFTPLHELEGIITPNGLCFERHHGGVADVDPADHRLMIHGLVERPLLLSLDELKRFPRVNRIHFMECAANSGMEWRGAQLNGCQFTHGMIHCVQYTGVSLRTLLEEAGVKSSGKWLLVEGADSAAMDRSLPTEKALDDCIIAYKMNGEALYPEQGYPMRLVVPGWQGNLWVKWLRRIEVGDQPWHTREETSKYTDLLPNGKARRFTWSMDAKSVITSPSPQAPIKHGKGFTIVSGLAWSGNGKVKRVDVSLDGGRSWWPARLDGPVLDKALTRFYYEFDWNGESLLLQSRVQDETGYVQPSKAELRKVRGYNSIYHNNGIQTWHVQANGEVENVEVA

SEQ ID NO: 18225 - protein, 390 aa, Brassica napus
MAMAAAVIVPLGILFFISGLVVNLLQAVCYVLVRPMSKNTYRKINRVVAETLWLELVWIVDWWAGVKIQVFADDETFNRMGKEHALVVCNHRSDIDWLVGWILAQRSGCLGSALAVMKKSSKFLPVIGWSMWFSEYLFLERNWAKDESTLQSGLQRLNDFPRPFWLALFVEGTRFTEAKLKAAQEYAASSELPVPRNVLIPRTKGFVSAVSNMRSFVPAIYDMTVAIPKTSPPPTMLRLFKGQPSVVHVHIKCHSMKDLPEPEDEIAQWCRDQFVAKDALLDKHIAADTFPGQKEQNIGRPIKSLAVVVSWACLLTLGAMKFLHWSNLFSSWKGIALSAFGLGIITLCMQILIRSSQSERSTPAKVAPAKPKDNHQSGPSSQTEVEEKQK

SEQ ID NO: 18226 - protein, 369 aa, Flavobacteria bacterium
MKKVLFIDRDGTIVKEPPVDYQLDSYEKLEFLPMAITQLHRIARELDYELVMVTNQDGLGTDSFPEDTFWPVHNLMMNVLENEGIKFSEVLIDRSFPEQNAPTRKPQTGLLTHYIKGNYDLENSFVIGDRNSDMQLAKNIGCKGIQLPSITDDSTFEDELVALKTDSWKEIFEFLKGQPRKVTVSRKTNETDIKIVLNLDGSGNGKIDTGLKFYDHMLEQLQRHGSLDLDIKVNGDLEIDEHHTIEDTAIALGDAFAKALSSKKGINRYGFLLPMDDSLAQVGIDFGGRPWIVWEAEFKREYVGDMPTELFFHFFKSFSDAAKCNLNMKVEGDNEHHKIEALFKAFAKAIKMAVKQTGDGKLPSTKGTL

SEQ ID NO: 18227 - protein, 666 aa, Mycobacterium tuberculosis
MAADYDKLFRPHEGMEAPDDMAAQPFFDPSASFPPAPASANLPKPNGQTPPPTSDDLSERFVSAPPPPPPPPPPPPPTPMPIAAGEPPSPEPAASKPPTPPMPIAGPEPAPPKPPTPPMPIAGPEPAPPKPPTPPMPIAGPAPTPTESQLAPPRPPTPQTPTGAPQQPESPAPHVPSHGPHQPRRTAPAPPWAKMPIGEPPPAPSRPSASPAEPPTRPAPQHSRRARRGHRYRTDTERNVGKVATGPSIQARLRAEEASGAQLAPGTEPSPAPLGQPRSYLAPPTRPAPTEPPPSPSPQRNSGRRAERRVHPDLAAQHAAAQPDSITAATTGGRRRKRAAPDLDATQKSLRPAAKGPKVKKVKPQKPKATKPPKVVSQRGWRHWVHALTRINLGLSPDEKYELDLHARVRRNPRGSYQIAVVGLKGGAGKTTLTAALGSTLAQVRADRILALDADPGAGNLADRVGRQSGATIADVLAEKELSHYNDIRAHTSVNAVNLEVLPAPEYSSAQRALSDADWHFIADPASRFYNLVLADCGAGFFDPLTRGVLSTVSGVVVVASVSIDGAQQASVALDWLRNNGYQDLASRACVVINHIMPGEPNVAVKDLVRHFEQQVQPGRVVVMPWDRHIAAGTEISLDLLDPIYKRKVLELAAALSDDFERAGRR

SEQ ID NO: 18228 - protein, 187 aa, Neisseria meningitidis
MTDLETKRLETQAMLENADLLFDQGQCRAALQKVADEITRDLGGKYPLLLPVMGGAVVFTGQLLPLLRFPLDFDYVHVSRYGDKLEGGAFNWKRMPDAEQIRGRHVVVLDDILDEGHTMSAIQAKLLEMGAASCRAAVFANKLIDKPKPIRADYVGLDVPNRYVFGYGMDAAGCWRNLGEIYALGGK

SEQ ID NO: 18229 - protein, 613 aa, Haemophilus influenzae
MTDKITFNDLGLPEFILKAVSDLGFETPSPIQQACIPHLLSGNDVLGMAQTGSGKTAAFALPLLAQIDPSEKHPQMLVMAPTRELAIQVADACEQFVKYAHGSRIVTLYGGQRYDIQLRALKQGAQVVVGTPGRILDHIRRGTLNLSELRFIVLDEADEMLRMGFIDDVETVMAELPENHQTALFSATMPEPIRRITKRFMNDPKEVKIKVNNENAPDIEQSCWYVHGVRKNEALLRFLEVEDFDAAIIFARTKTGTLDITELLEKNGFRSAALNGDMTQQLREQTLDRLRNGSLDIVVATDVAARGIDIERISLVVNYDIPLDAESYVHRIGRTGRAGRSGRALLFVEPRERRLLRNIEHLMKKGINEVELPNHLVLQECRRKKFVAKITKQLEHHDLEQYRSLLEDLFTADQDQEDIAAAMLMLLQGKQKLILPPDPPMEKRRRERNDRGDRRENPRSAERRGERKGYGNPQAMDLYRIEVGRADGVEVRHIVGAIANEGDINSRYIGHIKLYDDYTTVELPQGMPKELLQQFGKTRVLNKQMQMSFLGAVKSDNSRGSDDFNGKRKGRGSDFRGERGRERGNDNRGNRKFNEKSNRTFSDKPRRDRRSSF

SEQ ID NO: 18230 - protein, 178 aa, Oryza sativa
MSKSKTIADKCALASSGFQGDIKALHKNLAARELLYQHQHNKRMSCPAMAQLLSNTLYYKRFFPYYAFNVLGGLDSEGKGCVFTYDAVGSYERTGYSAQGTGSALIMPVLDNQLKSPSPLLLPARDAVTPLSETEAVDLVKDVFASATERDIYTGDKLEIVVINKAGTKREYIDLRKD

SEQ ID NO: 18231 - protein, 790 aa, Arabidopsis thaliana
MEMGVMENLMVHTEISKVKSQSNGEVEKRGVSVLENGGVCKLDRMSGLKFKRRKVFAVRDFPPGCGSRAMEVKIACENGNVVEDVKVVESLVKEEESLGQRDASENVSDIRMAEPVEVQPLRICLPGGDVVRDLSVTAGDECSNSEQIVAGSGVSSSSGTENIVRDIVVYADESSLGMDNLDQTQPLEIEMSDVAVAKPRLVAGRKKAKKGIACHSSLKVVSREFGEGSRKKKSKKNLYWRDRESLDSPEQLRILGVGTSSGSSSGDSSRNKVKETLRLFHGVCRKILQEDEAKPEDQRRKGKGLRIDFEASTILKRNGKFLNSGVHILGEVPGVEVGDEFQYRMELNILGIHKPSQAGIDYMKYGKAKVATSIVASGGYDDHLDDSDVLTYTGQGGNVMQVKKKGEELKEPEDQKLITGNLALATSIEKQTPVRVIRGKHKSTHDKSKGGNYVYDGLYLVEKYWQQVGSHGMNVFKFQLRRIPGQPELSWVEVKKSKSKYREGLCKLDISEGKEQSPISAVNEIDDEKPPLFTYTVKLIYPDWCRPVPPKSCCCTTRCTEAEARVCACVEKNGGEIPYNFDGAIVGAKPTIYECGPLCKCPSSCYLRVTQHGIKLPLEIFKTKSRGWGVRCLKSIPIGSFICEYVGELLEDSEAERRIGNDEYLFDIGNRYDNSLAQGMSELMLGTQAGRSMAEGDESSGFTIDAASKGNVGRFINHSCSPNLYAQNVLYDHEDSRIPHVMFFAQDNIPPLQELCYDYNYALDQVRDSKGNIKQKPCFCGAAVCRRRLY

SEQ ID NO: 18232 - protein, 169 aa, Hordeum vulgare
MAAAASSASSVHDFTVKDASGKDVDLSTYKGKVLLIVNVASQCGLTNSNYTELAQLYEKYKDQGFEILAFPCNQFGGQEPGTNEEIVQFACTRFKAEYPIFDKVDVNGDNVAPVYKFLKSSKGSLFGDNIKWNFSKFLVDKDGNVVDRYAPTTSPLSIEKDIKKLLASS

SEQ ID NO: 18233 - protein, 349 aa, Glycine max
MALGRVIYVAHTVCIRSELQPMAPDRIGSSSSSRQRDLVFVVNPLGANGRTGKEWRKLVPYLRSRLGKECNICESITSGPCHAIDITREAIREGADAVIAVGGDGTLHEVVNGFFWAGKPVVSQVKESTHSTALSLIPLGTGSDFARTFGWKNDPHEAIERVARGLRSMIDVGVITGESCDHHYFINVADIHLSAKAGFYASRYKRFGNLCYVIGALQAFIGHQNQDMRIRFNDGPWETCPQVTALCIGNAKYFGGGMKITPNADPFSRNLEVVTLQNFKWYDFVFKLHKLYSGTHLSVKNVSDRSVLSIEVEDISGMGGGIYIQSDGEHLGFLPKKISVVPAAIEMIL

SEQ ID NO: 18234 - protein, 131 aa, Glycine max
  misc_feature (102)..(102): Xaa can be any naturally occurring amino acid
  misc_feature (125)..(125): Xaa can be any naturally occurring amino acid
MAPLMISSPAATTGNRALAYVGAPFTDLKYMAGLRTRNTNTDITSIASNGGRVQCMQAWPPIGKKKFETLSYLPDLDDAQLTKEVAYLLRNGWIPCLAFELXTGSLYREHITSPGYYDRRYWTCXKLSMFG

SEQ ID NO: 18235 - protein, 162 aa, Triticum aestivum
  misc_feature (86)..(86): Xaa can be any naturally occurring amino acid
  misc_feature (88)..(88): Xaa can be any naturally occurring amino acid
  misc_feature (91)..(91): Xaa can be any naturally occurring amino acid
  misc_feature (100)..(100): Xaa can be any naturally occurring amino acid
  misc_feature (105)..(106): Xaa can be any naturally occurring amino acid
  misc_feature (113)..(113): Xaa can be any naturally occurring amino acid
  misc_feature (118)..(119): Xaa can be any naturally occurring amino acid
  misc_feature (121)..(121): Xaa can be any naturally occurring amino acid
  misc_feature (126)..(127): Xaa can be any naturally occurring amino acid
  misc_feature (130)..(130): Xaa can be any naturally occurring amino acid
  misc_feature (135)..(135): Xaa can be any naturally occurring amino acid
  misc_feature (137)..(137): Xaa can be any naturally occurring amino acid
  misc_feature (140)..(140): Xaa can be any naturally occurring amino acid
  misc_feature (144)..(144): Xaa can be any naturally occurring amino acid
  misc_feature (146)..(146): Xaa can be any naturally occurring amino acid
MGSEASGGAAAIDLLRSAAPFLPDADLLLTPGTGLVLVDLVNGFCTVGAGNLAPVTPNKQIEKMVEESTRLAKVFCQRNWPVFAFXDXHHXDKPEPPFPXDCYIXXGEKNLFXALKWXXEXPIVKXXQGXIDGNXLXFEXDGSXFXEWSVQKFGLGIPKFGL

SEQ ID NO: 18236 - protein, 414 aa, Haemophilus somnus
MNIADYDPVLWQAIQDENLRQEEHIELIASENYASPRVMEAQGCQFTNKYAEGYPGKRYYGGCEYADIVEQLAIDRAKALFGADYANVQPHSGSQANAAVYMALLNPGDTILGMSLAHGGHLTHGASVSFSGKIYKAEQYGITSEGLIDYDALRKQAHEVKPKMIVGGFSAYSQIVDWAKMREIADEVGAYLFVDMAHVAGLIAAGVYPSPMPHAHVVTTTTHKTLAGPRGGLILANGNEELYKKLNSAVFPAGQGGPLVHVIAAKAVCFKEALEPEFKTYQAQVVKNAKAMVKVFKQRGYNVVSDGTENHLFLVDLVNHGLTGKAADAALSRANITVNKNAVPNDPQKPFVTSGIRVGTPAVTRRGFNEEDVAELAGWMCDILDSMNKDNHEQVIADTKEKVLAICKRLPVYP

SEQ ID NO: 18237 - protein, 579 aa, Hordeum vulgare
MGEVAAEMYTQDGTVDIKGNPALKKDTGNWRACPYILANECCERLAYYGMSTNLVNFMKDRMGMANAAAANNVTNWGGTCYITPLIGAFLADAYLGRFWTIASFMIIYIFGLGLLTMATSVHGLVPACASKGVCDPTPGQSAAVFIALYLIALGTGGIKPCVSSFGADQFDEHDDVERKSKSSFFNWFYFSINIGALVASSVLVYVQTHVGWSWGFGIPAVVMAIAVGSFFVGTSLYRHQRPGGSPLTRIAQVLVAATRKLGVAVDGSALYETADKESGIEGSRKLEHTRQFRFLDKAAVETHADRTAAAPSPWRLCTVTQVEELKSVVRLLPIWASGIVFATVYGQMSTMFVLQGNTLDASMGPKFKIPSASLSIFDTLSVIAWVPVYDRILVPAVRSVTGRPRGFTQLQRMGIGLVVSMFAMLAAGVLELVRLRTIAQHGLYGEKDVVPISIFWQVPQYFIIGCAEVFTFVGQLEFFYDQAPDAMRSMCSALSLTTVALGNYLSTLLVTVVAKVTTRGGKQGWIPDNLNVGHLDYFFWLLAALSLVNFAVYLLIASWYTYKKTAGDSPDAKGGAHDQ

SEQ ID NO: 18238 - protein, 194 aa, Ostreococcus tauri
MSRASLALGDARALRPRPASSASRRRARTPTRAFFNGKGADKTARDAIDLSKRKISSETDDKGAAVTVSFLGANDSRVDVTCGSNQYILDAGLEAGIEIPFTCRGGICGACVARCAKGTIDQSDIADLEFTLSEEELKSGMVLLCMARPVGDVEIETQSDWGYSLGVCEWRGATGEILGRDPTPLMGDTDRIGL

SEQ ID NO: 18239 - protein, 1165 aa, Streptococcus pyogenes
MKKKVNQGSKRYQYLLKKWGIGFVIAATGTVMLGCTPSILTHQVAAKTIVGLARDEAQQGDGNAKSGDGFQSSSKEAKPVLDSSSANPASIAEHHLRMHFKTLPAGESLGSLGLWVWGDVDQPSKDWPNGAITMTKAKKDDYGYYLDVPLAAKHRQQVSYLINNKAGENLSKDQHISLLTPKMNEVWIDENYHAHAYRPLKKGYLRINYHNQSGHYDNLAVWTFKEVKTPTTDWPNGLDLSHKGPYGAYVDVPLKEGANEIGFLILDKSKTGDAIKVQPKDYLFKELDNHTQVFVKDTDLKVYNNPYYIDQVSLKGAEQTTPNEIKAIFTTLDGLDEDAVKQNIKITDKAGKTVAIDELTLDKDKSVMTLKGDFKAQGAVYTVTFGEVSQVARQSWQLKDKLYAYDGELGATLAKDGSVDLALWSPSADTVKVVVYDKQDQTKVLGQADLTKSDKGVWRAHLTSDSIKGISDYTGYYYLYEITRGQEKVMVLDPYAKSLAAWNDATATDVIKTAKAAFIDPSKLGPTGLDFAKINNFKKREDAIIYEAHVRDFTSDKALEGKLTHPFGTFSAFVEQLDYLKDLGVTHVQLLPVLSYFYANELDKSRSTAYKSSDNNYNWGYDPQHYFALSGMYSANPNDPALRIAELKNLVNEIHKRGMGVIFDVVYNHTARTYLFEDLEPNYYHFMNADGTARESFGGGRLGTTHAMSRRILVDSIAYLTREFKVDGFRFDMMGDHDAAAIEQAFKAAKAINPNTIMIGEGWRTYQGDEGKKEIAADQDWMKATNTVGVFSDDIRNTLKSGFPNEGTAAFITGGAKNLEGLFKTIKAQPSNFEADAPGDVVQYIAAHDNLTLHDVIAKSINKDPKVAEEEIHKRIRLGNTMILTAQGTAFIHSGQEYGRTKQLLNPDYKTKVSDDKVPNKATLIDAVAKYPYFIHDSYDSSDAVNHFDWAKATDSIAHPISNQTKAYTQGLIALRRSTDAFTKATKAEVDRDVTLITQAGQDGIQQEDLIMGYQTVASNGDRYAVFVNADNKTRKVVLPQAYRYLLGAQVLADAEQAGVTAIAKPKGVQFTKEGLTIDGLTALVLKVSSKTANPSQQKSQIGNHQTKTPDGSKDLDKSLMTRPKRAKTNQKLPKTGEASSKGLLAAGVALLLLAISLLMKRQKD

SEQ ID NO: 18240 - protein, 537 aa, Streptococcus pyogenes
MKKHWWHKATIYQIYPRSFKDTNGNGIGDLKGITSQLDYLQKLGITAIWLSPVYQSPMDDNGYDISDYEAIADVFGDMADMDELLAAANERGIKIIMDLVVNHTSDEHAWFVEARENSNSPERDFYIWRDEPNDLTSIFSGSAWEYDNASGQYYLHLFSKRQPDLNWENEALRHKIYDMMNFWIAKGIGGFRMDVIDLIGKVPDLEITGNGPRLHDYLKEMNQATFGNHDVMTVGETWGATPEIARQYSRPENKELSMVFQFEHVGLQHKPDAPKWDYAEELDVPALKAIFSKWQTELKLGEGWNSLFWNNHDLPRVLSIWGNDSTYREKSAKALAILLHLMRGTPYIYQGEEIGMTNYPFKDLTEVNDIESLNYAKEAMGNGVSAARVMDSIRKVGRDNARTPMQWSKDTHAGFSKAQETWLPVNPNYQDINVADALADPDSIFYTYQKLIALRKEQDWLVEADYHLLPTADKVFAYQRQLGEETYVIVVNVSDQEQVFAKDLAGAEVVITNTDVDKVLETKHLQPWDAFCLKLKA

SEQ ID NO: 18241 - protein, 322 aa, Trichodesmium erythraeum
MEDNANYKNAVDILSTISILKESFSVTEIELFVKLTNFQRYKAKVKIICQSEPAISIICLITGEARVISNDYQLAILREGDIFGESMFSNECIRTANVIASTDVSAIIFTVEDYERLTRISPNIALKYKLFFEAIYKYHKRKDDKFFSVDSTKYLALIAHNEMKSSLVEFVKEHIKLITKFPLVATGTTGLLLHQATGVVLSRKVKSGPLGGDQAIGSMISTDNICGVLFFRDPLSSHPHHADIEALSRLCDVYQVPLATNPSTAKAILLYLDNTPLEGKHNFSLALTKYQENQSRIVHGGVTSSLKPLGDSDYPDIHSVKN

SEQ ID NO: 18242 - protein, 161 aa, Ostreococcus tauri
MGFGFGRKARSESTAAPVRDVEYVREESKSEAYARIRKARERSRKEFEAKERGGVSYALFSVARALDFQEDIESDRGLLNAARRMRNGDKMSTEQYGALRRKVGGTKGGFFGENVDVVGAYTDKGYVDKDDVGTDIVGAPFLAAVLLGVLGTTIWVAVQVP

SEQ ID NO: 18243 - protein, 250 aa, Pimpinella brachycarpa
MGKCYPTVSEEYKVAVEKCRRKLRGFIAEKNCAPLMLRLAWHSAGTYDVKTKTGGPFGTMRQKLEQSHAANNGLDVAVRLLEPFKEQFPIISYGDLYQLAGVVAVEITGGPDVPFHPGRPDKDEPPQEGRLPNATLGNDHLRNVFVKTMGLSDKDIVTLSGGHTLGRAHKERSGFEGPWTSNPLIFDNSYFKELLTGEKEGLLQLPTDKSLLEDPVFRPLVDKYACDEDAFFADYAESHMKLSELGFAEA

SEQ ID NO: 18244 - protein, 248 aa, Candida albicans
MTSSPPEYAPTSTSSFTVSTSDVYNQEVTKSSLIKTPLHKSVYDSLAEIYSILPTLEMVENSYLKDYITDKERYTSTTYRLIHQYQMLIKVFTDDQTKFQLLQKEFLPGLLSDMSNFLDLLLSKFNDSYPHAVSRIKNGLPATIEQINGNQPTSASARLVAEITGNFITCMDAVKLNYKSKEQLHPLLSDLVVNLNELNEELQFTGKSKLVNWLIKINNLQTELTQEEADSFLNDLDIAYKGFYTTLE

SEQ ID NO: 18245 - protein, 502 aa, Haemophilus influenzae
MFIARTNTIFLWKISFIKVNCRQFYVNYIQLQRFNMSKVASIVDVLQGKVAIGETVTVRGWVRTRRDSKAGLSFLAVYDGSCFDPIQAIINNDIKNYESEILRLTTGCSVIVTGKVVESPSEGQAVELQAEKVEVTGFVEDPDTYPMAAKRHSIEYLREVAHLRPRTNIIGAVARVRHCLSQAIHRFFHEQGFYWVATPLITASDTEGAGEMFRVSTLDLENLPRSENGKVDFSQDFFGKESFLTVSGQLNGETYACALSKIYTFGPTFRAENSNTTRHLAEFWMVEPEVAFATLADNAKLAEDMLKYVFRAVLAERKDDLQFFEKHVDKDVITRLENFVNSDFAQIDYTDAIDVLLKSGKKFEFPVSWGIDLSSEHERFLAEEYFKSPVVVKNYPKDIKAFYMRLNDDGKTVAAMDVLAPGIGEIIGGSQREERLEVLDKRMEEMGLNPDDYWWYRDLRKYGSVPHSGFGLGFERLIVYVTGVQNIRDVIPFPRAPRNANF

SEQ ID NO: 18246 - protein, 338 aa, Listeria monocytogenes
MTQKKVAILGAGSWGTGLALVLADNNHQPVIWGNLDKIVNEINESHTNSHYLPDIILPTEVKATLSLDEAIDGAEIVVIAIPTNAMRIVCKQLNEALKEPTILVHVSKGIEPETNLRMSEVIEDEIDASKRKALVVLSGPSHAEEVALRHPTTLCASCKDLSAAEIVQDRFINNNLRIYTNDDVIGAEIGGALKNIIALGAGISDGLGYGDNAKAALMTRGMAEITRLGVAVGSNPQTFYGLTGIGDLIVTCTSVHSRNWRAGNMLGKGENLDEVLEKMGMVVEGVRTAKAVHGWAKKLDIDMPITESIYAILFENKDAREAVDLLMGREKKIEKESF

SEQ ID NO: 18247 - protein, 145 aa, Saccharomyces cerevisiae
MKLDRDSSGSIDKNEFMSIPGVSSNPLAGRIMEVFDADNSGDVDFQEFITGLSIFSGRGSKDEKLRFAFKIYDIDKDGFISNGELFIVLKIMVGSNLDDEQLQQIVDRTIVENDSDGDGRLSFEEFKNAIETTEVAKSLTLQYDV

SEQ ID NO: 18248 - protein, 154 aa, Zea mays
  misc_feature (114)..(114): Xaa can be any naturally occurring amino acid
MAKKPDRWYRSDRRTRHTPTYRYCRAVTDRKISIYHAAMKRKRADDLPYCEHLVSSETENDSRKALEADRFACKENMTKSEEKDAFHPKIFFYPLHALRINKTISRAGDDTMKXGMMVAHGNPQGTRVMEDIVHALLLGTCKDNNRCPWQQRSA

SEQ ID NO: 18249 - protein, 333 aa, Oryza sativa
MVINLEFIRAIVTADEILLLDPLTIDVIPFVEQLTHHLPLKNLVCGNGQPGGDDHGEKHDDSHGDQVPRLNEATGAEHELPFEFQVLELALETVCSSFDVNVSGLERRATPVLEELTKNVSTRNLDRVRTLKSDLTRLLAHVQKVRDEIEHLLDDNEDMAHLYLTRKQLQNQQVEALISSAASNSIVPGGTSLSRLNNSFRRSVSIATSMHLDNDVEDLEMLLEAYFMQLDGIRNRILSVREYIDDTEDYVNIQLDNQRNELIQLQLTLTIASFGIAVNTFIAGAFAMNIQSKLYSIDDGSFFWPFVGGTSSGCFMICIVLLWYARWKKLLGP

SEQ ID NO: 18250 - protein, 326 aa, Coxiella burnetii
MTEIKKLIVLTSGGDAPGMNAAIRAVVRTALHYQFEVYGATAGFAGLVNGQVVPLNSRAVANCIQRGGTILKTGRFENFRFKAVRDKAREFLKKLQIDAMIVLGGNGSFAGASKLYQEGGPQMIGIPCTIDNDIQGTDYCIGFDTACNTALQAIDKIRDTAFSHERNFLIEVMGRSSGFIAVNVGIAGGAEIIALPEFHVDIDTLTQKIKKQHGKKSASIIVAAEANQPGHSFEVAKQIKEKTGIEYRVCVLGHTQRGGTPTVKDRVLASLMGAQAIEALKKGLTEKMIAYQNGKIAVAPLPDPDNGTRYFADEALLRVNNIICAM

SEQ ID NO: 18251 - protein, 236 aa, Oryza sativa
MAGSGELKLLGVWSSPYAIRVRVVLNLKSLPYEYVEENLGDKSDLLLASNPVHKSVPVLLHAGRPVNESQVIVQYIDEVWPGGAGGRPSVMPSDPYERAVARFWAAYVDDKVRPAWLAILFGSKTEEERAAAVAQAVAALETLEGAFGECSKGKPFFGGDGVGFVDVVLGGYLGWFTAIDKLIGRRLIDPARTPALAAWEERFRATDAAKGVVPDDADKLLEFRQTLLRWSASKAK

SEQ ID NO: 18252 - protein, 302 aa, Pseudomonas fluorescens
MTILKVATTQMPCTWDLKSNLDRAEQLVREAAGQGAQVILLQELFATPYFCIEQSHQHMALAEAYRDSQVLSRFAALARELGVVLPLSWYEKAGNAYFNSLSVADADGRLLGVYRKTHIPNAIGYQEKEYFSPGDTGFKVWDTAFGRLGVGICWDQWFPETARCLALMGAEVLLFPTAIGSEPGCADLDSRDHWQMTMRGHAAANLLPVIASNRVGREVAGTDAALQMNFYGSSFICNHKGKVLAEADRASTGVLVQSLDLAAMREDRLSWGIYRDRRPEMYGALLSQDGRHLNVRWNPQGV

SEQ ID NO: 18253 - protein, 527 aa, Rhizobium leguminosarum
MEPTHLFELVIAMFLAIIALHYAAHRLGLPPSVALLTGGALLAFVPGLPAISVDPELVLVIFLPPLLMDGAWSIAVARLRRHVIGIASLAVGAVLFTCAVVAVVAHLIFPSIPWAACAALGAIVAPPDAVAARAVLQRVRLPRRLQILLEGESLLNDASGLVLFRFAVAAAATGAFSAAEAGGSFLVLALGGAVVGIVVGTAWFKLVRLLGDEYLIIAASVLLGWIAYLAGEQLHVSGVIATVTAGLIMSWHQHTVLSAAMRMRGTSFWTVMIFLMEAAVFILIGLSLRDVVERGGGLTTVIATMGLPMLAILVALVLARFAWVFACDFAVRFCAALGFAQARPLGVGGATVLSWAGVRGVVTLALALSLPEGFPGRDFILVTSFAVILGTVLIQGTTLGRVIAWARLVEPESERARLTMSQAEAAMAQAQVEVVQNLAYDAEGKLIHPQLLERYQRRATSIVDYAEKTEQYMPVLHAHFDVILEAVAIGRRELIRLHRAGEIDDETLLELERDLDLEELSAISAKA

SEQ ID NO: 18254 - protein, 136 aa, Brassica napus
  misc_feature (15)..(15): Xaa can be any naturally occurring amino acid
MARTKQTARKSTGGXAPRKQLATKAARKSAPATGGVKKPHRFRPGTVALREIRKYQKSTELLIRKLPFQRLVREIAQDFKTDLRFQSSAVSALQEAAEAYLVGLFEDTNLCAIHAKRVTIMPKDIQLARRIRGERA

SEQ ID NO: 18255 - protein, 605 aa, Oryza sativa
MSALTTSQLATSATGFGIADRSAPSSLLRHGFQGLKPRSPAGGDATSLSVTTSARATPKQQRSVQRGSRRFPSVVVYATGAGMNVVFVGAEMAPWSKTGGLGDVLGGLPPAMAANGHRVMVISPRYDQYKDAWDTSVVAEIKVADRYERVRFFHCYKRGVDRVFIDHPSFLEKVWGKTGEKIYGPDTGVDYKDNQMRFSLLCQEAPRILNLNNNPYFKGTGEDVVFVCNDWHTGPLASYLKNNYQPNGIYRNAKVAFCIHNISYQGRFAFEDYPELNLSERFRSSFDFIDGYDTPVEGRKINWMKAGILEADRVLTVSPYYAEELISGIARGCELDNIMRLTGITGIVNGMDVSEWDPSKDKYITAKYDATTAIEAKALNKEALQAEAGLPVDRKIPLIAFIGRLEEQKGPDVMAAAIPELMQEDVQIVLLGTGKKKFEKLLKSMEEKYPGKVRAVVKFNAPLAHLIMAGADVLAVPSRFEPCGLIQLQGMRYGTPCACASTGGLVDTVIEGKTGFHMGRLSVDCKVVEPSDVKKVAATLKRAIKVVGTPAYEEMVRNCMNQDLSWKGPAKNWENVLLGLGVAGSAPGIEGDEIAPLAKENVAAP

SEQ ID NO: 18256 - protein, 287 aa, Bacillus subtilis
MYDTIVIGAGQAGISIGYYLKQSDQKFIILDKSHEVGESWKDRYDSLVLFTSRMYSSLPGMHLEGEKHGFPSKNEIVAYLKKYVKKFEIPIQLRTEVISVLKIKNYFLIKTNREEYQTKNLVIATGPFHTPNIPSISKDLSDNINQLHSSQYKNSKQLAYGNVLVVGGGNSGAQIAVELSKERVTYLACSNKLVYFPLMIGKRSIFWWFDKLGVLHASHTSIVGKFIHKKGDPVFGHELKDAIKQKEIILKKRVIAAKQNEIIFKDSSTLEVNNLFGLLVSGIPYVG

SEQ ID NO: 18257 - protein, 417 aa, Arabidopsis thaliana
MISLNLSPSLNPGLLHKTRTCQQPTRLSALLVTNPKPFNHRHPLGLSPIPNLQIRDVSAKPLLSLTNPESSSGFSRKPRSIAAVGSSDSNPDEKSDLGEAEKKEKKAKTLQLGIVFGLWYFQNIVFNIFNKKALNVFPYPWLLASFQLFAGSIWMLVLWSFKLYPCPKISKPFIIALLGPALFHTIGHISACVSFSKVAVSFTHVIKSAEPVFSVIFSSLLGDSYPLAVWLSILPIVMGCSLAAVTEVSFNLGGLSGAMISNVGFVLRNIYSKRSLQSFKEIDGLNLYGCISILSLLYLFPVAIFVEGSHWVPGYHKAIASVGTPSTFYFWVLLSGVFYHLYNQSSYQALDEISPLTFSVGNTMKRVVVIISTVLVFRNPVRPLNALGSAIAIFGTFLYSQATAKKKKIEVGGDKKN

SEQ ID NO: 18258 - protein, 744 aa, Hevea brasiliensis
  misc_feature (642)..(642): Xaa can be any naturally occurring amino acid
  misc_feature (645)..(645): Xaa can be any naturally occurring amino acid
  misc_feature (659)..(659): Xaa can be any naturally occurring amino acid
MEACNCIEPQWPADELLMKYQYISDFFIALAYFSIPLELIYFVKKSAVFPYRWVLVQFGAFIVLCGATHLINLWTFTMHSRTVAIVMTTAKVLTAAVSCATALMLVHIIPDLLSVKTRELILKNKAAELDREMGLIRTQEETGRHVRMLTHEIRSTLDRHTILKTTLVELGRTLALEECALWMPTRSGLELQLSYTLRQQNPVGYTVPIQLPVINKVFSCNRAVKISPNCPVARIRPFAGKYMPGEVVAVRVPLLHLSNFQINDWPELSTKRYALMVLMLPSDSARQWHAYELELVEVVADQVAVALSHAAILEESMRARDLLMEQNVALDLARREAETAIRARNDFLAVMNHEMRTPMHAIIALSSLLQETGLTPEQRLMVETILKSSNLLATLINDVLDLSRLEDGSLQLDLGTFNLRAVFREVLNLIKPIASVKKLPVTLNLAPDLPEYAIGDEKRLMQTILNVVGNAVKFSKEGNISITAFVARPESLRDLRFPDFFPVPSDDHFYLRVQVKDEGLGINLQDIPKLFTKFAQNQSLATRNSGGSGLGLAICKRFVNLMEGHIWIESEGLGKGCTAIFVVKLAILECSNESKHPFMQNGPKPNQGAKQTSFMGPESSLLMDDTGGYQDGNKRTFWGTLXCDXTTVSSSDECLRVVXLDHKVVFMDVCMPDGLELLSAYMKDFTKRHERPLIVALYWNANKVTKENCMKVGMDGVILKPVSVDKMRGVLSDLLEHRVLFEAM

SEQ ID NO: 18259 - protein, 315 aa, Lactobacillus acidophilus
MSKKINVHLLVNEVAGNGNAIKANTELHAVLNKLNIPFDQQKSNYPGELTKLACEYANNNPAKNNILIVVGGDGSFNEVLNGIKQSHYPETPITYFPAGTGNDFARGAGLTDDPFQLINNLLQDPEPEKVDCGYFTSNIAEIPSGYFVNNFGIGFDAFVVHQSNHTSLKKKLNHINSGNLIYGLNVVKALINQKTFAVTVKTADQTLRYGDAYLVTTTNHPYFGGGFAILPKADIYSHHLDTVIVEKPNLNRTLFLFGKLITNGSHVTAPEFHYVEAKEIQVETKKPEYAQIDGEDVDKQNFKVNFKINHFNLLK

SEQ ID NO: 18260 - protein, 213 aa, Glycine max
MAVLPSSSSNLELTISVPGFASSPVLLPLSSVKELDINQVPLEEDWMASNMEDEEEGSNGDPPRKKLRLTKEQSRLLEESFRQNHTLNPKQKESLAMQLKLRPRQVEVWFQNRRARSKLKQTEMECEYLKRWFGSLTEQNRRLQREVEELRAIKVGPPTVISPHSCEPLPASTLSMCPRCERVTSTADKPPSAAATLSAKVPPTQSRQPSAAC

SEQ ID NO: 18261 - protein, 358 aa, Vitis vinifera
MALPVSAIGFEGYEKRLEISFSEPGIFSDPEGRGLRSLSRAQLDEILEPAECTIVGSLSNDIVDSYVLSESSLFVYPYKIIIKTCGTTKLLLSIPPILKLADTLSLSVSCVRYTRGSFNFPGAQPYPHRHFSEEVAVLDSYFGKLGSGSKAYVMGSSDKSQKWHVYSASAEVRSACDPVYTLEMCMTGLDREMASVFYKTHSSSAVKMTDTSGIRKILPDSEICDFEFDPCGYSMNAIEGAAISTIHVTPEDGFSYASFETVGYNPKDVNLSHLIERVLSCFQPNEFSVAVHADISGKLLERNCLLDVKGYCCEERSNEELGMCGSMVYHRFMKTEGLVSPRSILKCCWKEEEEEEKE

SEQ ID NO: 18262 - protein, 86 aa, Unknown
  Azoarcus sp. EbN1
MAKEELLEMEGVVNEVLPDTRFRVTLENGVEVQAYASGKMRKHRIRILAGDKVSVELSPYDLTKARISFRHKDERPAGAPSQFRRR

SEQ ID NO: 18263 - protein, 329 aa, Bdellovibrio bacteriovorus
MRIYSDITKTIGQTPLIEMQRIGKGLPGRLLLKLEFFNPLGSVKDRIGLAMIEDAERSGQLKPGMKIIEPTSGNTGIALAFVAAAKGYDITLTMPETMSQERRTLLLMLGAKIILTPGPLGMKGAIAKAMELLEQTPNAWMPRQFDNPANPAIHKETTALEIWNDTDGKVDMVVSGVGTSGTITGVGTVLKAKNKNIKIIAVEPAESPVLSGGKPGPHKIQGLGAGFVPSVMDRSVVDGVEQVSSEESIKVAREVIKKEGIPVGISSGAAISAGLRQAAKEENRGKNIVVIIPSTTERYLSTLLAEQERAEALSLPVATVDENYLSKVK

SEQ ID NO: 18264 - protein, 605 aa, Oryza sativa
  misc_feature (432)..(452): Xaa can be any naturally occurring amino acid
MSALTTSQLATSATGFGIADRSAPSSLLRHGFQGLKPRSPAGGDATSLSVTTSARATPKQQRSVQRGSRRFPSVVVYATGAGMNVVFVGAEMAPWSKTGGLGDVLGGLPPAMAANGHRVMVISPRYDQYKDAWDTSVVAEIKVADRYERVRFFHCYKRGVDRVFIDHPSFLEKVWGKTGEKIYGPDTGVDYKDNQMRFSLLCQAPRILNLNNNPYFKGTYGEDVVFVCNDWHTGPLASYLKNNYQPNGIYRNAKVAFCIHNISYQGRFAFEDYPELNLSERFRSSFDFIDGYDTPVEGRKINWMKAGILEADRVLTVSPYYAEELISGIARGCELDNIMRLTGITGIVNGMDVSEWDPSKDKYITAKYDATTAIEAKALNKEALQAEAGLPVDRKIPLIAFIGRLEEQKGPDVMAAAIPELMQEDVQIVLLXXXXXXXXXXXXXXXXXXXXXVRAVVKFNAPLAHLIMAGADVLAVPSRFEPCGLIQLQGMRYGTPCACASTGGLVDTVIEGKTGFHMGRLSVDCKVVEPSDVKKVAATLKRAIKVVGTPAYEEMVRNCMNQDLSWKGPAKNWENVLLGLGVAGSAPGIEGDEIAPLAKENVAAP

SEQ ID NO: 18265 - protein, 546 aa, Lophopyrum elongatum
MGLDLGAIALKYTGLAVSDHGSIVAITMFIALLCGCIVFGHLLEGNRWVNESTTALVLGLITGGVILLCTKGVNSRILIFSEDIFFIYLLPPIIFNAGFQVKKKQFFRNFATIILFGAAGTLISFVIITLGAMGLFSKLDVGPLELGDYLAIGAIFSATDSVCTLQVLNQDEAPLLYSLVFGEGVVNDATSVVLFNAIQNIDINHFDVFVLLQFIGKFLYLFFTSTVLGVAAGLLSAYIIKKLCFARHSTDREVAIMILMAYLSYMLSMLLDLSGILTVFFCGIVMSHYTWHNVTESSRVTTKHTFATLSFIAEIFLFLYVGMDALDIDKWKLASSSPKKPIVLSAVILGLVMVGRVAFVFPLSFVSNLSKKESHPKISFNQQVIIWWAGLMRGAVSIALAYNKFTTSGHTAVRVNAVMITSTIIVVLFSTMVFGLLTKPLINLLVPPRPGTAADISSQSFLDPLTASLLGSDFDVGQLTPQTNLQYLLTMPTRSVHRVWRKFDDKFMRPMLGGRGFVPFVPGSPIERSVHGPGLLGTVTEAEDRS

SEQ ID NO: 18266 - protein, 71 aa, Triticum aestivum
VYEDEEEWFREIFSGSKKEDAIQNQYEFLVQRMGGPPLFSQRRGNLIELALFSQLVHCSPKASLFPLPSCH

SEQ ID NO: 18267 - protein, 816 aa, Burkholderia vietnamiensis
MSSPETSRPAEASAPLAAIVIGAGFAGIGMAVALQRAGIHDFVIVERSHDVGGVWRDNRYPGAACDVPSHLYSFSFEPNANWSRVFAPQPEIHAYLQHCARKYGLARHLRFGAEVEHARYDEAGALWRVALADGTTLSAAVLISGTGQLSRPALPKLPGIDTFRGRAFHSAQWDRDYPLAGKRVAVVGTGASAIQFVPAIAGDVARLLVFQRSPAYVLPRPDRPYRRWERTLFRRLPGAMKLHRASIYLRYESRAIAFTRLHGLMDFAVGRPFRKLLARDVRDPALRSKLTPDYPIGCKRILLSSDYLAALGRDNVELVTRGIRRVTETGIETDDGVHHQVDAIVYGTGFAATEFLSPMRITGRDGLDLNDAWRRGAQAYLGVTVPGFPNFFMLYGPNTNLGHNSIVYMLESQIAHVMRCLRAMQRDGASAIDVDPRRYRRYNAHVQQRLEGSVWSGCKSWYVDASGHNSTNWPGFTLSYRWITRFTGLSAYRFSRPLAGDTAPTQAVVVAPPAGRVEALAAASLRGFLRAAFRPLIGPPFGARVQRRVVAMLSPLMPGAGGTLRYRTAAAGVPVEVIAPKRGDAGGVILYLHGGAFCVGSPRTHRSVTTRLAAEAGLPVWAPDYRLAPEHPSPAAVDDALAAYEALRAQGYAPHRIVIAGDSAGGALALALAMALRERGEPAAAALLLISPVTDAALGGATLASRRHDDPMIRRGWLEQGLRWYHGAGAGASRGPLDADLRGLPPMLVQVGDQEVLLSDAQRLAAHARACGVPCRLEIHAARWHVFHLQAFYLQSARDALRTLAGFAAQRVAAPV

SEQ ID NO: 18268 - protein, 381 aa, Listeria monocytogenes
MSEDLFDVEVRNFEEGDKVTGTVTSVEDKQVYVGIPGSKLDGVVPISELSNIHVETASDVVSVGDTLDLIVTKVEDDILVLSKRKVDAEKASDDIKAKFESGEVFEAVVSDVVKGGLVVDLGVRAFVPASLVEDHFVEDFADYKGTTLTFKVVEFEPENNRVILSHRAVVETEKASQKQALLSEIKEGDVIEGTVQRLANFGAFVDIGGVDGLVHISQISYKHIATPQEALEEGQKVTVKVIGIDPENERISLSIKATLPGPWDGIAEKAPVGSVLEGKVVRLVTFGAFVEIFPGVEGLVHISQISHEHIGTPQEVLSEGQTVEVKVLEVNEADKRLSLSIKELKDAPVEEADYELPEENTGFQMSDLIGDKLKGLQNDDK

SEQ ID NO: 18269 - protein, 437 aa, Acidobacteria bacterium
MKYAFVNPKWSFTGSTYFGCRDPHYPLELLFAAQKVENAGHAPLLVDAQNDDLALEEVKRRVAEFEPDFLVIPSAPSYLFWRCPPPELRVPMDYFRAIETSATKVCIGPHASATPAAVLRKTGADIVIKGEPEQAIFELATKPWEQIDGVCYRRGDGSLHISPTLAVVDMKTLTALDFSNYSIERHAHRHHVFFGEGRGAELEFARGCPWNCYFCNKQLFRNKFRERPVDAILSEIDAVIARGVNYVYFIDEIFGVGKNVRMLLEEISKRNVSIGFQTRIDLWDEDSLDLLGRAHCISMECGIESITEEGREELNKNCRMTTERITELLIYAKEKAGIPWVQANLILTDKDDKNEIHRWQDNLKSHGVWVSEPVPMFPFPGSPLYSQTFGAAPDDNAWERAHSHYMSQFREGDWSDIQEQLPRSIAELESVEENAAR

SEQ ID NO: 18270 - protein, 368 aa, Candida glabrata
MSFYNVLKNGDDMLREYPRRSIIWRILSYGTCLFTYGVSRMILSTLYNFKVFNFERLENAMKRSKAENRGVLTIMNHMSMVDDPFVWATFPIRFYSSVDRFRWCLGAENICFQNAALSYFFSLGKTLSTRRFGAGPFQDSIDATVRLFSTDETLLKDKDPNYKPPVRQKSPPWVHIYPEGFVLQLQPPHSNSMRYFRWGVARTILESTVPPIIVPIFSTGFEKIASEEAKGMMRQLMPRNYGSKIKVTIGEEISDEIIFRYRKEWQVLVEKYKDCNNPDEMPDELKYGEEAEDLRSRLAAELREHVAKIRHDECHFPEEDPRFKSVSWWKKFNCSEGESDPDVKIIGKNWAIKRLQTHLKNNENTKDH

SEQ ID NO: 18271 - protein, 614 aa, Glycine max
MSYDKNPSPVPTSTTGDEEKKVTGGGYDVGVYSAHGRVDHNARAVDGHDLNDSYDPSKESLLTRLGLNIESFKRAPGTTRGLVAHGDIPPEYLQHDNPLLQQKMKPRHLQMIAVGGSIGTGLFVGSGASLGNGGPAAVLMAWIIMGVMLIMVTQALGEMAIIYPVSGGFYTLASRMLDPSFAFAMGWNYVLQWAVVLPLEITVAGTTVQYWTDKVPLGVWITIFFLLIIFFATLGTLGYAEEEFWSSCLKLAVVIMFIFIGIVCICGGGPASGDYGSYVGGRYWQNPGAFANGFKGVCAMFVTAAFSFAGTELVGLAATETPNPRKTLPSAVKNTFWRITIIYITSLTIIGLLIPYDDPDLFGGSGANVSPFVIVLDRANIGGLNHLVNATICISVLSIGLSCVYAGSRTLTALAETGYAPKMFTYVDKSGRPLYSVLAILAFGPIAYVNLANVGTDVFNWLLALSGLSTLFTWLAICVTHIRFRQAWKIQGHSVEELPFTAIAGVWGSWLGAILIVIVLIAQFYIGLFPLGGVESGNARAESFFLSYLAFPILLAFWVVGYAWKRTLPRKTTEIDLDTGRKSWLTVEEMRQYKAERRLAPWWKRIYRMLFTSS

SEQ ID NO: 18272 - protein, 329 aa, Neisseria meningitidis
MKITVIGAGSWGTALALHFSQHGNRVSLWTRNADQVRQMQEARENKRGLPGFSFPETLEVCADLADALKDSGLVLIVTSVAGLRSSAELLKQYGAGHLPVLAACKGFEQDTGLLTFQVLKEVLPDNKKIGVLSGPSFAQELAKQLPCAVVLASENQEWIEELVPQLNTTVMRLYGSTDVIGVAVGGAVKNVMAIATGLSDGLEYGLNARAALVTRGLAEITRLASAMGAQPKTMMGLAGIGDLILTCTGALSRNRRVGLGLAEGKELHQVLVEIGHVSEGVSTIEEVFNTACKYQIDMPITQTLLQLIRKEMTPQQVVERLMERSARFE

SEQ ID NO: 18273 - protein, 1301 aa, Oryza sativa
MLLHILGSSTLAPARPSPLRQSGAGTGAATVRCASSSSNPSPSSSSSAAAAAGKQVAKVHSYGALDYERRAALRWSSLYRRIAVGHGGRPVGRTLGAWDEGERRLDKWELCRIARELRKFRRFNLALQVYDWMTERRDRFSLSSSDMAIQLDLIAKVRGVSHAEEYFEELPDPLKDKRTYGSLLNVYAQAMMKEKTESTFEQMRKKGFATDTLPFNVLMNFYVDAEEAEKVSILIDEMMERNVAFDVCTYNIWIKSCAAMQDADAMEQVFNQMIRDETVVANWTTYTTLASMHIKLGNSEKAEESLKEAEKRTTGREKKCFHYLMTLYSHLGKKEEVYRVWNWYKATFPTIHNLGYQEVLSALVRLGDIEGAELLYEEWASKSSSFDPKTMNILLAWYAREGFVTKAEQTLNRFVEKGGNPKPNTWEILGTAYLKDGQSSEALSCLEKATAVASPSKWRPRPTNVESLLANFKEKNDAESADRLMNVLRSRRPPPVKPPAAAAAVAGGGVAGTPGGKGRGLGASGEGIGSSGGRGDPQSRRCTRSASAKGSGDARSVEEGGPRVAGDDGGSGKSGVAAEGSGFEGLRNGRGGGVGTAAAEDCGLEKSNPDGIVGDADVHLESGSDARDGECVSEGLKKPCVNNSNGSSAADCAPKVKKGNDSGDGGADECNAAAKSSNLACPGNNGDETNRKGRKVVLPWRFQVGFKRSFSKAFCSDSESSGPSGTQFYRAQDSSTPCTPATRSSVRCYASAHSGVRVSAMRDFSVKGEKETSTPYKKSKTGMDGPSQGMPKNGVVLARENIMGSLQNFRLIYRDLLDEEEEKSTEAVIRPDLQAYRIFRERFITDCDEKKYIGNVPGIKVGDIFHLRVELCVVGLHRPHRVGVDHIKQEDGTCIAVSIVSYAQSSDIKNNLDVLVYSGAMTAIANQKIEGTNLALKKSMDTNTPVRVIHGFVTHLNGNCQRKKIPTYIYGGLYIVEKYWREKEGNDRYVYMFRLRRMAGQKHIDIQDILNSGQAESYGGIIIKDISRGLEKIPVSVVNSISDEYPMPYRYIAHLQYPRNYQPAPPAGCGCVGGCSDSKRCACAVKNGGEIPFNDKGRILEAKPLVYECGPSCKCPPTCHNRVGQHGLRFRLQVFKTKLMGWGVRTLDFIPSGSFVCEYIGEVLEDEEAQKRTTDEYLFAIGHNYYDEALWEGLSRSIPSLQKGPDKDEEASFAVDASKMGNFAKFINHSCTPNLYAQNVLYDHDDKSVPHIMFFACEDIPPRQELSYHYNYTIDQVHDANGNIKKKKCLCGSIECDGWLY

SEQ ID NO: 18274 - protein, 324 aa, Nostoc punctiforme
MSVIFFPPPIQQINSEIIRSAGVDLYVLRLDLMHPWVNGNKWFKLKYNLLEAKEKNFTTLLTFGGAYSNHIYATAAAGNLFGFRTIGVIRGEERLPLNPTLNFAVQQGMQLVYTNREMYRQRNTPVVEEYLQQRFGEVFIIPEGGSNLNGVRGCMEIIGDAMSTAVTERSRSAGYAYAFDRICVACGTATTLTGIALSLHQGQRAIAFPVLKNGSFLAQEIESLLTNYLASDLPTPSNSPAFWELVCDYHFGGYAKVNKELLLFSQQFREEHGIPLDYVYTAKMFYGVMDLLKQGFFSKGDSLLLVHTGGLQGNVGMEERFQRM

SEQ ID NO: 18275 - protein, 166 aa, Zea mays
  misc_feature (19)..(19): Xaa can be any naturally occurring amino acid
VENRFCLSHGRGLRALSRXQIDSVLDLARCTIVSELSNKDFDSYVLSESSLFIYPLKIVIKTCGTTKLLLTIPRILELAEELSMPLAAVKYSRGTFIFPGAQPAPHRSFSEEVAALNRYFGGLKSGGNAYVIGDPARPGQKWHVFYATEYPEQPMVNLEMCMTGLD

SEQ ID NO: 18276 - protein, 544 aa, Thermobifida fusca
MSSDQVQAGGLTVTLRGPVRDAAENALQQLRASRVASRLAAKDATLWGPAAEPEASIRLGWVDLPQESRALLPQISEIAQAKREAGLDRVVLAGMGGSSLAPEVIAASRDARLITLDTTDPHQVRRVVTTDLDRTVVVVASKSGSTVETDSHRRAFEQAFADAGIDPAERIVVVTDPGSPLAELAGERGYPTVLANPHVGGRYSALSAFGLVPSALVGVDIEALLDEAAALAATLADDTNPALLLGAALGGFSGRDKVVLAGATPVGLGDWIEQLVAESTGKDGTGLLPVVVESASAPGFTPGPDTHLVVYGETEPEVPETADTVVTGPLGAQFLAWEYATAVAGHLLGINPFDQPNVQESKDNTKALLELSNNGTLPTGTPLLTDGAVEVYASDGTGVGDAKNLASVLRALIEQIPDDGYLAVMAYLDRDAEGDGQAAALRSELAALTARPVTFGWGPRFLHSTGQYHKGGPANGVFLQITGDITEDLPIAGKPYTFSRLQLAQALGDFNALAERSRPTVRLHWRDRSAGLAELIRALGEIRP

SEQ ID NO: 18277 - protein, 150 aa, Zea mays
MAAAAGRKVAVAAVQFACTAERLIREAHKKGAKIVLVQELFEGHYFCQAQRLDFFRRAKPYKGNPTIIRMQQLAKELEVVIPVSFFEEANNAHYNSVAIIDADGADLGLYRKSHIPDGPGYQEKFYFNPGDTGFKAFKTKYATIGVGICL

SEQ ID NO: 18278 - protein, 451 aa, Oryza sativa
MASWVSARGAATAYATGAADANAAENVLPSATAAQHLHHPLALSMSSGSLSSCITAGEYGMAAVAAADGGRKRGGAGGGGQKQPVHHRKSIDTFGQRTSQYRGVTRHRWTGRYEAHLWDNSCKKEGQTRKGRQGGYDMEEKAARAYDLAALKYWGPSTHINFPLEDYQEELEEMKNMTRQEYVAHLRRKSSGFSRGASMYRGVTRHHQHGRWQARIGRVSGNKDLYLGTFSTQEEAAEAYDVAAIKFRGLNAVTNFDITRYDVDKIMASNTLLPADLARRNAATTTSKDDHSAAGAGAIVSVHSAADIAVADTLWKATTAPRQQQQHHDDVVLSGADQAAFSVLHDLVAVDAAAAHHHQQQQQHMSMSAASSLVTSLSNSREGSPDRGGGLSMLFAKPSPAVAASAQQQASTKLMAAPLPLGSWVSSPPASARPPAVSIAHMPLFAAWTDA

SEQ ID NO: 18279 - protein, 469 aa, Zea mays
METVFKWRARTGGGVSLIHLLVRCFAVSAAILLLADGRHADAVDPAAPVEIQQTGSSSEVADEQQWRMVRTRGNQFVVGDDDDHRPFYVNGFNTYWLMILAVDPSTRGKVTEVFQQAAAAGLTVCRTWAFNDGGWRALQKSPSVYDQDVFKALDFVVSEARKYRIRLILSLINNWDSYGGKAQYVKWAGDDAAADGGRLNITASVDDDFFSDQTVKVYFKNHVKNMLTRVNTYTSVMYKDDPTIFAWELMNEPRCTSDPAGNKLQGFYGPSTPSRFPANPNAYAGQVGTDFIRNHRVLGVDFASVHIYPDTWMPGATLEARLWFVDSWMEAHIADADGTLGMPVVFTEFGASTTKARSGCFNATTRDQFIHAVYARLLNSTRRGGAGAGALLWQMLPLGTDYMDDGYGVVLPRAAATARIISAHSRDLAIFNSRCAWSCRWGCRRRGHKSEDPDVDDDLPLVEDKQREA

SEQ ID NO: 18280 - protein, 1166 aa, Capsella rubella
MKQKWLFVLILCFFTALGIHGKRLINSDFDETALLMAFKQFSVKSDPNNVLGNWIYESGRGSCSWRGVSCSDDGRIVGLDLRNGGVTGTLNLANLTALPNLQNLYLQGNYFSSSSGGDSSSGSYCYLQVLDLSSNLISDYSLVDYVFSKCSNLVSVNFSNNKLVGKLGFAPSSLKSLTTVDFSYNILSEKIPESFISEFPASLKYLDLTHNNFSGDFSDLSFGMCGNLSFFSLSQNNISGVKFPISLPNCRFLETLNISRNNLAGKIPGGEYWGSFQNLKQLSLAHNRFSGEIPPELSLLCKTLETLDLSGNALSGELPSQFTACVWLQNLNIGNNYLSGDFLSTVVSKITRITYLYVAFNNISGSVPISLTNCTNLRVLDLSSNGFTGNVPSGLCSQQSSPVLEKLLIANNYLSGTVPVELGKCKSLKTIDLSFNELTGPIPKDVWMLPNLSDLVMWANNLTGSIPEGVCVKGGKLETIILNNNLLTGSIPQSISRCTNMIWISLSSNRLTGKIPTGIGNLSKLAILQLGNNSLSGNVPRQLGNCKSLIWLDLNSNNLTGDLPGELASQAGLVMPGSVSGKQFAFVRNEGGTDCRGAGGLVEFEGIRAERLERFPMVHSCPATRIYSGMTMYTFSANGSMIYFDISYNAVSGLIPPGYGNMGYLQVLNLGHNRITGNIPDSLGGLKAIGVLDLSHNDLQGYLPGSLGSLSFLSDLDVSNNNLTGPIPFGGQLTTFPVSRYANNSGLCGVPLRPCGSAPRRPITSSVHAKKQTLATAVIAGIAFSFMCLVMLFMALYRVRKVQKKELKREKYIESLPTSGSCSWKLSSVPEPLSINVATFEKPLRKLTFAHLLEATNGFSAETMVGSGGFGEVYKAQLRDGSVVAIKKLIRITGQGDREFMAEMETIGKIKHRNLVPLLGYCKVGEERLLVYEYMKWGSLETVLHEKSSKKGGIFLNWTARKKIAIGAARGLAFLHHSCIPHIIHRDMKSSNVLLDEDFEARVSDFGMARLVSALDTHLSVSTLAGTPGYVPPEYYQSFRCTAKGDVYSYGVILLELLSGKKPIDPGEFGEDNNLVGWAKQLYREKSGTEILDPELVTEKSGDAELFHYLKIASQCLDDRPFKRPTMIQVMAMFKELKADTEEDESLDEFSLKETPLVEESRDKEP

SEQ ID NO: 18281 - protein, 297 aa, Haemophilus influenzae
MSVKGDIGVIGLAVMGQNLILNMNDHGFKVVAYNRTTSKVDEFLQGAAKGTNIIGAYSLEDLAAKLEKPRKVMLMVRAGDVVDQFIEALLPHLEEGDIIIDGGNSNYPDTNRRVKALAEKGIRFIGSGVSGGEEGARHGPSIMPGGNQEAWQYVKPIFQAISAKTEQGEPCCDWVGGEGAGHFVKMVHNGIEYGDMQLICEAYQFLKEGLGLSYDEMQAIFAEWKNTELDSYLIDITTDILGYKDASGEPLVEKILDTAGQKGTGKWTGINALDFGIPLTLITESVFARCVSSFKDQ

SEQ ID NO: 18282 - protein, 429 aa, Nostoc punctiforme
MISKSLLPLEPASPAHICPFDQACSYLEAAAKELNLNQGLLEILSHPRKVVTVSIPVKLDDGEIQVLAGHRVQHSDVLGPYKGGIRYHPAVTLREVSALAMLMTWKCALLGIPYGGGKGGIPIDPKRYSVGELERISRRYISELLKDIGPSVDIPAPDMGTSAREMAWMMDTYSVNVGHAVPGVVTGKPLSIGGSLGREMATGRGTMIIVREALADRGKSLVGVRVAIQGFGNVGGAAAELLHQAGAKIIAVSTGAGGIFSEAGLDIPALKIYAAENRKSIVGFPQSVPISNADLLTLPCDVLIPAALENQITGENVNQVQAQIVAEAANGPVTLEANLALEARGVTVLPDILANAGGVVVSYLEWVQGLSYVFWDEERVNREMEHLMVQAYRKVIQQSNKRQISLRLAAYTLGVGRVAQALTDRGLYP

SEQ ID NO: 18283 - protein, 241 aa, Zea mays
MATTAGAGGAGKLKLLGAWPSPFVNRVRVALHLKGLEYENVEEDLTNKSDQLLASNPVHKKVPVLLHGDTPVSESLVIVEYLDDAFPGAGQALLPADPYERAVARFWAAYVDGKLHGMMVKAILGATEEERAAATADALAAMETLEGAFAECSGGKEFFAGDEPGYLDVVLGGFIGWLRAWDKVGGVKLLDGGRRTPRLAAWAERFAALDVARDVIPDPDHIAEFAKVLQARSAAAAAAGN

SEQ ID NO: 18284 - protein, 428 aa, Debaryomyces hansenii
MTAIQKPVVAKREAPKAEVNPTVSRLTQTETIKPTKERTVSVFSPPVFNFAANSFAQSVSNEYKHASPKRIKLDNSRVQVPSIVKPKQDKPRPPAIVTKPRVINIEFPNKQKSGFKLLIRPKHEPSIKKQKQGIEVLSTSNTKRITKSISVDDVEYVEKVKHAIKQVLPKPDYDDGSLGPVILRLAWHCCATYNKFTGNGGSNGSTMRFVPEITDDGNSGLDIARSALEPIKQKFPDITYSDLWTLAGKISIQEMGGPKIPWRCGRVDCIDDRYVPPNGRLPFAYKNANHIRETFGRMGFNDRETVLLLGAHGLGRCHKRFSGWEGKWTENPTSFSNDFYKVLLDEEWSLGTVPETGKEQYYNKDKSLIMLNTDIELIRDPHFLHFVKLYSQHQATFFQDFANAFGKLLELGIERDSNGNVLPKNEFY

SEQ ID NO: 18285 - protein, 169 aa, Oryza sativa
MALVEGNNGVSGGAVSFSEEQEALVLKSWAIMKKDSANIGLRFFLKIFEVAPSASQMFSFLRNSDVPLEKNPKLKTHAMSVFVMTCEAAAQLRKAGKVTVRDTTLKRLGATHFKYGVGDAHFEVTRFALLETIKEAVPVDMWSPAMKSAWSEAYNQLVAAIKQEMKPAE

SEQ ID NO: 18286 - protein, 118 aa, Nostoc commune
MSTLYDNIGGQPAIEQVVDELHKRIATDSLLAPVFAGTDMVKQRNHLVAFLAQIFEGPKQYGGRPMDKTHAGLNLQQPHFDAIAKHLGERMAVRGVSAENTKAALDRVTNMKGAILNK

SEQ ID NO: 18287 - protein, 470 aa, Solanum tuberosum
NKIKPGVAYSVITTENDTQTVFVDMPRLERRRANPKDVAAVILGGGEGTKLFPLTSRTATPAVPVGGCYRLIDIPMSNCINSAINKIFVLTQYNSAPLNRHIARTYFGNGVSFGDGFVEVLAATQTPGEAGKKWFQGTADAVRKFIWVFEDAKNKNIENIVVLSGDHLYRMDYMELVQNHIDRNADITLSCAPAEDSRASDFGLVKIDSRGRVVQFAEKPKGFDLKAMQVDTTLVGLSPQDAKKSPYIASMGVYVFKTDVLLKLLKWSYPTSNDFGSEIIPAAIDDYNVQAYIFKDYWEDIGTIKSFYNASLALTQEFPEFQFYDPKTPFYTSPRFLPPTKIDNCKIKDAIISHGCFLRDCSVEHSIVGERSRLDCGVELKDTFMMGADYYQTESEIASLLAEGKVPIGIGENTKIRKCIIDKNAKIGKNVSIINKDGVQEADRPEEGFYIRSGIIIILEKATIRDGTVI

SEQ ID NO: 18288 - protein, 284 aa, Ipomoea nil
WESHIWDCGKQVYLGGFDTAHAAARAYDRAAIKFRGVEADINFSLEDYEEDLKQMSNLTKEEFVHVLRRQSTGFPRGSSKYRGVTLHKCGRWEARMGQLAGKKAYDKAAIKCYGREAMTNFEPSAYEGEMNKNTRDGGTNASLDLNLWISPPLDGPKRPENARKLQFNFEARDLSLLKRVKVECTPGTPYGPAMASQYSRWPGLQSALTPNNEEGLMGTNAEASSPVFSNLRWLSQGVAPSAPRFSSAASSGFSSTATSMFKFPSAAPPPSAASQNHLMTLRPN

SEQ ID NO: 18289 - protein, 323 aa, Brassica napus
MDLDSMDCASTIDVTDDEEIHQDRHSYASVSKHHSNNSNANAASGLLPTTTSVHELLECPVCTNSMYPPIHQCHNGHTLCSTCKNRVHNRCPTCRQELGDIRCLALEKVAESLELPCKYMSLGCPEIFPYYSKLKHETVCNFRPYNCPYAGSECSVMGDIPFLVAHLRDDHKVDMHSGCTFNHRYVKSNPREVENATWMLTVFHCFGQYFCLHFEAFQLGMAPVYMAFLRFMGDETEARNYNYSLEVGGYGRKLIWEGTPRSVRDSHRKVRDSHDGLIIQRNMALFFSGGDRKELKLRVTGRIWKEQQQSGEGGGGACIPNLS

SEQ ID NO: 18290 - protein, 466 aa, Oryza sativa
METSYREEEARRKASLLHCIFFFLLGALAMAAAIAVLHESSYWEWRCNRLTDIVVDGDDGDGPSSSEVVDGGGEWGMVRTRGAQFVVGGGRPFYVNGFNTYWLMVLAVDPSTRGKVTEVFRQAAAVGLTVCRTWAFNDGGWRALQKSPGVYDEEVFKALDFVVSEARKHKIRLILPLINNWDDYGGKAQYVRWAQAAAAGAGADAFFSDETVRGYFKSHVTAVLTRVNAYTGVAYRDDPTIMAWELMNEPRCASDPTGDTLQAWIAEMAFHVKSVDPAHLLGVGAEGFYGPSSPPARLRGEPQRRLRPRRGQLRPQTPRPRVRFCLRSPVPGELGGVRGMPVLLAEFGVSTRGRPGRRSTRPSRDAFIEAVYGAMLRSTRRGGGGAGALLWQVFPEGTDYMDDGYAVVLPRAAATAGIVAAHSRRLQSFNSRCAWSCRWGCNKRDNDTAETTTAEADVDVSFHHEL

SEQ ID NO: 18291 - protein, 244 aa, Aspergillus oryzae
MSLPQRTASLTRITNETKIQISLSLDGGVLPPYEPTDHFPAPEDPKEAEAATHGIVPPKDAHHATQFTATQQITVSTGIGFLDHMLHALAKHSGMSLAIRAKGDLYIDDHHTTEDTFLALGAAFTKALGARQSIARFGRGDAPLDEALSWAVIDISSRPWAVINLGFRREKIGDLSTEMITHGLQSFAQEAGVTLHVCCTYGDNDHHRAESAFKALAVAIRTACTRRVAGEVGAGDIVSTKGVL

SEQ ID NO: 18292 - protein, 96 aa, Betula pendula
CDHLRVVFGQQMGLSDQDIVALSGAHTLGRCHKERSGFEGPWTSNPLIFGNTYFTELLSGEKEGLLQLPSDKAPLSDAAFRPLVDKYAADEDAFFV

SEQ ID NO: 18293 - protein, 411 aa, Pyrococcus horikoshii
MCMVKVWVEKLLDEPELYILRLDDSEIKHFEAAWSIPEGITYNAYLMKVGDAVVLFDTWKGEYTEKFLESLSTLVDPKEITHIIVHHTEPDHSGALPKLLELNEYRAKLIGTTFAKNLLQGFYGDKVVENFHTIKDGEEVKIGNRTFRFITVPWLHWPDTMITYDVEDKLIFSCDAGGGYGIPEAIDDSDEDVVKKYLPYVTKYIVTVIGHYHKYIVQNIKKLKELGIIENANMILPGHGLIWRKSPTRIFEHYERVGAGIPTKDKVLVIYDSMYGFVEKRMSVVIEELKRYGKKPVVYRFTDKENPAISDILGEVPDSEALVIGVSTYEADIHPRMRCALYEILDKANYEKPVLIVGAFGWGGVAGKKVETLISRSKFELVDVVETKGRMTSEDEERLREAVRKLIQWQL

SEQ ID NO: 18294 - protein, 109 aa, Oryza sativa
MAGKLYQLMSRMHLARSRSSSSSAATAAAAAADVPRGHFAVYVGERRKRFVIPTAYLKHPSFVLLLKRVEEEFGFDCHRCGGLTIPCATEGDFASFVAEAIASDDHHHH

SEQ ID NO: 18295 - protein, 794 aa, Candida albicans
MVQLALFTNNNHNNNSNNNTTNTLNDDTQYDSTTMNTEDTPIIPDKTDKLNGSDSRSSSRNRTRSISFTRFLFNSNNNNNNNKDHTEQSRCPSNETSDNSVGSPEQQNSGFNKLKKMFKTNSSLTQEDGKNSGRTRSASTPLTPPKVKKETSVPVITTTKAPNKEETTTTKIHSPPESPVVQSNPYFQYQGVPAHTNTSQNPQIETAPGRSDMSVALRHNDSVFSLNENGVLKPPKIHYSELSSSSEDNSEPSSPALPKTPMRDLVEKDELHLKPIEDERDLAIPASPFQRALRRVASAPLVHRLLNEKSPEDANNNNNNNTGNNLGGPFSTSTQTSPKKDEPFDINKHIGEVKITGRPRTYTQDRTYSNAATRIVDVQVGPNSFEKVRLLGKGDVGKVFLVREKSSNKLYAMKILNKKEMIERNKIKRALAEQEILATSNHPFIVTLYHSFQSKDHLYLCMEYCMGGEFFRALQTRDTKTICEADAKFYAAEVTAALEYLHLMGFIYRDLKPENILLHQSGHIMLSDFDLSKQSERAKNPEISFHKSGMHLSSAGSSNHHNGPAIDTKACIDGFRTNSFVGTEEYIAPEVIRGKGHTSAVDWWTLGIFLYEMLFGTTPFKGQDRKKTFANVLKKDVKFSDTQQSISSNCRNLIKKLLIKDEEKRLGSKTGASEIKNHAFFKDTQWALLRHQKPPMIPVLTKSTSTSNSNKKYEKPMEDTEEIDDVTSISKSINEQIDDPFSQFNSVTLRYGGEFEDLNQSPMYNPDSSAYTSVAYTMTSNNENSFRQKSFLKR

SEQ ID NO: 18296 - protein, 694 aa, Hordeum vulgare
MSASLSMSGGAGEAATRTVVWFRRDLRVEDNPALAAAARTAGEVVPAYVWAPEEDGPYYPGRVSRWWLSQSLKHLDASLRRLGASRLVTRRSTDTVAALLELVRSTGATHLFFNHLYDPLSLVRDHRVKQVLAAEGISVQSFNSDLLYEPWEVLDDHGSPFTMFTSFWNKCLCMVDPPAPMLPPKRINSGDLTRCSSDDLIFEDDSERGSNALLARAWSPGWQNADKAFTAFINGPLIDYSVNRKKADSANTSLLSPYLHFGELSVRKVFHQVRMKQLTWSNESNRDGEEGCSLFLRSIGLREYSRYLAFNHPCSHEKPLLAHLRFFPWVVNEVYFKVWRQGRTGYPLVDAGMRELWATGWLHDRIRVVVSSFFVKVLQLPWRWGMKYFWDTLLDADLESDALGWQYISGSLPDGRELDRIDNPQFEGYKFDPYGEYVRRWLPELARLPTEWIHHPWDAPESVLQAAGIELGSNYPLPIVELDEAKSRLQDALSEMWELEAASRAEIENGMEEGLGDSSDEPPIAFPQELQHMEVDRATSHTPATAGPARRRADQMVPSITSSLVRAETETELSAVFESEVSRPEVPSQVHFQAQPRMESREQVASDGTAARYNQQYTLHRVQGGGIAPSTSEASSSWTGREGGVVPVWSPPAASGHSDPYAADETDISSRSYLDRNPQSHNRLMNWNQLSQSS

SEQ ID NO: 18297 - protein, 255 aa, Acidobacteria bacterium
MRLKGKHALITGGDQGIGRGIALRFAQEGADVAIGFLSNDDHAKSAVEEMRSHGVNAAALQIDVSNIGALAKFYADATRALGPLDVLVNNAGIEKRDEFLKSTEDDFDSVIAVNLKGPYFLSQLFARDLAEAKRPGKIINISSVHEELPFPNFASYCAAKGGLKMLCRNLAIELAPYGITVNNIAPGAIKTPINDKLLHDPSKLKPLLEHIPLKRMGTTDDVAGCAAFLASSDADYITGTTLVVDGGLLFNYHEQ

SEQ ID NO: 18298 - protein, 157 aa, Volvox carteri
MAPKKEEKPASQAAEAPEVKAEAKPKAVKAPKKKEKKAPAKKVAKEPSAGGEDGDKKSKKKAKVAKSETYKLYIYKVLKQVHPDTGISSKAMSIMNSFINDIFEKVATEASKLSRYNKKPTVTSREIQTAVRLVLPGELAKHAVSEGTKAVTKFTSA

SEQ ID NO: 18299 - protein, 210 aa, Xanthomonas axonopodis
MPSRSKSSQRWLKEHFADPYVKKAQAEGMRSRAAYKLEELLQRDRLLKPGMVVVDLGAAPGGWSQQVRKSMGDSGRVVALDILDMPALAGVEFLHGDFREQAVLSQFEAMLGDVPVDLVLSDMAPNKSGMDAVDQPRMMHLAELAMEFADTHLKPGGAFLIKLFQGVGSDDYIRELRRRYEKVTIRKPAASRKRSPEVYALGQGKRVQIK

SEQ ID NO: 18300 - protein, 125 aa, Betula pendula
LKQEPGTSEETEQFACTRYKAEYPIFQKIRCNGPDTAPLYKFLKASKTGFLGSRIKWNFSKVAFPCNQFLKQEPGTSEETEQFACTRYKAEYPIFQKIRCNGPDTAPLYKFLKASKTGFLGSRIK

SEQ ID NO: 18301 - protein, 262 aa, Unknown
  Synechococcus sp. WH 8102
MTNAEQTGTVYLVGAGPGDPELLTLKAHRLLSQCDALVYDSLVPREVLDLVPASCERRFVGKRRGHHSVPQPSTNAVLVEMAQKHSTVVRLKGGDPFLFGRGGEEAAYLAERNIPVQVVPGVTAGIAAPAYAGIPVTHRRAGSSVTFVTGHEEIDKRRPSVDWRALATASDGLVIYMGLHNLPRIAEELMAGGLAATTPVAVIQQGTVAGQRCLKATLVDVADQCRAEAFKSPSIVVVGEVIDQQVEACRPSPAAVTMPILF

SEQ ID NO: 18302 - protein, 361 aa, Emericella nidulans
MASAARSASRAFLRSSLRPAVRSSRFALPTQGLRVASRRGYSSEASSGKSSNTLLWAGVALAGGAGAYFYLQGGDVGASTKVFTPTKEDYQKVYNAIAERLANETDYDDGSYGPVLVRLAWHASGTYDAETGTGGSNGATMRFAPESDHGANAGLKYARDFLEPIKAKFPWITYSDLWTLAGACAIQELGGPDIPWRPGRQDKDVSGCTPDGRLPDATKNQDHIRAIFGRMGFDDREMVALIGAHALGRAHTDRSGFDGPWNFSPTVFTNEFFRLLVEEKWQPRKWNGPKQFTDNTTKTLMMFPTDLALVQDKGFRKHVERYAKDSDAFFKEFSEVFVKLLELGVPFNSKVEDRYVFKRSE

SEQ ID NO: 18303 - protein, 171 aa, Argyroxiphium caliginis
YQAFELIHARWAMLGAAGCIIPEAFNKYGASCGPEAVWFKTGALLLDGNTLNYFGKNIPINLVVAVVAEVVLVGGAEYYRIINGLDLEDKLHPGGPFDPLGLAKDPDQFALLKVKEIKNGRLAMFSMFAFFIQAYVTGQGPVENLASHLSDPFGNNLLTVISGNIERVPTL

SEQ ID NO: 18304 - protein, 254 aa, Dechloromonas aromatica
MNTTKQLQGGKVWLVGAGPGDPELLTIKAARLISMADAIVYDHLVGNGIMDMARADARLVYAGKESSKHTMPQDSINQLLVDLANEGLSVVRLKGGDPFIFGRGGEELETLVASGVPFEVVPGVTAAAGCAAYAGFPLTHRDHAQSVTFVTGHLKDGTVNLDWTALARPCHTVVFYMGIGAAEEICRQMINHGLPSMTPAAVIRNGTQSDQRTLLATLGTLPHRIAESGIKPPALIVVGSVVGLHEKLNWFEKQ

SEQ ID NO: 18305 - protein, 291 aa, Pseudomonas fluorescens
MTVTKTSEYLETLYEGYGQRFRMEKLLHEVRTEHQHLVIFQNPRMGRVMALDGVIQTTEADEFIYHEMLTHVPILAHGTAKRVLIIGGGDGGMLREVTKHASVEHITMVEIDGTVVDMCKEFLPNHSSGAYDDPRLNLVIDDGMRFVATTTEKFDVIISDSTDPIGPGEVLFSENFYQACHRCLNEGGILVTQNGTPFMQIEEVKTTAGRLRSLFPDWHFYQAAVPTYIGGSMTFAWGSTNPAYRKLSREVLQQRFIGSGIVTRYYNPEIHIGAFALPQYVLQAVNKPSND

SEQ ID NO: 18306 - protein, 171 aa, Argyroxiphium sandwicense
YQAFELIHARWAMLGAAGCIIPEAFNKYGASCGPEAVWFKTRALLLDGNTLNYFGKNIPINLVVAVVAEVVLVGGAEYYRIINGLDLEDKLHPGGPFDPLGLAKDPDQFALLKVKEIKNGRLAMFSMFAFFIKAYVTGQGPVENLASHLSDPFGNNLLTVISGNIERVPTL

SEQ ID NO: 18307 - protein, 112 aa, Unknown
  Frankia sp. CcI3
MRLVTAILRPHRIDDVRTALETFGIQGMTVSQVTGFGIELWRTQTYRGQTFHDESVSAVRVECVVADCDVEDVIEVIRRSGGSAASGAGKIWVLPVDAIARVRTGERGPDAL

SEQ ID NO: 18308 - protein, 420 aa, Triticum aestivum
MLLRPALPVAVSSTLPLFSHLAAVRRRCSIAATGMAGVSAASPAAAQIGSFLSKKPYAPPSWASHLALAPSHTFSLGHFPTPIHKWNLPNLPEGTEVWIKRDDLSGMQLSGNKVRKLEFLLSDAVAQGADCVITVGGIQSNHCRATAVAAKYLNLDCYLILRTSKLLVDQDPGLVGNLLVERLLGAHIDLVSKEEYGKIGSVALADLLKNKLLEEGRKPYVIPVGGSNSLGTWGYIEAVRELEQQIQLSGDVQFDDIVVACGSGGTIAGLALGSKLSSLTAKVHAFSVCDDPEYFYDYVQGLIDGLQSGLDSHDIVSIQNAKGLGYAMNTAEELKFVKDIATATGIVLDPVYSGKGAYAMLKDMADNPSKWKGRKVLFVHTGGLLGLYDKVDQMSSLAGSWRRMDLEESVPRKDGTGKMF

SEQ ID NO: 18309 - protein, 608 aa, Streptomyces hygroscopicus
MCGITGWVSFHQDPRTQAPVIEAMTATLAPRGPDAAGVWLGPRAAIGHRRLAVIDLAGGVQPMTDRPDAPTTVLTYSGEIYNHHELRSQLSGLGHEFRTRSDTEVVLRGYAEWGEKVADHLDGMFAFAVWDERAQRLLLVRDRLGVKPLFWAEVDGGLAFASEPKALFAHPEIRPRVDADGLREAYSLLFNTGPTVWSGVREVEPGGLLLLDRDGIRERRYWQLEADAHPDDRDATIARVHDLVSTAARAQLEADVPLCSLLSGGIDSTVLTALLADELRLREGPGARIRSYAVDYSDQAESFTGDVLRTGHDTPYATEAGAFLGTDHSTVVLDPRALLDPEHRRAVVVARDSPIGVGDMDTSLHLLFGEIRKHSTVALSGEAADEVFGGYPWFHNPKALATATFPWLLVTGDEAAMPLNPELDLRIGEFRDDTYRTALAAVPHLDGETPTEHRQREMQHLSLTRWLRQLLHRKDRLSMAQGLEVRVPYCDHRLVEYAFTTPWALKNFDGREKSLLRAAGTGLAPDSVLHRPKNHYPATHHPDYNRGLQNMARDALADDTVRSLADETRLKPCLDTPPGQLEWGHRLRLERVVDLALWLDHYQPELAL

SEQ ID NO: 18310 - protein, 195 aa, Rhodobacter sphaeroides
MRKAEISRKTAETDISVTVDLDGTGRYDIRTGVGFFDHMMDQARPARADRHPLRCEGDLHIDDHHTVEDCGIALGQALTRALGDKARIRRYGSFHLAMDDALVRAALDLSGRPFLVWNLPFPTEKIGSFDTELVREFFQALATHGGITLHVDLIHGVNSHHIAEAAFKAVARSLREAVEPDPRRADAIPSTKGML

SEQ ID NO: 18311 - protein, 250 aa, Bacillus caldolyticus
MKKKCIAMLLAGGQGSRLRSLTKNIAKPAVPFGGKYRIIDFTLSNCTNSGIDTVGVLTQYQPLLLHSYIGIGSAWDLDRRNGGVTVLPPYSASSGVKWYEGTANAIYQNMNYIEQYDPDYVLVLSGDHIYKMDYQQMLDYHIAKQADATISVIEVPWEEASRFGIMNTNENMEIVEFAEKPANPKSNLASMGIYIFNWPLLREYLQIDNADPHSSHDFGKDVIPRLLRENKRLVAYPFKGYWKDVGTVKS

SEQ ID NO: 18312 - protein, 335 aa, Mycobacterium tuberculosis
MTAPPVHDRAHHPVRDVIVIGSGPAGYTAALYAARAQLAPLVFEGTSFGGALMTTTDVENYPGFRNGITGPELMDEMREQALRFGADLRMEDVESVSLHGPLKSVVTADGQTHRARAVILAMGAAARYLQVPGEQELLGRGVSSCATCDGFFFRDQDIAVIGGGDSAMEEATFLTRFARSVTLVHRRDEFRASKIMLDRARNNDKIRFLTNHTVVAVDGDTTVTGLRVRDTNTGAETTLPVTGVFVAIGHEPRSGLVREAIDVDPDGYVLVQGRTTSTSLPGVFAAGDLVDRTYRQAVTAAGSGCAAAIDAERWLAEHAATGEADSTDALIGAQR

SEQ ID NO: 18313 - protein, 222 aa, Thermobifida fusca
MFGFVKTDMVDPAKALPGRDTPMPVPERHEVLGTPLAPPYPEHAQLADFGMGCFWGVERIFWRLGAENGIITTAAGYAGGYTPNPTYEEVCTGRTGHAEVVRVVFDPERISYTDLLKVFWENHDPTQGMRQGNDVGTQYRSIILYHNEEQRAAAEASRDAFQPVLTRMGYGPITTEIVPATPFYFAEPYHQQYLSEAKNPHGYCGVSGTGATCPVGVARTSG

SEQ ID NO: 18314 - protein, 480 aa, Oceanicola granulosus
MSQPHRPHGEPSFRQSVDIMFNRAVALMDLPPGLEEKIRVCNATYTVRFGVRLRGGIHTFTGYRSVHSEHMEPVKGGIRYAMSVNQDEVEALAALMTYKCALVETPFGGSKGGLRIDPREWEEDELERITRRFAYELAKRDLIHPAQNVPAPDMGTGEREMAWIADQYRRMNTTDINANACVTGKPLNSGGIAGRVEATGRGVQFALREFFRHPDDINAAGLSGTLEGKRVIVQGLGNVGYHAAKFLQEEDGCRIVGIIERDGALTAPDGLDVDDVHAWIGEHGGVTGYPRATYTPEGDAVLEATCDILIPAALEGVIHKDNAARIQAPLIIEAANGPITAGGDEILREKGCVIIPDMFANAGGVTVSYFEWVKNLSHIRFGRMQRRQEEARHELIVRELERLSADRDLGWELSPNFKDRYLKGAGELELVRSGLDDTMRTAYQAMSETWHGRNDVHDLRTAAYLVSIERVAASYRAKGL

SEQ ID NO: 18315 - protein, 340 aa, Serratia marcescens
MNTVNASMTVIGAGSYGTALAITLARNGHSVVLWGHNPAQIQTLQHDRCNQAFLPDVPFPDTLLLEADLARALAASRDVLVVVPSHVFGDVLRQLKPHLRPDARIVWATKGLEAETGRLLQNVAREALGETIPLAVLSGPTFAKELAAGLPTAIALAATDAQFADDLQQGCMHCGKSFRVYSNPDFIGVQLGGAVKNVIAIGAGMSDGIGFGANARTALITRGLAEMSRLGSALGADPSTFMGMAGLGDLVLTCTDNQSRNRRFGIMLGQGKGVQEAQDSIGQVVEGYRNTKEVLALAQRQGVEMPITEQIYQVLYCHKDAREAALSLLGRARKDEKPSV

SEQ ID NO: 18316 - protein, 305 aa, Legionella pneumophila
MSKIAVVINPIAGGGRGKKIWKVLKPGLHALFEQTVYRISNRVNDLEAITDGLLAENPDSLLIIGGDGTLNHVLNGLIENDKLKNPQIKIAFFNAGCGGDFTRQFPQQKMTEFLDRLSHNQFIKCDIGKITLANQVSRYFINIASCGLSGHVVLRVSKSKWLKKLGGTLNYLLHALTGLMTYRKTKVRVQIDDALPFDSSILLMAVCSGQYFGGGMHVAPIAKVNDGLFDVVSFNEFSKLNALLKLYKIYSGGHLLDNNVHYVQAKKIKIEPLEESKIEIEADGEIIGCLPAQFELIKETLPLIV

SEQ ID NO: 18317 - protein, 472 aa, Bifidobacterium longum
MATTAGAKKGLWSTIRRIAASDRISGLIMLGFALTGLVLANLPATAHAFETVAETHLFIPYTNLDLPIGHWAQDGLLTIFFLTVGLELKQELTTGSLANPKAAAVPMLCAVGGMIAPPILFLAVTALFSQIGPGEPGTLILTTTGSSIPFSEMSHGWAVPTATDIAFSLAVLALFAKALPGSIRAFLMTLATVDDLLAIILIAVFFSSINAWYWFIGIAVCAAIWAYLVRLKKVPWIAVGIVGILAWIMMFEAGVHPTLAGVLVGLLTPSREMHGELSPRAERYANKLQPFSALLALPIFALFATGVHFESMSPLLLASPLVIALIVALVVGKPLGIITTAWLSTHVGGLKMAKGLRVRDMIPAAVACGIGFTVSFLIASLAYKNAELSAEARFGVLVASLIAAAISGVLLSRQSKRFEKTAAAAAADAEDDESIDGDGIGQPSHTTEPTTPTEHPGTLADGTASVEIDFRH

SEQ ID NO: 18318 - protein, 376 aa, Mesorhizobium loti
MKADFYETLGVQKGADEKELKSAFRKLAMQFHPDRNPGDHSCEHKFKEINEAYETLKDPQKRAAYDRFGHAAFEQGGMNGGAQGFGAGGFADIFEDIFGDMMGGRQRRSSGGRERGADLRYNMEISLEEAFAGKTAQIRVPASISCTECSGSGAKPGTQPVTCSMCHGHGKVRATQGFFSIERTCPQCQGRGQTIKDPCPKCAGQGRVTEERSLSVNIPAGIEDGTRIRLANEGEAGLRGGPSGDLYIFLAVKPHEFFQRDGADLYCKVPISMTTAALGGSFEVTTLDGTQTKVKVPEGTQNGRQFRLKGKGMPVLRQPNVGDLYIQTAVETPQNLSRRQRELLEEFEQLSSQDNSPQSSGFFARMKDFFESFGER

SEQ ID NO: 18319 - protein, 712 aa, Hordeum vulgare
MSVSSSSMCGGDAGMKCVVWFRRDLRVEDNPALAAAARTAGEVVPAYVWSPEEDGPYFPGRVSRWWLSQSLKHLEASLHRLGAGKLVTRRSADSVAALLQLVRDTGATHLFFNHLYDPISLVRDHRLKEMLTSEGIVVQSFNADLLYDPWEVNDDDGQPFNMFMPFWNRCLSMPYDPPAPLLPPKRINSGDLSMCPSDDLIFEDESERGSNALLARAWSPGWQNADKALSAFLNGPLIDYSVNRKKADSANTSLLSPYLHFGELSVRKVFHLVRMKQLVWSNEGNHAAEESCTLFLRSVGLREYSRYLCFNHPCSHEKPLLAHLRFFPWVVDESTFKFWRQGRTGYPLVDAGMRELWATGWLHDRIRVVVSSFFVKVLQLPWRWGMKYFWDTLLDADLESDALGWQYISGSLPDSRELDHIDNPQLEGYKFDPHGEYVRRWLPELARLPTEWIHHPWDAPASVLQAAGVELGSNYPLPIVELDTAQVRLQEALSEMWQLEAASRAAMDTGMEEGLGDSSEVPPIEFPQDLQMEVHWEPARVAPNVLTTAQRRQDQMVPTMTTSLNRVETEISADLGNSVDSRAEVPFRMHFEPRTEREEIIQSTGNAVGTNGIHHHNNFQQPQHRMRNIFAPSVSEASSSWTGRDGGVVPVWSPPAASGHSETYGADEADVSSRSYLDRHPQSHRIMNWHQLSQSLTTGRDVENSVQPNYIG

SEQ ID NO: 18320 - protein, 269 aa, Brassica napus
IKERIGAGSFGTVHRAEWHGSDVAVKILMEQDFHAERVNEFLREVAIMKRLRHPNIVLFMGAVTQPPNLSIVTEYLSRGSLYRLLHKSGAREQLDERRRLSMAYDVAKGMNYLHNRNPPIVHRDLKSPNLLVDKKYTVKVCDFGLSRLKASTFLSSKTAAGTPEWMAPEVLRDEQSNEKSDVYSFGVILWELATLQQPWGNLNPAQVVAAVGFKNKRLEIPRNLNPQVAAIIETCWTNEPWKRPSFATIMDLLRPLIKSAVPPPNRLDM

SEQ ID NO: 18321 - protein, 155 aa, Volvox carteri
MAPKTKEEKPASEAVEPKAEAKPKAEKAPKKKEKKAPAKKSAKEPAAGDAAEGDKKKKKAKVAKSETYKLYIYKVLKQVHPDTGISSKAMSIMNSFINDIFEKVATEASKLSRYNKKPTVTSREIQTAVRLVLPGELAKHAVSEGTKAVTKFTSA

SEQ ID NO: 18322 - protein, 118 aa, Aegiceras corniculatum
ISVVLFSTVIFGLLTKPLVRLLLPSSKHLSRMLSSEATTPKSFIVPLLDNGQESESDLGGFHIVPPSGLRMLLTTPARSVHHYWRKFDDAYMRPMFGGRGFVPFVPGSPTESSVPQEE

SEQ ID NO: 18323 - protein, 272 aa, Medicago truncatula
MVKYIVKDANMLVFVTPHQFMEGICKRLDGKIRTDAEGISLVKGMEVKKEGASMISTLISNQLKINCSVLMGANIANEIAMQKFSEATIGYRENKEAAERWVQLFNTPYFNVTSVQDVEGVEMCGTLKNIVAIAAGFIDGLEMGNNTKSAIMRIGLKEMMAFSKLLFPSVKYSTFFESCGVADLITTCMGGRNRKVAAAYARNGGKRSFDELEAELLKGQKLQGVLTAKEVYEVLTARGWVERFPLFTTVYEISSGLLPPSAIVEFNNKSKL

SEQ ID NO: 18324 - protein, 517 aa, Phaseolus vulgaris
MTKLLHSYFSIPFSPFYVSIPIATVLFVLIIYNFFLASKNHSSTPPGPLSVPIFGNWLKVGNDLNHRVLTSMSQTYGPVFLLKLGSKNLVVVSDPELATQVLHSQGVEFGSRPRNVVFDIFTGKGQKMVFTVYGEHWRTMRTIMNLPFFTKKGVHNYSTMWEEEMELVVRDLKVNEHVRSEGIVIRKRLQLMLYNIMYRMMFDAKFESQEDPLFIQATRFNSERSRLAQSFEYNYGDFIPLLRPFLRGYLNKCKDLQSRRLAFFNTHYVQKRRQIMAANGEKHKISCAIDHIIDAQMKGEISEENVIYIVENINVAAIETTLWSMEWAIAELVNHPSVQSKIRDEISEVLKGEPVTESNLHELPYLQATVKETLRLHTPILLLVPHMNLEEAKLGGYTVPKESKVVVNAWWLANNPSWWKNPEEFRPERFLEEECATDAVAGGKVDFRFVPFGVGRRSCPGIILALPILGLVIAKMVSNFELSAPQGTKIDVNEKGGQFSLHIANYSTVLFHPIRTQ

SEQ ID NO: 18325 - protein, 349 aa, Rubrobacter xylanophilus
MAEVRRVGMLTGGGDAPGLNGVIRAVTVKCVEDYGYEVVGIKRGWRGLLAPQEDSVEKLTVDGVRYILDEGGTVLLSSRTNPYKKEGDAEKVVKNMQEFGIDALVAIGGDDTLGVASRLHKDFGVQVVGCPKTIDNDLSGTDICFGYDTAVSIATEALDRVRTTAKSHERILVVEIMGRHAGWITYGAGLAGAANVTLIPEVEPDIDAIADLFKKRAERGERWGVVAVSEGVTIGEEYITQSAERDEFGHVRLGGIGETLAKELKERTGIDTRHVVLGHLQRGGTPTAYDRILSTRYGLRAAEAVKNGEWGKMVALRGSDIVTVPLEEATGETRTVPEDLYGVLKTFFG

SEQ ID NO: 18326 - protein, 355 aa, Phaseolus vulgaris
FTVYGEHWRTMRTIMNLPFFTKKGVHNYSTMWEEEMELVVRDLKVNEHVRSEGIVIRKRLQLMLYNIMYRMMFDAKFESQEDPLFIQATRFNSERSRLAQSFEYNYGDFIPLLRPFLRGYLNKCKDLQSRRLAFFNTHYVQKRRQIMAANGEKHKISCAIDHIIDAQMKGEISEENVIYIVENINVAAIETTLWSMEWAIAELVNHPSVQSKIRDEISEVLKGEPVTESNLHELPYLQATVKETLRLHTPILLLVPHMNLEEAKLGGYTVPKESKVVVNAWWLANNPSWWKNPEEFRPERFLEEECATDAVAGGKVDFRFVPFGVGRRSCPGIILALPILGLVIAKMVSNFELSA

SEQ ID NO: 18327 - protein, 501 aa, Sinapis alba
MSTNKKTIVWFRRDLRIEDNPALAAAAHEGSVFPVFIWCPEEEGQFYPGRASRWWMKQSLAHLRQSLKALGSELTLIKTHSTVSAILDCVRATGATKVVFNHLYDPVSLVRDHTVKEKLVERGISVQSYNGDLCMSPGRYTVKRANLLLVLILTGKKCLDMSVESVVLPPPWRLMPLSAAETVWACSVEELGLENEAEKPSNALLTRAWSPGWSNADKILNEFIEKQLIDYAKNSKKVVGNSTSLLSPYLHFGEISVRRVFQCARMKQIIWARDKNGEGEESADLFLRGIGLRDYSRIICFNFPFTHEQSLLSHLRFFPWDADVDKFKAWRQGRTGYPLVDAGMRELWATGWMHNRIRVIVSSFAVKFLLLPWKWGMKYFWDTLLDADLECDIIGWQYISGSLPDGHELDRLDNPAIQGAKYDPEGEYIRQWLPELARLPTEWIHHPWDAPLTVLKASGVELGTNYAKPIVVIDTARELLTKAISRTREAQIMIGACGDEM

SEQ ID NO: 18328 - protein, 621 aa, Kineococcus radiotolerans
MPQDPTTAGAGGGVPRPEHPRPSVVRADWINLNGTWGFEVDPGDSGLERGVRDRPLAGSITVPFAPESELSGIGDTDFLPAVWYRREVAIPEDWAGRRTLLHFGAVDHDATVWVDGEEVVRHRGGFTPFTADLGHRRGTVTVVVRARDDHRGPQARGKQSTRYDNYECLYTRTTGIWQTVWAEPVPDVSLGRPRITPDVAGSTFHLEQPLRRSGTGAVGDRAGWTLTASVRDAAGEVVTATVRADLDLSPRLVLPVPADRVRLWEPADPHLYDVTVTLADASGAVVDTVETYAGLRSVSIDGKAVLLNGRPVFQRLVLDQGYYPDGLMTAPTDAALVADIELSLAAGFNGARLHQKVFEERFLFHADRLGYLVWGEFGDWGAAEEGSSHRGEYQQPTPNFVSQWLEALERDYSHPSIVGWCGLNETHQPLTDRGQVLDDATRAMFLAAKAMDTSRPVLDASGYSHRVLESDVWDSHNYTQDPAEFAREMAGLAQGRPDTNFAHGTTTVISLPYQGQPWFCSEFGGIWWRPDTAASDPDVDRGAESSWGYGEPPRSEEEFHHRFEGLTGVLLDDPLMFGYCYTQLTDVFQEQNGIYSFDRSVKLDVERVRAAQQRPAAIERT

SEQ ID NO: 18329 - protein, 130 aa, Arabidopsis thaliana
  misc_feature (91)..(91): Xaa can be any naturally occurring amino acid
  misc_feature (103)..(103): Xaa can be any naturally occurring amino acid
CWSQTPRVPDLEEFYAVFRSMVVSPAQATMVCPFNGLKNSDDLPATQQANNDITSISCNGGRVNCMQVCAPHVKKKCETLYYLPDLTEYEXAKEVDYLIHNKXIPYVEFELEHGFVNREHVNSPGYYDGR

SEQ ID NO: 18330 - protein, 116 aa, Mycobacterium tuberculosis
MTDSEKSATIKVTDASFATDVLSSNKPVLVDFWATWCGPCKMVAPVLEEIATERATDLTVAKLDVDTNPETARNFQVVSIPTLILFKDGQPVKRIVGAKGKAALLRELSDVVPNLN

SEQ ID NO: 18331 - protein, 171 aa, Dubautia latifolia
YQAFELIHARWAMLGAAGCIIPEAFNKYGASCGPEAVWFKTGALLLDGNTLNYFGKNIHINLVVAVVAEVVLVGGAEYYRIINGLDLEDKLHHGGPFDPLGLAKDPDQFALLKVKEIKNGRLAMFSMFAFFIQAYVTGQGPVENLASHLSDPFGNNLLTVISGNIERVPTL

SEQ ID NO: 18332 - protein, 267 aa, Ralstonia eutropha
MDKAGKSTGKVYLIGAGPGAADLITVRGARLLGEAQVVLHDALVSPEMLAWCPQARLVEVGKRCGKRSTAQLFINRQIIDMATKYERVVRLKGGDPMLFGRADEELQALEAAGIAYEVVPGITAALAAASAIAKPLTKRGVSRSVAFATQAKAADGTEVPASAADIEADVRADTLVYYMGRDQAAAIAAQLIAHGKAPSTPAWVVEAVSTPHQRSHAFTLQQMAAGEAAGWIDPSHPSLLMIGAALAARATEPVTRDVAATISAKAA

SEQ ID NO: 18333 - protein, 171 aa, Dubautia laxa
YQAFELIHARWAMLGAAGCIIPEAFNKYGASCGPEAVWFKTGALLLDGNTLNYFGKNIPINLVVAVVAEVVLVGGAEYYRIINGLDLEDKLHPGGPFDPLGLAKDPDQFALLKVKEIKNGRLAMFSMFAFFIKAYVTGQGPVENLASHLSDPFGNNLLTVISGNIERVPTL

SEQ ID NO: 18334 - protein, 318 aa, Oryza sativa
MDFPGDAEDFALEFIREHLLGGDAPVLPPAAVPAAAAYPPTSTMFLPQQQRGYAGLTPQEYVVDSAPAADQAAFRDDQPDPAADVMIMFGGERFPAVKPSSSSSPSLTVTVPPSSFGSWAPAAVPAAAATAAAVEDFRKYRGVRQRPWGKFAAEIRDPKRRGSRVWLGTYDTPVEAARAYDRAAFRMRGAKAILNFPNEVGTRGAELWATPPPTNKRKRQPEDDTAAADDVEVIGVANKAVKTEAPTSAYSSSSLSSMSRDTTATTSSAGTSTGSSEPTSFPVVTPSSWSWDQYWDGLPPLSPLSPHPALGFPQLTVS

SEQ ID NO: 18335 - protein, 578 aa, Nostoc punctiforme
MSVATLTPNHSRDVQVAEIGKNTLILRSRTWDRLKFEVEYSRQRGTTANSYLIQGEKKALIDPPGESFTEIYLEQLAQYLDFISLDYIVLSHVNPNRRATLQVLLSLVPQATLICSRPAANALKTAFPELESPIQAVRSGDTLDLGQGHHLSFVTVPTPRWADGLCTYDYATKILYTDKLFGAHICEDTLFDEDWKGLDAERRYYFECLHAPQAKQVEVVLDKLSLLGARCYAPAHGPVVRYSLSRFTYDYRQWCQGQKSQELSVALLYASAYGNTAIMANAIAQGLIQNGVNVESINCELADSAEINRIVETCDGLIIGSPTLGGHAPTQIQTALGIVLSVAAKTKLAGVFGSYGWSGEAIDLIESKLKDANYQLGFETIRVRFSPTSEILQQCQEAGAFFAQNLKKTKKLRSSRQIVTETHVDRTEQAVGRIIGSLCVVTTRDEETHKGVLTSWVSQATFNPPGIMIAIANEQNADLMHHPGDKFVLNILKEGRNVRRYFSRHSTLGDNPFANLATKTALNGCLILNEALAYLECTVQNQLECGDRWLIYAVIDRGEVLENDGITALEHRKSGSYY

SEQ ID NO: 18336 - protein, 328 aa, Oryza sativa
MDFHHGDADDFALEFIREHLLGVDGATATATEPADLEVVEPAAAYPPMSWQEQRQQEQHGCHVELTDEHLESAPAAEAAAAFRTAPAQPAAEVMIKFGGEPSPVRPSSSLTISLPPSSFGSWASAAAPAAAAVEDFRKYRGVRQRPWGKFAAEIRDPKRRGSRVWLGTYDTPVEAARAYDRAAFRMRGAKAILNFPNEVGTRGTELWAPPPPPPAHSAAASTTNKRKRQPSEDPDDGVEVIGVVSKAVKTEAPTSNSSSLSSSLTSRDTTPATSSAGAEHAGAAAESSPATPSSWSWEQYWEALLGGLPPLSPLSPHPALGFPQLTVN

SEQ ID NO: 18337 - protein, 116 aa, Thermus thermophilus
MKLIVAIVRPEKLNEVLKALFQAEVRGLTLSRVQGHGGETERVETYRGTTVKMELHEKVRLEIGVSEPFVKPTVEAILKAARTGEVGDGKIFVLPVEKVYRIRTGEEDEAAVTPVQ

SEQ ID NO: 18338 - protein, 171 aa, Dubautia raillardioides
YQAFELIHARWAMLGAAGCIIPEAFNKYGASCGPEAVWFKTGALLLDGNTLNYFGKNIHINLVVAVVAEVVLVGGAEYYRIINGLDLEDKLHPGGPFDPLGLAKDPDQFALLKVKEIKNGRLAMFSMFAFFIQAYVTGQGPVENLASHLSDPFGNNLLTVISGNIERVPTL

SEQ ID NO: 18339 - protein, 431 aa, Flavobacteria bacterium
MTVIAKGKTKKLPLRGMMDNVMEQFNSAADHINLHLNIRKILSITNNEIIVHFPVKMDNGDVEIFTGYRVQHNNALGPYKGGLRYHPTVDIDAARALAMWMTWKTSLAGLPYGGGKGGIQLDPSKYSPSELERITRRFTFALADNIGPEHDIPAPDVNTNSQTMAWMADTYMSTRPPAERTANQHVVTGKPDGSGGLEGRDRATGYGVFLTIKFWAHKSAESLKDKRFIVQGFGNVGYWAAHFLEKEGAHLVAVQDAYGTLHNDDGIKVEDLYNYSIANKGSIVDFPEAKAIPKADFYTTDCDICIPAALGNQITSENAPYIKARLIAEGANGPTNVDGEKILLEKGVTIIPDILCNSGGVIGSYFEWLQNRNGELWQLDEVMIKLEKKMRESFNKVYTFSESEAMDMRTAAYCIAIKRIEKAYVQRGIFP

SEQ ID NO: 18340 - protein, 316 aa, Methylobacillus flagellatus
MATKHARLLILGSGPAGYTAAVYAARANLKPVLITGIAQGGQLMTTTEVDNWPADADGVLGPELMARFQKHAERFNTEIIFDHIHTTHLTEKPIRLVGDAGEYTCDALIIATGASAKYLGLPSEEAFAGKGVSACATCDGFFYRNQEVAVIGGGNTAVEEALYLANIASKVTLVHRRDKFKAEAILVDKLMERVKEGRIVLETFQTLDEVLGDDSGVTGIRLKDVNSGATKEIALKGVFIAIGHKPNTDIFEGQLEMEGGYIVTKAGREGNFTATSVPGVFAAGDVQDHIYRQAVTSAGTGCMAALDAERYLDQLS

SEQ ID NO: 18341 - protein, 502 aa, Oryza sativa
MASITSELLFFLPFILLALLTFYTTTVAKCHGGHWWRGGTTPAKRKRMNLPPGAAGWPLVGETFGYLRAHPATSVGRFMEQHIARYGKIYRSSLFGERTVVSADAGLNRYILQNEGRLFECSYPRSIGGILGKWSMLVLVGDPHREMRAISLNFLSSVRLRAVLLPEVERHTLLVLRAWPPSSTFSAQHQAKKFTFNLMAKNIMSMDPGEEETERLRREYITFMKGVVSAPLNLPGTPYWKALKSRAAILGVIERKMEERVEKLSKEDASVEQDDLLGWALKQSNLSKEQILDLLLSLLFAGHETSSMALALAIFFLEGCPKAVQELREEHLGIARRQRLRGECKLSWEDYKEMVFTQCVINETLRLGNVVRFLHRKVIKDVHYKGYDIPSGWKILPVLAAVHLDSSLYEDPQRFNPWRWKSSGSSGGLAQSSSFMPYGGGTRLCAGSELAKLEMAVFLHHLVLNFRWELAEPDQAFVFPFVDFPKGLPIRVHRIAQDDEQE

SEQ ID NO: 18342 - protein, 649 aa, Lactobacillus acidophilus
MCGIVAFYDPKINDKQAVIGKMMATIKHRGPSSDGYYTNDEVALGFRRLSIIDLRGGSQPIYNEDKTRAIIFNGEIYNFKPLREELIKAGHTFTTKADTEVLLHGYEEWGMDGLLKRVRGMFAFLIWDDNNKTLYGARDFFGIKPMYYSNQDGHLLVGSELKSFLEYPKFKRELNVEAVKPYLMNQYNDLEETFFKGVYRFPAGHWFEYKDGEMKTHQYWDAEYKENSLSFEETLKRINDDLKETVDLYRNADVKVGAFLSEGIDSSYLTSLLNPDDVFSVSFDDSTYDEASKAKALADINHWKFFSEKVDADEAMRDFPEMQYHMDEPDANPSIIPLWYLCKLARKHVTVALSGEGADELFAGYVNYGMHTHNDVIKVFTSELKKLPKNKQVKLAHKIKKMPNFPGKVHMYTNLAEPSEFYVGQSVIYDMDYPTIFTSKDANSILQPTYRNKLTVNGIYQKDFKKVKGIDNVKQMQYIDLHHFMLNDIEQKADKISMAHSLEVRVPYLDKKIAELANSIPTKYLVNRHDTKYALRKASEKVLPDEWAKRPKLGFPTPIKQWLKEPRFYKQVRSLFEEEFVNDIFDQKKIIKLLDDNYEGDGSHRRQIWAIYTFLVWYKLFFVDYENTVKKYQHVQPEVANLISQGKLL

SEQ ID NO: 18343 - protein, 384 aa, Saccharomyces cerevisiae
MSFSNSKDKSVVAVYKLVKAPIYSHCFSQDKSILAVTCETDCLVYRVSNNTPPVLFATLKDHDKTITAVDISIHGRIVTCSQDRNAYVWEPLSDGTYKPTLVLLRINRAATSVTWAPNGYKFAVGSSARIIAVCYYEHENNWWVSKHIKKPIKSTINCLSWHANGVLLAAGGTDGFMRVFSGFIKGLDSKESVAGSPWGQKFPFGCLIREWYQGSYIHDVEWRSQMERIAYVAHDGTLNVVDYQSPVQSVNAPEGLPYRSLVWINDHEIVCGGYSCHPVLFSEASEGWKFAKNLDKSDNNKSSALTASGNTDELSGNNDESSTFGISALRKFKELDLKGKVSTDVQESAHENAIVELRPFAESNGQITQVSSCGLDGKIVIYTI

SEQ ID NO: 18344 - protein, 554 aa, Actinobacillus pleuropneumoniae
MSENFAQLLEEFLAAEARLGSVVKGTVVAIQKGYVIVDTGFKSESSIPAEEFTNAQGELEVQVGDQVDVVLKAVEDGFGETVVSRGDAKRNEAWIALEKAFEEQATVIGFVNGKVKGGFTVELNGVRAFLPGSLVDTRPVRDSLNLEGKELEFKVIKLDQKRNNVVVSRRAVIESESNQDRDEVLANLVEGSVVTGTVKNLTDYGAFVDLGGVDGLLHITDMAWKRVKHPSEVVAVGQEVTVKVLKFDKEKTRVSLGLKQLGQDPWAAIAQNHPVNSKLTGKVTNLTDYGCFVEILDGVEGLVHVSEMDWTNKNIHPSKVVSVGDVVEVMVLEVDEERRRISLGLKQCKANPWEHFAATHNKNDKVTGKIKSITDFGIFIGLEGGIDGLVHLSDISWNATGEEAVRNYKKGDEVEAVVLQVDAVKERISLGIKQLESDPFTNFVESTKKGAILTGKVVEVDAKGVKVELEGGVEAFIRANEATRDRVEDITTVISAGDTIEAKYTGVDRKARVVNLSVRAKDEAEESAAIAQVNKEEVAIPNAMAEAFKAAKGE

SEQ ID NO: 18345 - protein, 450 aa, Botryotinia fuckeliana
MSNLPSEPEFEQAYNELASTLENSTLFEKNPEYRTALKVVSIPERVIQFRVVWEDDKNQVQVNRGYRVQFNSALGPYKGGLRFHPTVNLSVLKFLGFEQIFKNALTGLNIGGGKGGADFDPKGKSDNEIRRFCVSFMRELSKHIGADTDVPAGDINVGGREIGFLFGAYKAIQNKWEGVLTGKGGSWGGSLIRPEATGYGLVYYVAHMIQYAGQGSFQGKRVAISGSGNVAQYAALKCIELGATVVSLSDSQGSLIAEGDAYFTPEDVGKIAELKLKRQSLTAFEHGGKYKYIEGSRPWTHVKVDVALPCATQNEVSKEEAESLVASGARYIAEGSNMGCTQEAIDVFEAERKEKKDKAIWYAPGKAANAGGVAVSGLEMAQNSARISWTQEEVDEKLKDIMKNAFETGLETPKKYVEAKDGEYPSLVAGSNIAGFVKVASAMHNHGDWW

SEQ ID NO: 18346 - protein, 480 aa, Pyrococcus horikoshii
MCLIAGGFKLYTDEIIRIIELGKHRGPDSFGVWSEREVIKSSDFSALEEVKGGDKVLIQCRLAMTGSKEYTQPFYNEIALVHNGEIYNHEKLRAYLVERGISFESDVDSEVILRLLEYLLFDRNLSPWNAIKKLMWMLRGDYAVAFHYNGKFYLFRDPLGIRPLYYSSQGHFGSEKKVLWGLGEEATPVMPGEAVEISKFGINRVRLYDVTAIKSFGSEYFDGLRNLLIDSVKIRSSKKIGILFSGGLDSTLIAFIASRYSNVTLYVSGTEDSKDVEWARKVSQELGLKLKEYIFSKEEVEKELKRIMFAIEEPNPMNLSIAIPLYFSTKLAREDGVKILLSGQGADELFGGYAKYLENPNLMISDVANLGERNLARDDKVSMINGVEVRYPYLDLPFAVLALNTPLQHKIKDGKRKIILREIAKSLGLPEWIAEREKKAAQYGSNAQKILEKIAKSRGIRLKELASLLFSEVFRGIHNR

SEQ ID NO: 18347 - protein, 137 aa, Vibrio cholerae
MVMSEITKTLLNIRSLRAYARELTIEQLEEALDKLTTVVQERKEAEAEEIAARAEQEAKLAAIAEQIAKDGIDLEALISALSGETKTKAKGKRAPRPAKYKYIDTNGEEKTWTGQGRTPSVIQKALDEGKSLEEFAL

SEQ ID NO: 18348 - protein, 364 aa, Ostreococcus tauri
MAFSISAKVSAFTGAKVNATRAQKARRANVAVKAQGTDYGLGLQMSTTADKNIDPNGRAKVPLEMEKMELPLNTYKNKEPFVGTIRSVERIVGPNATGETCHIIIEHGGKMPFWEGQSYGVIPPGTKVNSKGKEVPHGVRLYSIASSRYGDSYDGLTATLCVRRATYWDPEMNAEDPAKKGICSNFLCDAKPGQEVMMTGPTGQVMLLPKDPATPVIMVATGTGIAPMRSYLRRFFLEDIPSWEFKGLAWLFMGVANSDAKLYDDEFQEMVKRFPDQFRIDYALSREDTNKNGGKMYIQDKVEEYKDQVFQLLDGGAHMYFCGLKGMMPGILSMLEGVCKEKGISYEEWLEGLKKNGQWHVEVY

SEQ ID NO: 18349 - protein, 621 aa, Oryza sativa
MGAAFLSSWPWDNLGAYKYVLYAPLVGKAVAGRAWERASPDHWLLLLLVLFGVRALTYQLWSSFSNMLFATRRRRIVRDGVDFGQIDREWDWDNFLILQVHMAAAAFYAFPSLRHLPLWDARGLAVAALLHVAATEPLFYAAHRAFHRGHLFSCYHLQHHSAKVPQPFTAGFATPLEQLVLGALMAVPLAAACAAGHGSVALAFAYVLGFDNLRAMGHCNVEVFPGGLFQSLPVLKYLIYTPTYHTIHHTKEDANFCLFMPLFDLIGGTLDAQSWEMQKKTSAGVDEVPEFVFLAHVVDVMQSLHVPFVLRTFASTPFSVQPFLLPMWPFAFLVMLMMWAWSKTFVISCYRLRGRLHQMWAVPRYGFHYFLPFAKDGINNQSRASPVRQGGQEWAPRVVSLAALNKNEALNGGGTLFVNKHPGLRVRVVHGNTLTAAVILNEIPQGTTEVFMTGATSKLGRAIALYLCRKKVRVMMMTLSTERFQKIQREATPEHQQYLVQVTKYRSAQHCKTWIVGKWLSPREQRWAPPGTHFHQFVVPPIIGFRRDCTYGKLAAMRLPKDVQGLGACEYSLERGVVHACHAGGVVHFLEGYTHHEVGAIDVDRIDVVWEAALRHGLRPV

SEQ ID NO: 18350 - protein, 482 aa, Triticum aestivum
MSGRLLLLLRLILCIVLATRQLALAGAASSSTVVTSLPGFQGRLPFHLETGYVEVDEENGTELFYYFVESEAGGENDPFLLWLTGGDHCSVLSGLAFEIGPFKFVVEPYNGTIPSLEINPNSWTKVAHILFVDSPAGAGFSFSRQPKGYHVGEISTSLQLHEFLIKWFRDHPKFLSSPLYIGGDSYAGKIIPFIAQKISQGNEVGRSPLLNLKGYIVGNPATGERIDESSKVPFAHGFGIISDQLYETILGHCQGQDYKNPTNVLCAKALGTFHSLLSEVMSPHILLIKCVYSSAGPHAEMDDSAGADRKILSEEAAGIKMGKRLEHPPVRPPLDCIDYAHYLSYFWANDERTRDALGIKDGTVDEWVRCQDGGVPYTRDILSSIKYHCNVTANGYRALVYSGDHDSVVPHLGTQAWVRSLGFPIVDEWRAWHLHGQSAGFTITYSNNMTFATVKGGGHTAPEYEPDRCFAMFSRWILNQPL

SEQ ID NO: 18351 - protein, 357 aa, Vibrio cholerae
MSKQQKILFIDRDGTLIVEPPVDFQVDRLDKLKLEPYVIPSLLKLQEAGYRLVMVTNQDGLGTSSYPQADFDAPHNMMMDIFESQGVKFNDVLICPHFERDNCSCRKPKLGLVKEYLQGGKVDFKSSAVIGDRMTDLQLAENMAIRGIQYHPQTMGWLDIVKDLTTKPRVAQVVRKTKETDIQVLVNLDQTGGNQIETGLGFFDHMLDQIATHGGFQLQLKVVGDLHIDDHHTVEDTALALGQALREALGDKRGIGRFGFTLPMDECLAQCALDLSGRPYLKFDASFSRPQVGDLSTEMVYHFFRSLTDTLACTLHLSSSGDNDHHIIESLFKAFGRTLRQAITVQGNDLPSSKGVL

SEQ ID NO: 18352 - protein, 1447 aa, Candida glabrata
MTFLKKIAGSNGHSKSGSVSSIRYSANSQASPSASVSSSRSFKTHVRNSSNSTDYSGSTYVFGTGNTASSGSNHGTPTSSKTFSKMGSSYNRRSIDSPRSTSNRNSEYTLDNSSLNSHPQANKGGDNVSRPTSLEKNADTDSSTYSRKSSGSTSSLSFDNLILSWDPTNPDEWTLSRVIAWFKFHDFPDSWIAVFKRHQLCGQRFLRLLAYDNFAIYEKHLPISKNASFDKFQALLKDTMKKNVSSSHSRQRSGNSVAAMHIEPNKGVNLRHKSSRSQDDIVGSRSASESGINNEQLNLGKPPEKGVVKSHKKTKSTGSLYRRSFISLMGSSSHSSAENTQMEKNNPNIKIHIPSRPQSVVESEPSTAKTLSPLSPPYSALFNKLDQKNRSDPTLFEISDEKYSRLKNDDYNDDIAAQSSSTNFNGKQQHSSSATYSKSKKNEKGGFNVRNSAVMPEDKSTFWEKLKRKSQTISPSTQNHTQLNSANLSKNRVSLQQIQGGFDMTDQVKPDNIVTPKIHQAHKSSSIDTKSQNFENVFDKFLLDKKYYPAKIKSSTNEEDFVLITKDNVSFIPLLISELPNECSKLKEYFMRKLRIVSGECSVHMTDFGCDIGASLNDTLLDTIRNSLFMNTSRKLFIRDTGTHKYSPGKPIINSSQREMLRKKESIKSINSSILASNDEISTITSSSDIASFDDRSSAPGRQYPQTPSYFYDASNVNDDVNYWNFKENQSSLVPGKVPDVKPEAQFTLKIPDKIKHKGLEDDLQRNSFHVLRKDEGKEIDFNNRRRSPYTNPELAPKREAPKAPITGSPMRLQKSRSLSKSVSIVTNNDRSRRDELSPSRKSYKNSETNSPSSEKIVSSYTPGSSHVLVPQPYKGVGDISRKGKLEDDHMFSMTEVLRSRVNRSTSSVSNNSVIYSTSPILKRGSSKRIVSSASAADVFEENTINFNDVPELSDSDEDSASSEDIIWGSETKISETEVVPENNNFNKTDSEDDDKIYSMNNKLTPVRKMTLRPTAEIVYQNLERFFPRAHLDKPVVEELHNSKSPVSKTSDKARINSILEQHSNISEKGVKSQNNDNVIKEKKSNTSLPRRTRTIRAIAHEAGEARRNSMKVKRSNTKMWGTKIVEITDKNTIEINKSKNARGEYKEFAWMKGEMIGKGSFGAVYLSLNITTGEMMAVKQVEVPKYGTQNELVKDMVEALKSEVATLKDLDHLNIVQYLGSEIRGNIYSLFLEYVAGGSVGSLIRLYGRFDEKLIRHLNTQVLSGLKYLHSKGILHRDMKADNLLLDEDGICKISDFGISKKSKNIYSNSDMTMRGTVFWMAPEMVDTKQGYSAKVDIWSLGCVVLEMFAGKRPWSNLEVVAAMFQIGKSKSAPPIPDDTIQLISSKGKDFLSKCFEIDPEKRPTADDLLEHSFSKVDPAFNFSRTRLYEFIKTNDKLNSSVLRNT

SEQ ID NO: 18353 - protein, 426 aa, Oryza sativa
MEPLHDEALSENSNELQQCTTSERSSTMISPAAADNSMITMAATSVESSVSADKVSPVEGQVTEAAVEHAPVEKDQCEEPNTTIVDSGDSSVSLKNEELQDHDQAPSGSSIMSNSAEQPEEASDVNMQQQVENVDTTQDATEESDATPEIGMVDVTYADTENYVQSPLLQTTSKLQSTTGQNVLKEPEAAKQSDVSGEYESVLVGKQNESANNLTGDSAKEEPPLVGLGMEADTHESAPRELKDEPILPETERSELSCEHGDITGHEDSEMYAPPECETDVQKESCCVDRRRADMQVPKEVECDELGDDNPKEDASVQTENMASEEASLASATPDGMKDENKVAEETTSDYATPYSSKSDNENKLAEENQKLKEMLQNLLASGSDQMGVITELSEKVKTLERKLARKKRPKVRVHRPTRQATAKVH

SEQ ID NO: 18354 - protein, 316 aa, Unknown
  Nocardioides sp. JS614
MTTPWRTAATWSLADIPPQDGRTVLVTGTTVGGLGQFTALELARRGARVVLAGRTEQRLEETRAAITTEVPAAALETLVVDLADLASVRRAAVQAAGLGPIDVLVNNAGVMGTPYHRTGDGLELQLATNHFGPFLLTGLLLPQLVASGAGTVVTVSSQMHRVARSAPLDDPRSQHGRYQRWPTYARSKLANLLFTYELDRRARRAELPVRALAAHPGFAATHLAANGQYGRARGGRATILDAAIKAISPNRADEGAWPTLMAATADLPGGTYCGPSGFAEGGGVPHVTTSNKLSHDQAAQRRLWELSEQTTGIRYP

SEQ ID NO: 18355 - protein, 382 aa, Geobacter metallireducens
MRKPINLLREFSVPLIAGVITALAWANLDPRGYDALIHQPSFGGVSLHFLVNELFMVLFFGIAAAEITQSCLPGGDLNPPRKAVNPLLATLGGVIGPVLVYLSLNAVIGDPTLTKGWGIPTATDIALAWLVARLVFGAGHPAVSFLLLLAVADDAIGLAIIAVFYPDPVHPTEPMWLFLTVAGIVAAYILRGARAKSYWPYVLVGGGLSWTGLFKAHLHPALALVFIIPFLPHPPRESAHLFEENPRDTSPLARFEHDWKIVVDFGLFLFGLANAGVRFSSVGTATWLVLTALLVGKTAGILTMGSLGKALGFPLPDRVGFKELALTGLVAGMGLTVALFVAGVAFVDPDIEGAAKMGALLSGGVLPVAVALGRILKVRRIP

SEQ ID NO: 18356 - protein, 225 aa, Zea mays
MLQCLDGVKQLLAVLLKCCHIDLKQPNGLEDPEVLARETVFSVSEVEALYELFKKISSAVIDDGLINKEEFQLALFKTNKKESLFADRVFDLFDTKHNGILGFEEFARALSVFHPNAPLDEKIEFSFQLYDLKQQGFIERQEVKQMVVATLAESGMNLLDEVIESIIDKTFEEADTKHDGKIDKEEWRNLVVRHPSLLKNMTLQYLKDITTTFPSFVFHSQVDDT

SEQ ID NO: 18357 - protein, 174 aa, Triticum aestivum
QGSSVTMKVSDATLAGMQDDAERVWSPELARLIRETAEPFVNVIYDADPLPRLSWAGGSVALVGDAAHPTTPHGLRSTNMSVHDARVLGECLARWGQTPPPRALAEYEAARLPVVAAQVLHARRLGRLKQGLPVEDGDTGAFDAWAATAEDALQLRQRGMPYFGGAPTVDGGSL

SEQ ID NO: 18358 - protein, 383 aa, Gloeobacter violaceus
MARDLYETLNVSRDASKEDIKRAYRKLARQYHPDVNKDAGAEDTFKELSRAYEVLSDDDQRARYDRFGEAGLNGGVGGGPGDFAGAAGFGDISDIFESFFGGFAGAGTGGRRATRPGGPTRGDDLRYDMVLEFQEAIFGGEKEITINHLITCETCRGSGSKPGSGPMTCRNCGGQGQIRQARRTPFGLFTQVAACPNCQGTGEVIESPCPTCSGRGRNQKQTTIKITIPAGVDAGSRLRVQGEGDAGMRGGPPGDLFIYVSVRNHPVFRREGQDIYSIAEISYLQAILGSQMSVETVDGPQTVVVPPGTQPETVLTLDGKGVPRIGNPTRRGNHYLQLKVVIPTKLGAEERELLTKLAKARGEKVSKKEGLEGLIDSIGNLFH

SEQ ID NO: 18359 - protein, 431 aa, Methanosarcina barkeri
MTESTKSKDESMRSHLGKPGPVYDGIEPGELGEVTESVQDRMRQLESRNSYLEEQCSQIESEKRYLENQKIKYEREIRKLQSELDRMKTSPLIIGTVIDVIKNDRIIVRSSNGPQFLVNVSQYIDEKKLLPGAKVALNQHTLAIAEVIPSTEEPFVAAMEVLESVEVDYDQIGGLDEQIQELQEAVELPLIEPERFARIGIDPPKGVLLYGLPGTGKTLLAKAVAHRTNATFIRVVGSELVQKYIGDGSKLVREIFEMARKKAPSIIFIDELDSIAARRLNETTGADREVQRTLMQLLAEMDGFDKRKNIRIIAATNRPDVLDPAILRPGRFDRLVHVPMPGVEARGKILKIHCGKMTLAGDIDFKRLAKATEGMSGADLKAIATEAGMFAVRKNKELIEMEDFLEAVDKVSMAADTQKMMPTSLPETMFV

SEQ ID NO: 18360 - protein, 307 aa, Desulfovibrio vulgaris
MQQFDAIVIGGGPAGMTAALYLARSGVSVAMVERLSPGGQVLMTSEIENYPGFPKGIQGWELADLFAAHLEGYAITRFNDEVREIVPAPADNRVRVGDDWISGRTLILCSGARYKRLGLPDEERLTGKGVSYCALCDGNFFRGQVVGVVGGGNSALEESLYLSKLVKKLHLIHRRDDFRAAKCYQDKVCIMPDIDVVRSSVVEAIHGDDRLTGVTVRNVKTGETSFLELDGLFIFIGFEPVGGFLPGGIERDEQGFVITDGEMRTNLPGIFAAGDIRSKMCRQVTTAVGDGATAANAAFVYLEQLDA

SEQ ID NO: 18361 - protein, 107 aa, Desulfovibrio vulgaris
MAAQITDATFEASVLKSAIPVLIDFWAPWCGPCRAMGPVIDELAAEYEGKVLIVKMNVDDNPATPSKYGIRAIPTLILFKNGEVVEQVTGAVSKSSIKDMIAQKALG

SEQ ID NO: 18362 - protein, 41 aa, Aegilops longissima
KGKLPKDARLALVDWWNTHYRWPYPTINNWFVNQRKRHWKP

SEQ ID NO: 18363 - protein, 464 aa, Unknown
  Mycobacterium sp. JLS
MRIAQHVSELIGNTPLVQLNSVVPEGAGTVAAKIEYLNPGGSSKDRIAVKMIDAAEASGELKPGGTIVEPTSGNTGVGLALVAQQRGYKCIFVCPDKVSEDKRNVLRAYGADVVVCPTAVAPDDPDSYYSVSNRLVTEIEGAWKPDQYSNPMGPESHYETTGPEIWRDTDGKVTHFVAGVGTGGTITGAGRYLKEVSGGKVRVIGADPEGSVYSGGTGRPYLVEGVGEDFWPSAYDPAVPDEIIAVSDADSFDMTRRLAREEGLLVGGSCGMAVVAAIEVAQKAGPDALVVVLLPDGGRGYLSKIFNDSWMSSYGFLRNRLDGSIEQPTVGDVLRGKSGELPDLVHTHPSETVRDAIGILREYGVSQMPVVGAEPPVMAGEVAGSVSERELLSAVFEGRAKLADAVAEHMSPPMPLIGAGELVSTAAKTLRECDALMVVEEGKPVGVVTRHDLLGFLSDGSTRR

SEQ ID NO: 18364 - protein, 260 aa, Unknown
  uncultured bacterium 582
MTVKTDKPSQLRVLVTAGASGIGRVIAESFAQTGARLHICDIADAALGEAKKTHPTWGVSRCDVSQSDQVARLFEEVGNNLGGLDVLINNAGIAGPTGGVEEITADDWRRTVDINLNGQFYCANRAVPLLKQSPNASIICISSVAGRLGYAYRTPYAATKWAIIGLTKSLAIELGPSGIRVNALLPGIVAGPRIEKVISDRAQTMGVSYGDMEQEYIDKVSLRRMVTAQDVANQAVFLCSPGGVNISGQSISICGNVEVL

SEQ ID NO: 18365 - protein, 58 aa, Avena vaviloviana
KGKLPKEARLKLLHWWELHSKWPYPSETEKIALAETTGLDQKQINNWFINQRKRHWKP

SEQ ID NO: 18366 - protein, 335 aa, Streptococcus pneumoniae
MKRIAVLTSGGDAPGMNAAIRAVVRQAISEGMEVFGIYDGYAGMVAGEIHPLDAASVGDIISRGGTFLHSARYPEFAQLEGQLKGIEQLKKHGIEGVVVIGGDGSYHGAMRLTEHGFPAIGLPGTIDNDIVGTDFTIGFDTAVTTAMDAIDKIRDTSSSHRRTFVIEVMGRNAGDIALWAGIATGADEIIIPEAGFKMEDIVASIKAGYECGKKHNIIVLAEGVMSAAEFGQKLKEAGDISDLRVTELGHIQRGGSPTPRDRVLASRMGAHAVKLLKEGIGGVAVGIRNEKMVENPILGTAEEGALFSLTAEGKIVVNNPHEADIELSSLNKSLS

SEQ ID NO: 18367 - protein, 320 aa, Coprinopsis cinerea
MPHSHHSHSGQFCKHASGKLEEVVQEAIRQKFQVFGLTEHVPRYRIDDLYPEESDMTLDDLMNQFEAFLAEAHRLKDLYASQITLLVGLETEHITEADLAGLDRILERFGDQVEYIVGSVHHVDGVPIDFDLPTYEKALGNFAPSTSSDAADDQRTTYAKFYSAYFDAQYQLLERFKPEVVGHFDLCRLFAPSMRFADFPDVWEKIIRNIKFSVSYGALFELNAAAFRKKWDTAYPGEDIIRVILGHGGRLALSDDSHGPHAVGLNYHRAYDYLKSVGVSELWYLTRSDEQNAGGRKVKPVKLEGKWEEHSFWSGIKNKP

SEQ ID NO: 18368 - protein, 171 aa, Argyroxiphium sandwicense
YQAFELIHARWAMLGAAGCIIPEAFNKYGASCGPEAVWFKTGALLLDGNTLNYFGKNIPINLVVAVVTEVVLVGGAEYYRIINGLDLEDKLHPGGPFDPLGLAKDPDQFALLKVKEIKNGRLAMFSMFAFFIQAYVTGQGPVENLASHLSDPFGNNLLTVISGNIERVPTL

SEQ ID NO: 18369 - protein, 608 aa, Ipomoea batatas
MATITASHFVSHVCGGATSGESKVGLGQLALRSQAVTHNGLRPVNKIDMLQLRTSAKKPSKNGRENEGGMAAGTIVCKQQGMNLVFVGCEVGPWCKTGGLGDVLGGLPPALAARGHRVMTVCPRYDQYKDAWDTCVVVELQVGDRIEPVRFFHSYKRGVDRVFVDHPMFLEKVWGKTGSMLYGPKAGKDYKDNQLRFSLLCQAALEAPRVLNLNSSNYFSGPYGEDVVFVANDWHTALLPCYLKTMYQSRGIYMNAKVAFCIHNIAYQGRFAFSDFSLLNLPDEYKGSFDFIDGYDKPVKGRKINWMKAGIREADRVFTVSPNYAKELVSCVSKGVELDNHIRDCGITGICNGMDTQEWNPATDKYLAVKYDITTVMQAKPLLKEALQAAVGLPVDRNIPLIGFIGRLEEQKGSDILYAAISKFISMDVQILILGTGKKKFEQQIEQLEVMYPDKARGVAKFNVPLAHMITAGADFMLIPSRFEPCGLIQLHAMRYGTPCICASTGGLVDTVKEGYTGFHMGAFNVDCETVDPEDVLKVITTVGRALAMYGTLAFTEMIKNCMSQELSWKGPAKNWETVLLSLGVAGSEPGVEGDEIAPLAKENVATP

SEQ ID NO: 18370 - protein, 147 aa, Alkalilimnicola ehrlichei
MQYLHTMVRVSDLDASLDFYCNKLGLVEISRKESEKGRFTLVFLAAPDDEARARSADKAPMLELTYNWDPETYTGGRNFGHLAFRVPDIYGLCQRLMDSGVTINRPPRDGHMAFVRSPDGISIELLQAGEALPPKEPWASMANTGTW

SEQ ID NO: 18371 - protein, 169 aa, Nicotiana sylvestris
MASQSSKPQSIYDFTVKDAKGNDVDLSIYKGKVLIIVNVASQCGLTNSNYTDLTEIYKKYKDQGLEILAFPCNQFGGQEPGSIEEIQNMVCTRFKAEYPIFDKVDVNGDNAAPLYKFLKSSKGGFFGDSIKWNFSKFLVDKEGNVVDRYSPTTTPASMEKDIKKLLGVA

SEQ ID NO: 18372 - protein, 436 aa, Nocardia farcinica
MTAIALFTRDLRVHDNPVLAAARDAGDAVVPLFVIDAHLVPDRCPPNRARFLAAAVRELDAELRTRGGRLIVRRGVVADEVARVVDETGARTVHLADDVSGYSAARADALRERLDRRGVRLEPHPASITTVDGDVLRPATGRDHFAVFTPYFRRWSEVPRRAPLPPPEDLEVPDLPSAALPTPESLNRGEPSPQLSVGGETTGRALLDSWLAGPVDDYVETGDDLAADATSHLSPYLHFGCLSPTELLHRVDVGSAGGQAFARQLAWRDFHHQLLAARPAVARHDYRPRPIRWRDDPQALAAWRSARTGYPIVDAALRQLHTEGWLPNRARLIAAAFLTKTLGLHWRAGAGHFLHWLVDADLANNQLNWQWVAGTGSDTRPNRGFNPLRQADRYDPDGVYVRRWIPELADLDGGRIHRPWRAEVDYPSPIAECPGM

SEQ ID NO: 18373 - protein, 159 aa, Brassica napus
AKPGVLERFMDNKDDIAKLRKCFAGLWSLDDPEIIKKAIEKPELFVMKPQREGGGNNIYGDDVRENLLRLQREGEEENAAYILMQRIFPKVSNVFLLRDGVYHKDQAISELGVYGAYLRNKERVIINEHSGYLMRTKVSSSDEGGVAAGYAVLDSIYLN

SEQ ID NO: 18374 - protein, 301 aa, Oryza sativa
MAEHLASIFGTEKDRVNCPFYFKIGACRHGDRCSRLHNRPTVSPTIVLANMYQRPDMITPGVDAQGQPIDPEKMQEHFEDFYEDIYEELSKFGEVETLNVCDNLADHMIGNVYVQFREEEQAVAAHNALQGRFYSGRPIIVEYSPVTDFREATCRQFEENSCNRGGYCNFMHVKQIGRELRRKLYGGRSRRSHGRSRSPSPRHRRGNRDRDDFRRERDGYRGGGDGYRGGGGGGGGDGYRGGDSYRGGGGGGRRGGGSRYDRYDDGGRRRHGSPPRRARSPVRESSEERRAKIEQWNRERE

SEQ ID NO: 18375 - protein, 162 aa, Saccharomyces cerevisiae
MTTSFYDLECKDKKGESFKFDQLKGKVVLIVNVASKCGFTPQYKELEELYKKYQDKGFVILGFPCNQFGKQEPGSDEQITEFCQLNYGVTFPIMKKIDVNGSNADSVYNYLKSQKAGLLGFKGIKWNFEKFLVDSNGKVVQRFSSLTKPSSLDQEIQSLLSK

SEQ ID NO: 18376 - protein, 231 aa, Mantoniella squamata
MACIASSFVGSVAALKATKVQAKSVSTVVKADIYPEFGTYPGGGESPIIPFGSEKNAEREVIHGRWAMLGVTGAWTTENGTGIPWFTAGTLCTPDDCTAVADKFPGAVAPLAPEGSGYPSFWAVLAIEVVLVGLAEAYRTGLSDSPFEELTVGDVSPGGRFDSLGLAESGDLEELKIKELKHCRLSMFAWLGCIFQALATQEGPIANWQAHVADPVHANVLTNAASGFGFY

SEQ ID NO: 18377 - protein, 472 aa, Oryza sativa
MGGGGGGTPRSSIGHILPGAGFVAVGVWHLFNHVKLFSQRPDTYVAPAWFPVPGARYLELALIIAGSGVEFAMEMFVGHSTLLPFAADGSIPSDRLHNHEHAIICLSLAVYAAAALHLDRARAPARGTLGLLLVAAVFAQELLVFHFHSTDHAGVEGQFHWLLQVVVAACLATSLLGVGYPRSFAVGLARSACVAFHGLWLAVIGAMVWVPSLVPRGCELVREDGRDTVRCRSKESLHRAKALANLQFGWYLSFMTVFVVALYLYVSNRYPAAEEAAYAPLQKAGAGDGDDDGDDDAHKGGGAGVHGFAALEIEAGNVSCPETAPKHESRGWCIEAPRPITARHVASPFHTLPFPSLPFATALLPPLLLLASAFIPLPLFLAPTPKTLAAATAAAAAVCSSMEAPPPPKEAAAEKVDGSPQPQPQAELRLRLPAEIDWDRLDKWRFFVLGAGLFSAVSTALYPAVVLKTRLQ

SEQ ID NO: 18378 - protein, 231 aa, Mantoniella squamata
MACIASSFAGSVAALKATKVQAKSVSTVVKADIYPEFGTYPGGGESPIIPFGSEKNAEREVSHGRWAMLGVTGAWAAENGTGIPWFTAGTLCTPDDCTAVADKFPGAVAPLAPEGSGYPSFWAVLAIEVVLVGLAEAYRTGLTDSPFEELTVGDVSPGGRFDPLGLAESGDLEELKIKELKHCRLSMFAWLGCIFQGLATQEGPIANWQAHVADPVHANVLTNAASGFGFY

SEQ ID NO: 18379 - protein, 346 aa, Kineococcus radiotolerans
MSDVTTNEIRNVIVVGSGPSGYTAALYAARAELRPLVFEGSVTAGGALMNTTEVENFPGFPEGILGPDLMDNMRQQAERFGAELITDDVVDVRLEGDVKEVVTGGGETYRAHAVILALGSAYRQLGLPDEKRLSGRGVSWCATCDGFFFREQDIVVVGGGDSAVEEATFLTRFARTVTIVHRRDELRASRIMRKRAEDNPKIRFAWNSEVTGILGGDKVEGLTLRDTVTGETREIPATGLFIAIGHEPRTDLVKGQVDLDENGFVLVEGRSTRTNVPGVFAAGDVVDHEYMQAITAAGMGCSAALDAEKYLAARGDAGLDAQPAREETETPDVPDSETTDRPQPRA

SEQ ID NO: 18380 - protein, 1033 aa, Oryza sativa
MERARRLANRALLRRLLAAAASTTSPAPSRGISTLAKAPGAGSRPRAPRPAPHQYTTGRPVSASALQPSDTFPRRHNSATPAEQAAMASECGFNTLDALIDATVPAAIRAPTMHFSGKFDAGFTESQMIDHMQRLAAMNKAYKSFIGMGYYNTHVPAVILRNLMENPAWYTQYTPYQAEIAQGRLESLLNYQTMVADLTGLPMSNASLLDEATAAAEAMAMCNGILKSKKKTFLIASNCHPQTIDVCQTRAAGFDLNVIVADAKDFDYSSGDVCGVLVQYPGTEGEVLDYAEFVKDAHAHGVKVVMATDLLALTSLRPPGEIGADIAVGSAQRFGVPMGYGGPHAAFLATSQEYKRLMPGRIIGVSVDSSGKPALRMAMQTREQHIRRDKATSNICTAQALLANMAAMYAVYHGPEGLKAIADRVHGLAGTFAHGLKKLGTVTVQELPFFDTVKVKVADANAIAQEACKNEMNLRVVDATTITVAFDETTTLEDVDKLFKVFNGGKPVNFTAESLASEVSSSIPSSLVRKSPYLTHPIFNMYHTEHELLRYLHKLQSKDLSLCHSMIPLGSCTMKLNATVEMMPVTYPSFANMHPFAPTEQAAGYHEMFDDLGDLLCKITGFDSFSLQPNAGASGEYAGLMVIRAYHRARGDYHRDVCIIPVSAHGTNPASAAMCGMKIVAVGTDSKGNINIEELRKAAEANKDNLAALMVTYPSTHGVYEEGIDEICRIIHENGGQVYMDGANMNAQVGLTSPGFIGADVCHLNLHKTFCIPHGGGGPGMGPIGVKKHLAPFLPSHPVITTGGFPLPEKTDPLGTISAAPWGSALILPISYTYIAMMGSKGLTDASKIAILNANYMAKRLEKHYPVLFRGVNGTVAHEFIIDLRGFKTTAGIEPEDVAKRLMDYGFHAPTMSWPVPGTLMIEPTESESKAELDRFCDALISIREEIAEIESGKADVNNNVLKSAPHPPQLLMSDSWTKPYSREYAAFPAAWLRGAKFWPTTCRVDNVYGDRNLICTLQQGSQVAEEAAAATA

SEQ ID NO: 18381 - protein, 327 aa, Unknown
  Synechococcus sp. WH 7805
MVGMKRILITGASSGIGLEATRRLALSGHQLTLFCRTPERGEQTRSQLVAAGAMPSQVSWLLADLADLRSVQSACDQLLDRAEPLDALVLNAGQQRAGAEAPVFSPQGLEITFAVNQLAHQLIATRLLPLLRLGSQPRLVITASDVHNPASGGGRVGQPADLGDLAGLKAGAGFAMLDGSASFDGDKAYKDSKLCNVLLGRELNRQLDAMMPVIAWSPGLVIPRSSGGFFRHNRQSNPLGMLLFALVARDVLRVTESVQTAGRLLADLITDSGYAASGFSYWSNRLVRPGVHRFSEAETSAEGADLQKAVDLFRLSDDLICEALAPN

SEQ ID NO: 18382 - protein, 723 aa, Listeria monocytogenes
MSEKQVFSTEWAGKTLSVEVGQLAKQASGAALIRYGDTVVLTAAVGSKKPRPGDFFPLTVNYEEKMYSVGKVPGGFLKREGRPSDRATLTARLIDRPIRPLFAEGFRNEVQITSTVFSVDQDCSPEMAAMLGSSVALVISDIPFEGPIAGVDVGRIDGKYVINPTIEQAEKSDISLTVAGTYDAINMVEAGAKEVSEEAMLEAIMFGHEEIKRLCEFQQQIIAAVGKEKREIELFVSDPELEAEVKAASEGKMKAAIKTEEKKAREAAIEDVKEEILESYKAKELENEAEILSEVAHILEMIEKDEMRRLISQDKIRPDGRKVNEIRPLSSEVGMLPRVHGSGLFTRGQTQALSVCTLAPLREHQIIDGLGTEEYKRFMHHYNFPQFSVGETGPRRAPGRREIGHGALGERALQYVIPSEEEFPYTIRLVSEVLESNGSSSQASICGSTLAMLDAGVPIKAPVAGIAMGLVKLGDDYTILSDIQGMEDHFGDMDFKVAGTKDGITALQMDIKIDGLSRQILDEALTQAKEGRLHILEHLTSTISAPREELSAYAPKIITLNIKPEKIKDVIGPGGKQINAIIDETGVKIDIEQDGTVYIASQDQAMNRKAIAIIEDIVREVEVGEVYTGKVRRIEKFGAFVELFKGTDGLVHISELAHERVGKVEDILKLGDEVTVKVIEVDQQGRVNLSRKALLEKKEQPEGDKKPQAEKKFYPKTKKPESK

SEQ ID NO: 18383 - protein, 218 aa, Zea mays
MAWWHAVAIVGHVALWVGGAKMGKKVAVVVGGSVAGLACAHAVAGAGWEVVVLEKAAAPAAGSGTGAGLGLDAQSMEIISRWIPGWGIDAVTLPLAVDLVSFPVLSGSPALALRLQNIATDSATKAARTLARDEDFKFRAAHWGDLHRRLHEELPPAVTVLWGHQFLSFEAPDDTRGVVATARVLRTGGTVEATGDLLIAADGSTSSVRRSFLPDLKL

SEQ ID NO: 18384 - protein, 306 aa, Brassica napus
VDPRVRAWLMLTCFQTSVISSSMFLTAMAANPLSANLAFNTIKQTIGWTDWAKAAIVPGIVSLIVVPFLLYLIYPPTVKSSPDAPKLAQEKLDKMGPMSKNELIMAATLFLTVGLWIFGAKLSVDAVTAAILGLSVLLVTGVVTWKECLAESVAWDTLTWFAALIAMAGYLNKYGLIEWFSQTVVKFVGGLGLSWQLSFGILVLLYFYTHYFFASGAAHIGAMFTAFLSVSTALGTPPYFAALVLAFLSNLMGGLTHYGIGSAPIFYGANYVPLSKWWGYGFLISIVNILIWLGVGGAWWKFIGLW

SEQ ID NO: 18385 - protein, 284 aa, Medicago truncatula
MFFLQSFHHRQTPSSYPPSQSSNSIVPNRYPNRNGYIKFRTTYNENLHYLKALTIINPNTKPNNLPHPDTINHILTIITFLKSHSFTEADIPRLVHHSPHLFTTSISPTSLSPVFTFLASDLLASVEDSHGLILRCPNLLFTDVNHILKPTLHFLREEVGVSNLNRPTNRNAHLLNTRVEKMRMRVRFLEEVVGFTYEEARNVCARLPAILGYDVENNLWPKFVYLVKEMEREVEELKKFPQFFGFSLDKRIVPRHLHLKERGVRIPLNRMLMWGDEKFYAKWK

SEQ ID NO: 18386 - protein, 420 aa, Saccharophagus degradans
MFDTKQTLDAFDPEIWQSIQDEAQRQEEHIELIASENYTSPMVMEAQGTKLTNKYAEGYPGKRYYGGCEYVDKAEALAIERAKTLFGADYANVQPHSGSQANSAVYAALCSPGDTVLGMSLAHGGHLTHGASVSFSGKMYNAVQYGINPDTGLVDYEEIANLAREHKPKMIVAGFSAYSQVLDWQKFRDIADEVGAYLMVDMAHVAGLVAAGVYPSPVQIADVTTSTTHKTLRGPRGGIILAKANPEIEKKLNSAVFPGGQGGPLMHVIAAKAISFKEAMTDEYKAYQKQVVANAKAMAATFNERGIKIVSGGTENHLMLVDLIGKEYTGKDADAALGAAYITVNKNAVPNDPRSPFVTSGLRVGTPAVTTRGFKEKQCIDLTNWICDVLESLENGNSEQVIADVKAKVLAVCAEFPVYK

SEQ ID NO: 18387 - protein, 475 aa, Triticum aestivum
MSTTEGKADAAAVEEMARSATAWCAMHGLVVGDRADPRSGTVPGVGLVHAPISLLPSRLPESFWSQACELAPLFNELVDRVSLDGDFLQDSLSKTRQVDDFTSRLLDIHRKMMDANKEENIRLGLHRSDYMLDSETNSLLQIELNTISVSFPGLCSIVTELHRTLINQYGNLLCLDAKRVPGNDASRQFAKALAKAWDEFNVDSAVVMMIVQPEERNMYDQYWLVKYLRESHGITTIRKTLSEVEAEGQVLLDGTLVVNGRKVAVVYFRAGYTPNDYPSEAEWSARLLMEQSSAVKCPSISYHLVGTKKIQQELAKPNVLERFLENKEEIAKLRQCFAGLWSLDDKEVVKSAIENPDLFVLKPQREGGGNNIYGLDVREALIRLKKEGGDALSAYILMQRIFPKASLASLVRGGFCHEALTVSELGIYGAYLRNKDKVIINDKCGYLMRTKVCSSDEGGVAAGFAVLDSLYLTDK

SEQ ID NO: 18388 - protein, 1109 aa, Ipomoea nil
MKVAVNTFLLFLCSTSSIYAAFALNSDGAALLSLTRHWTSIPSDITQSWNASDSTPCSWLGVECDRRQFVDTLNLSSYGISGEFGPEISHLKHLKKVVLSGNGFFGSIPSQLGNCSLLEHIDLSSNSFTGNIPDTLGALQNLRNLSLFFNSLIGPFPESLLSIPHLETVYFTGNGLNGSIPSNIGNMSELTTLWLDDNQFSGPVPSSLGNITTLQELYLNDNNLVGTLPVTLNNLENLVYLDVRNNSLVGAIPLDFVSCKQIDTISLSNNQFTGGLPPGLGNCTSLREFGAFSCALSGPIPSCFGQLTKLDTLYLAGNHFSGRIPPELGKCKSMIDLQLQQNQLEGEIPGELGMLSQLQYLHLYTNNLSGEVPLSIWKIQSLQSLQLYQNNLSGELPVDMTELKQLVSLALYENHFTGVIPQDLGANSSLEVLDLTRNMFTGHIPPNLCSQKKLKRLLLGYNYLEGSVPSDLGGCSTLERLILEENNLRGGLPDFVEKQNLLFFDLSGNNFTGPIPPSLGNLKNVTAIYLSSNQLSGSIPPELGSLVKLEHLNLSHNILKGILPSELSNCHKLSELDASHNLLNGSIPSTLGSLTELTKLSLGENSFSGGIPTSLFQSNKLLNLQLGGNLLAGDIPPVGALQALRSLNLSSNKLNGQLPIDLGKLKMLEELDVSHNNLSGTLRVLSTIQSLTFINISHNLFSGPVPPSLTKFLNSSPTSFSGNSDLCINCPADGLACPESSILRPCNMQSNTGKGGLSTLGIAMIVLGALLFIICLFLFSAFLFLHCKKSVQEIAISAQEGDGSLLNKVLEATENLNDKYVIGKGAHGTIYKATLSPDKVYAVKKLVFTGIKNGSVSMVREIETIGKVRHRNLIKLEEFWLRKEYGLILYTYMENGSLHDILHETNPPKPLDWSTRHNIAVGTAHGLAYLHFDCDPAIVHRDIKPMNILLDSDLEPHISDFGIAKLLDQSATSIPSNTVQGTIGYMAPENAFTTVKSRESDVYSYGVVLLELITRKKALDPSFNGETDIVGWVRSVWTQTGEIQKIVDPSLLDELIDSSVMEQVTEALSLALRCAEKEVDKRPTMRDVVKQLTRWSIRSYSSSVRNKSK

SEQ ID NO: 18389 - protein, 317 aa, Vigna radiata
MANFPVVDMGKLNTEERGAAMEMIKDACENWGFFELVNHGISIELMDTVEKLTKEHYKKTMEQRFKEMVANKGLESVQSEINDLDWESTFFLRHLPVSNVSENTDLDQDYRKIMKQFAEELEKLAEHLLDLLCENLGLEKGYLKKVFYGSKGPNFGTKVSNYPPCPTPDLIKGLRAHTDAGGIILLFQDDKVSGLQLLKDDQWIDVPPMRHSIVINLGDQLEVITNGKYKSVMHRVIAQTDGTRMSLASFYNPGDDAVISPAPALVKESDETSQVYPKFVFNDYMKLYAGLKFQAKEPRFEAMKAVSSVDVGAIATV

SEQ ID NO: 18390 - protein, 317 aa, Vigna radiata
MASFPVVDMGKLNTEERGAAMEMIKDACENWGFFELVNHGISIELMDTVEKLTKEHYKKTMEQRFKEMVANKGLESVQSEINDLDWESTFFLRHLPVSNVSENTDLDQDYRKIMKQFAEELEKLAEHLLDLLCENLGLEKGYLKKVFYGSKGPNFGTKVSNYPPCPTPDLIKGLRAHTDAGGIILLFQDDEVSGLQLLKDDQWIDVPPMRHSIVINLGDQLEVITNGKYKSVMHRVIAQTDGTRMSLASFYNPGDDAVISPAPALVKESDETSQVYPKFVFNDYMKLYAGLKFQAKEPRFEAMKAVSSVDVGAIATV

SEQ ID NO: 18391 - protein, 317 aa, Vigna radiata
MANFPVVDMGKLNTEERGAAMEMIKDACENWGFFELVNHGISIELMDTVEKLTKEHYKKTMEQRFKEMVANKGLESVQSEINDLDWESTFFLRHLPVSNVSENTDLDQDYRKIMKQFAEELEKLAEHLLDLLCENLGLEKRYLKKVFYGSKGPNFGTKVSNYPPCPTPDLIKGLRAHTDAGGIILLFQDDKVSGLQLFKDDQWIDVPPMRHSIVINLGDQLEVITNGKYKSVMHRVIAQTDGTRMSLASFYNPGDDAVISPAPALVKESDETSQVYPKFVFNDYMKLYAGLKFQAKEPRFEAMKAVSSVDVGAIATV

SEQ ID NO: 18392 - protein, 101 aa, Oryza sativa
  misc_feature (54)..(54): Xaa can be any naturally occurring amino acid
  misc_feature (58)..(58): Xaa can be any naturally occurring amino acid
  misc_feature (88)..(88): Xaa can be any naturally occurring amino acid
SPAASKTDYVTKGSMDYGFHAPTMSWPVPDTLMIEPTESDSNALLYWYCEALLXNDGXITHIERGPADVNNNVLKSAPHALQLLMIDXWTKPYCREYTAIP

SEQ ID NO: 18393 - protein, 390 aa, Xylella fastidiosa
KVGALPIIGAPSLTTSLQRWAETGRITWRQGTFEDSWLQEDIWLVIAATDQPEVNHAAARAAHAQRLFVNVVDDITLSNVQVPAVVERGPLRIAISSGGGAPMVARYLRQQLESLIDDSWGRLTTLFAQRRDTIRARYPNIEARRRFFETQLAGPLQRLLRKQRHAEAEAVLEAALAKTPTTESGSVTLVGAGAGDAGLLTLNALRALNEADIILYDRLVSDTVLQMARRDAEQIEVGKSATGHSVRQEDIHTLMLQHAHAGQRVVRLKGGDPFVFGRGGEELEFLRTHGIPYEVIPGITAALACAAYAGIPLTHRDHAQSLCLITAHCQSSLDTLNWVALAQERQTLTFYMGVAGLPTIQQRLCEAGRAETTPFALIENGARAQQRVLT

SEQ ID NO: 18394 - protein, 215 aa, Pseudomonas syringae
MTLRSEILVNKNVLPTAEQALPGRETPMTLPETHFVNGNPLLGPFTSNVEFAIFGLGCFWGAERRLWQQEGVVSTVAGYAGGFTPNPTYEEVCSGLTGHTEVVLVVYEPEKISYDSLLKVFWEAHNPTQGMRQGNDIGTQYRSVIYCTTPEQLAAAKASADAFQAELSKAGLGGITTEIEEAPTVYFAETYHQQYLAKNPQGYCGLGGTGVCLPA

SEQ ID NO: 18395 - protein, 390 aa, Xylella fastidiosa
KVGALPIIGAPSLTASLQRWAETGRITWRQGTFEDSWLQEDIWLVIAATDQPEVNHAAARAAHAQRLFVNVVDDITLSNVQVPAVVERGPLRIAISSGGGAPMVARYLRQQLESLIDDSWGRLTTLFAQRRDTIRARYPNIEARRRFFETQLAGPLQRLLRKQRHAEAEAVLEAALAKTPTTESGSVTLVGAGAGDAGLLTLNALRALNEADIILYDRLVSDTVLQMARRDAEQIEVGKSATGHSVRQEDIHTLMLQHAHAGQRVVRLKGGDPFVFGRGGEELEFLRTHGIPYEVIPGITAALACAAYAGIPLTHRDHAQSLCLITAHCQSSLDTLNWVALAQERQTLTFYMGVAGLPTIQQRLCEAGRAETTPFALIENGARAQQRVLT

SEQ ID NO: 18396 - protein, 494 aa, Oryza sativa
MTSARPAPVSAGEASLGRHLARRLVQVGVSDVFAVPGDFNLTLLDHLIAEPGLRLVGCCNELQRRAVVTNLEDAHEQIDTAIATALRESKPVYLSISCNLPGLPHPTFSRDPVPFFLAPRLSNKMGLEAAVEATVEFLNKAVKPVLVGGPKLRVAKAGKAFVDLVDASGYAYAVMPSAKGLVPETHPHFIGTYWGAVSTAFCAEIVESADAYLFAGPIFNDYSSVGYSFLLKKDKAIIVQPERVIVGNGPAFGCVMMKEFLSELAKRVNKNTTAYENYKRIFVPEGQPLESEPNEPLRVNVLFKHVQKMLNSDSAVIAETGDSWFNCQKLKLPEGCGYEFQMQYGSIGWSVGALLGYAQGAKDKRVIACIGDGSFQVTAQDVSTMIRCAQNSIIFLINNGGYTIEVEIHDGPYNVIKNWNYTGLVDAIHNGEGKCWTSKVKCEEELTEAIGMALGEKDCLCFIEVIAHKDDTSKELLEWGSRVSAANSRPPNPQ

SEQ ID NO: 18397 - protein, 72 aa, Wolinella succinogenes
MAKDDVIEVDGKVIEALPNATFRVELDNKHVILCHIAGRMRMHYIKILPGDRVKIELTPYSLDKGRITFRYK

SEQ ID NO: 18398 - protein, 355 aa, Chlamydia trachomatis
  misc_feature (17)..(17): Xaa can be any naturally occurring amino acid
ACLQVDSRGSPQIGIKXSELGPKAMYFAMQGSCPSDKRIFFVSNIDPDNAAEVLLEIDLEQTLVVVVSKSGTTLEPAANEELFRQAYQNKGLSIAEHFVAVTSQGSPMDDKSAYLEVFHLWDSIGGRFSATSMVGGVVLGFAFGYEAFIEFLQGAAAIDAHALTPKMRENLPLLSAMLGVWNRNLLGYPTTAVIPYSTGLKYFTAHLQQCGMESNGKSISREGKEISFRTSPIIWGDVGTNCQHSFFSLHQGTDIVPVEFIGFLHNQRGLDCVLSGTSSSQKLFANLVAQSLALAQGRDNANPNKRFKGNSPSSILVAQQLSPRIAGSLLAFYSINLHFKGFAGESILLTKKGFH

SEQ ID NO: 18399 - protein, 277 aa, Oryza sativa
MTAATAAGAFGFGRTRADMEPSSQPQPVMGVATGGSQAYPPPAAAYPPQAMVPGAPAVVPPGSQPSAPFPTNPAQLSAQHQLVYQQAQQFHQQLQQQQQQQLREFWANQMEEIEQTTDFKNHSLPLARIKKIMKADEDVRMISAEAPVVFAKACEVFILELTLRSWMHTEENKRRTLQKNDIAAAITRTDIYDFLVDIVPRDEMKEEGLGLPRVGLPPNVGGAADTYPYYYVPAQQGPGSGMMYGGQQGHPVTYVWQQPQEQQEEAPEEQHSLPESS

SEQ ID NO: 18400 - protein, 81 aa, Glycine max
HEGILREISRHSSVEHIDICELDQMVIDVYSEFFPDIAVGYEDPRVHVHISDGKKLNHLLLTCITNHTCLNKLCSLYNEAL

SEQ ID NO: 18401 - protein, 351 aa, Oryza sativa
  misc_feature (219)..(219): Xaa can be any naturally occurring amino acid
MENGHAKNLVAVIGSGNWGSVASRLIASNTAKLPSFHDEVRMWVFEEILPTGKKLSESINQANENCKYLPGIKLGANVIADPDLENAVKDANMLVFVTPHQFVEGICKKLVGKLRPGTEGISLIKGMEVKMEGPCMISKLITNILGINCCVLMGANIANEIAVEKFSEATIGYKKDKEVATRWAKLFTTPYFLVSVVEGIEGVELCGTLKNVVAIAAGXVGGLDMGNNTKAAIMRIGLREMRAFSKLLSPTVRDNTFFESCGVADLITTCLGGRNRRVAEAFARNGGKRSFDELEAEMLHGQKLQGVSTAKEVYEVLTYRGWQELFPLLSTVHEICIGQLPPTSIVEYRIH

SEQ ID NO: 18402 - protein, 401 aa, Geobacter metallireducens
MDMDEKDVVETEEESFAELFEKSNSETQRLRPGSKVEGKILKIGAEWVFIDIGKKGEGVMERKELQDAEGNLTVAEGDTITAWFTGSVRNEMRFTTKLGAGAAANAQLEEAHRSGIPVEGFVVKEIKGGFEVRLSGTTRAFCPFSQISLRRAENPAEFVGKHLLFKVTEYSERGRNIVLSHRQILEEEQRVKREALKEVLLEGMTVTGTVTRLADFGAFVDLGGVDGLIPVSEVGWTRVKHVRDVLSVGEQVSVVIKKIDWEAGKISLSLKDTLADPWTTVAEQFPEGSYHTGTVARLAAFGAFVTLAPGIDGLIHISKLGKGKRINHPSDVLKEGETVEVKVDGVDREARRLSLALAEVSRAAEEEEKSVASFRQQATSSSKESMGSFGDLLKAKIEEKR

SEQ ID NO: 18403 - protein, 607 aa, Bacillus cereus
MCGITGWVNWNKDLSNEHVILKKMANRIQHRGPDAEGFWFSPRAAFAHRRLIVIDPEGGAQPKTFRAGDYTYALTYNGEIYNFRELREHLQKCGHTFETHSDTEVLLHAYLEWKEDCVQHLNGIFAFALWDDQKQRLFLARDHLGVKPLFYTERNDSIIFGSEIKALLAHPSVPAEIDANGINEIFGLGLFRTPGCGVFKHIEEVRAGHSITFTRDKKVVTKYWNLESKVHTDSIEDTSSHILSILQDTVKRQLIADVPLVCMLSGGLDSSGITALAGKEFAAENKTLHTYSVDFVNSAKDFELTFARTGLDAPWVKRVSEHVGTSHHDIIVNAEELANRLFVPLRAKDLPSAGEMETSLYLLFCEMKKDATVALSGESADEVFGGYPWFHQEELLYVDKFPWLTNWKNTSPLLLHEVSNQCNLENYIDTRFQKAILEVPTLEGESKKSAKQRQMFYLFLTRFLPFLLDRKDRMSMAVGFEVRVPFCDYRLVEYLWNVPFNIKSIDNIEKGILRRALKPALPDDVRNRRKSAYPTSQDPHYLQTIRNLTLDMCSNKNNPIFSLINHSTLLAIANQSNKEINNFEARSAIEYMLQVNEWLKTYHIHIA

SEQ ID NO: 18404 - protein, 136 aa, Schizosaccharomyces pombe
MARTKQTARKSTGGKAPRKQLASKAARKAAPATGGVKKPHRYRPPTVALREIRRYQKSTELLIRKLPFQRLVREIAQDFKTDLRFQSSAIGALQEAVEAYLVSLFEDTNLCAIHGKRVTIQPKDMQLARRLRGERS

SEQ ID NO: 18405 - protein, 322 aa, Hyphomonas neptunium
MAANDQVPVGSGFHAKSTAREVVEGISLSGKHAIVTGGYSGIGLETVRALAGAGAKVTVPARRPDAAKDALTGINGVTVAAMDLADLGSVRRFAQDYSAAAPKLDLLINNAGIMACPLAHVGDGWEAQFGTNHLGHLALYQGLLPALRAANGARVVALSSTGHVRSDVIWDDPNYTSRAYDKWEAYGQSKSANALFALGVDMREKANGIRAFSVHPGGIFTNLQRHLPDEEMVALGWKSPDGTIPEMIQAMFKTPEQGASTTVWAATAPKLNGKGGVYCEDCDIARAATPDSKRWEHARAWISDDARAEKLWAMSDTFLANA

SEQ ID NO: 18406 - protein, 709 aa, Photorhabdus luminescens
MLNPIVRKFQYGQHTVTIETGMMARQATAAVMVNMDDTAVFVTVVGQKKVKAGQDFFPLTVNYQERTYAAGRIPGSFFRREGRPGEGETLVARLIDRPLRPLFPEGFLNEVRIVATVVSVNPQINPDIVAMIGASAALALSGIPFNGPIGAARVGYINDQYVLNPTSDELKNSRLDLVVSGTAGAVLMVESEADLLTEEQMLGAVVFGHDQQQVVIDNINALAAEAGKEKWDWVPEPVNQALHDRVAELAESRLGDAYRITEKQERYAQVDAIKDEVTAALLEQDETLEEAEIHEILGSLEKNVVRSRVLSGEPRIDGREKDMVRALDVRTGVLPRTHGSALFTRGETQALVTATLGTERDAQIIDELMGERTDRFLLHYNFPPYSVGETGMMGSPKRREIGHGRLAKRGVLAVMPKANEFPYTVRVVSEITESNGSSSMASVCGASLALMDAGVPIKAAVAGIAMGLVKEGDNFVVLSDILGDEDHLGDMDFKVAGSCEGISALQMDIKIEGITREIMQVALNQAKGARLHILSVMEQAITTPRDDISQFAPRIHTIKINPDKIKDVIGKGGSVIRALTEETGTTIEIEDDGTVKIAATDGEKAKHAISRIEEITAEIEVGRIYAGKVTRIVDFGAFVAIGGGKEGLVHISQIADKRVEKVADYLQVGQETSVKVLEIDRQGRVRLSIKEATAGTAVEEAPPAPQSAE

SEQ ID NO: 18407 - protein, 475 aa, Bifidobacterium longum
MIGLATMGSNLARNLAHHGNTVALFNRHYSRTEKLMNEHGTEGNFVPAETLEEFAASLKRPRTAIIMVKAGAPTDATIAQLEEVFEPGDIIVDGGNSFFKDTIKREKEVRAKGFHFVGCGVSGGEEGALNGPSLMPGGTAESWKTLGPILQSIAAKVNGEPCVTHIGTDGAGHFVKMVHNGIEYADMQVIGEAYDILRRGLGMDAEEIGDVFAEWNKGDLDSYLIEITAEILHHKDAETGKPFVDVVVDHAGMKGTGTWTVQAGLEFGSPVAAIGEAVFARALSSHGELREDAQKEGLAGPNKTIDLAGEDKAAFVEDVRKALFASKVVAYAQGLNEIQDGAKEYGWDINLSEVARIWRGGCIIRAQFLLDRITEAFRGDNPPASLLFDPYFEKIIGESQDAWRRVIVRAVEAGIPTPVFSSSLAYYDGLRSKRLPTALTQSQRDFFGAHTYGRVDKPGVFHTLWAEEGKPEIEA

SEQ ID NO: 18408 - protein, 281 aa, Saccharomyces cerevisiae
MSNHSEILERPETPYDITYRVGVAENKNSKFRRTMEDVHTYVKNFASRLDWGGFAVFDGHAGIQASKWCGKHLHTIIEQNILADETRDVRDVLNDSFLAIDEEINTKLVGNSGCTAAVCVLRWQLPDSVSDDSMDLAQHQRKLYTANVGDSRIVLFRNGNSIRLTYDHKASDTLEMQRVEQAGGLIMKSRVNGMLAVTRSLGDKFFDSLVVGSPFTTSVEITSEDKFLILACDGLWDVIDDQDACELIKDITEPNEAAKVLVRYALENGTTDNVTVMVVFL

SEQ ID NO: 18409 - protein, 827 aa, Unknown
  Silicibacter sp. TM1040
MRDWLQSFFVALGNRTYLPTWIALFVVGIAFAYAERQNQIINDQELRAEVQAEVGLIRSHLEGKLTADVQLIKGLVGALMAEQLMTQETFNEVASYAAGDRHEILNIAIAPDLVVTMVYPYERNKAVLGLDYNKNEAQREAVMRMRDSGEIVLAGPVNLVQGGTGFIIRYPVFAGEGADRRFWGMVAAVIDADALYAEAGLAAEDLPIEIALSGRDGTGHQGGVFYGDQNIHDHDPIVTDVFLPTGTWELAAIPRGGWPKQPGNLLELRLVLLAAGILIIVPTFMACRLSAVRRATINTLRKRETELERNQAELEQLSTVAQNASDSIVLSGPDQRIFWVNEAFSRMTGYTVDEAVGKRPGELLNGPETDPATIREISEYISRGERLHREILNYTKSGKTIWVDTNLVPVLDEDGEINMVIGIERDVTSQKQNAAELAVAKVAAEQADRTKTEFLANMSHEIRTPMNGIIGMADLLSETELHEDQEQYVQIIRTSSKALLKIINDILDLTRMESGKLSLEPVDFDLESCIENAVDILRPVASEKGLDLTVNYASGLPRTVRADDGRLRQILVNLVGNAVKFTASGRVDVRVLCASTNPYRLTIDVQDTGIGMTSAQLHNIFDRFSQADAATTRSFGGTGLGLTISRLLAKQMDGDITVYSDPGRGSCFSLHIQCQAPLGLPGHIDADEAPDLDLIYGCKVLLAEDNRTNRLLIRKYLSDLSVDLIEASNGQEAVELCAHHRPDLILMDMSMPEMDGLTATRLIRMPQNPHQPPIVALTANAFASDREACLAAGMNGFLSKPINKRELLHGMAGVLDDPDNLRRVASG

SEQ ID NO: 18410 - protein, 381 aa, Volvox carteri
MQIFVKTLTGKTITLEVESSDTIENVKAKIQDKEGIPPDQQRLIFAGKQLEDGRTLADYNIQKESTLHLVLRLRGGMQIFVKTLTGKTITLEVESSDTIENVKAKIQDKEGIPPDQQRLIFAGKQLEDGRTLADYNIQKESTLHLVLRLRGGMQIFVKTLTGKTITLEVESSDTIENVKAKIQDKEGIPPDQQRLIFAGKQLEDGRTLADYNIQKESTLHLVLRLRGGMQIFVKTLTGKTITLEVESSDTIENVKAKIQDKEGIPPDQQRLIFAGKQLEDGRTLADYNIQKESTLHLVLRLRGGMQIFVKTLTGKTITLEVESSDTIENVKAKIQDKEGIPPDQQRLIFAGKQLEDGRTLADYNIQKESTLHLVLRLRGGL

SEQ ID NO: 18411 - protein, 435 aa, Oryza sativa
MDTPSSSGSGGHLLHLHRSGGSSFRRRLRPGAAGEAGTPLGGVSYVSTPIPDDDDAFDVGANRLETLYSNIEMNGQYKVLTYSSNTIALMQQGGLRIQAGEKWKEEETVELEGSLGKSNAVNQELVALERELATHRRTGAIDSFCLYLYGIVLRDKGSEALARTVLVESVNSYPWNWSAWLELQSLCTSSDILNNLNLKNYWMKDFFLASAHLELKMHEEALKRYERLMGVFRCSDYIQAQIATVQYSMRDLDEADMIFEELLRTDPFRVDSMDVYSNLLRAVDINPRDYRAWYGLGQIYEMMGMPFYAVYYFRKSSYLQPNDAQLWNAMAQCYESDQLQMIEEAIKCYERSANNNDTEGIALHQLAKLHGMLGQSEEAAFYYKKDLERMEVEERQGQNFVEALLFLAKHCKSIGRFEEAEHYCTRLLDYTGPFK

SEQ ID NO: 18412 - protein, 171 aa, Wilkesia gymnoxiphium
YQAFELIHARWAMLGAAGCIIPEAFNKYGASCGPEAVWFKTGALLLDGNTLNYFGKNIPINLVVAVVAEVVLVGGAEYYRIINGLDLEDKLHPGGPFDPLGLAKDPDQFALLKVKEIKNGRLAMFSMFAFFIQAYVTGQGPVENLASHLSDPFGNNLLTVIYGNIERVPTL

SEQ ID NO: 18413 - protein, 171 aa, Centromadia pungens
YQAFELIHARWAMLGAAGCIIPEAFNKYGASCGPEAVWFKTGALLLDGNTLNYFGKNIPINLVVAVVAEVVLVGGAEYYRITNGLDLEDKLHPGGPFDPLGLAKDPDQFALLKVKEIKNGRLAMFSMFAFFIQAYVTGQGPVENLASHLSDPFGNNLLTVISGNIERVPTL

SEQ ID NO: 18414 - protein, 453 aa, Arabidopsis thaliana
MAVATAPSLNRHFPRRISNLYSRVKQRRPWLPPGDATLFNSRRNWDSHLFVYASSSSSPSSSPPSPNSPTDDLTAELCVNTGLDLFKRGRVKDALVQFETALSLAPNPIESQAAYYNKACCHAYRGEGKKAVDCLRIALRDYNLKFATILNDPDLASFRALPEFKELQEEARLGGEDIGDNFRRDLKLISEVRAPFRGVRKFFYFAFAAAAGISMFFTVPRLVQAIRGGDGAPNLLETTGNAAINIGGIVVMVSLFLWENKKEEEQMVQITRDETLSRLPLRLSTNRVVELVQLRDTVRPVILAGKKETVTLAMQKADRFRTELLRRGVLLVPVVWGERKTPEIEKKGFGASSKAATSLPSIGEDFDTRAQSVVAQSKLKGEIRFKAETVSPGEWERWIRDQQISEGVNPGDDVYIILRLDGRVRRSGRGMPDWAEISKELPPMDDVLSKLER

SEQ ID NO: 18415 - protein, 171 aa, Deinandra lobbii
YQAFELIHARWAMLGAAGCIIPEAFNKYGASCGPEAVWFKTGALLLDGNTLNYFGKNIPINLVVAVVAEVVLVGGAEYYRIINGLDLEDKLHPGGPFDPLGLAKDPDQFALLKVKEIKNGRLAMFSMFAFFIQAYVTGQCPVENLASHLSDPFGNNLLTVISGNIERVPTL

SEQ ID NO: 18416 - protein, 160 aa, Pseudomonas putida
MSAFHDLKLDALNGGELPLAPFKGQVVLVVNVASKCGLTPQYKALENLYQVYKDKGFNVLGLPCNQFAGQEPGSEKEIQDFCSLNYGVSFPLGGKLEVNGPQRHSLYRLLAGEGAEFPGDITWNFEKFLVGKDGRVLARFSPRTAPDDPAVVQAIEKALA

SEQ ID NO: 18417 - protein, 91 aa, Phaseolus vulgaris
  misc_feature (44)..(44): Xaa can be any naturally occurring amino acid
MGAFAEKQEALVNSSFEAFKANIHQYNVVFYTSILEKAAAAKDXFSFLANGVDPSNPKLTGHAEKLFGLLRVSASQLKANGTVVANAALGP

SEQ ID NO: 18418 - protein, 155 aa, Parasponia andersonii
VNKVFTEEQEALVVKAWAVMKKNSAELGLQFLKIFEIAPSAKNLFSYLKDSPVPLEQNPKLKPHATTFVMTTESAVQLRKAGKVTVKESDLKRIGAIHFKTGVVNEHFEVTRFALLETIKEAVPEMWSPEMKNAWGVAYDQLVAAIKFEMKPSST

SEQ ID NO: 18419 - protein, 556 aa, Photobacterium profundum
MTESFALLFEESLQEIETRPGAIVKGTVIAIANGYVLVDAGLKSESSIPVEEFKNAAGELEIEVGAEVDVALDAIEDGFGETKLSREKAKRHEAWIQLEKAYEEAETVVGIINGKVKGGFTVELNGIRAFLPGSLVDVRPVRDTAHLENKELEFKVIKLDQKRNNVVVSRRAVIESENSVERDELLASLQEGMEVKGIVKNLTDYGAFVDLGGVDGLLHITDMAWKRVKHPSEIVNVGDEINVKVLKFDRERTRVSLGLKQLGEDPWVAIAKRYPESTKLSGRVTNLTDYGCFVEIEEGVEGLVHVSEMDWTNKNIHPSKVVNVGDEVEVMVLDIDEERRRISLGLKQCKANPWQSFAEMQAKGDRVTGKIKSITDFGIFIGLDGGIDGLVHLSDISWNVTGEDAVRDFKKGDEISAVVLAVDAERERISLGIKQIEEDPFNSYVADNKKGVLVNGTVTAVDAKGATVELAVGVEGYLRASEASVDRVEDATLVLSVGDSVEAKFTGVDRKNRVVNLSVRAKDVAEEQEAMATLNKQEEASFGNAMADAFKAAKGE

SEQ ID NO: 18420 - protein, 291 aa, Streptococcus pneumoniae
MRNVRVATIQMQCAKDVATNIQTAERLVRQAAEQGAQIILLPELFEHPYFCQERQYDYYQYAQSVAENTAIQHFKVIAKELQVVLPISFYEKDGNVLYNSIAVIDADGEVLGVYRKTHIPDDHYYQEKFYFTPGNTGFKVWNTRYAKIGIGICWDQWFPETARCLALNGAELLFYPTAIGSEPILDTDSCGHWQRTMQGHAAANIVPVIAANRYGLEEVTPSEENGGQSSSLDFYGSSFMTDETGAILERAERQEEAVLLATYNLDKGASERLNWGLFRDRRPEMYRQITD

SEQ ID NO: 18421 - protein, 325 aa, Ostreococcus tauri
MSRSIVDHGVLLVWLGLFHALVVVVVVAIVALERRRAMTVLAALMSLSVVPRRIRPRWGVTLARAITRTAKSYFPCALTFENEEAYLKGARKGVGRLVGLEPHGALPLSVIAFADYFMFDEDGIEARGMNHAASMNSRALASGAIFHVPLVRHLWTWLGLEPISRRRMTSMLSDGSTCVIVPGGVAECMAMERGVETLYLKRRYGFVKIAIQTGAALVPAYTFGQTRAYKYWRLGPPLVPTSVANWFSKTFSFAPMVFWGKWFTPIPYATPLHTVVGELIETTQNDNPSREEVQAKLDEFIVAMRSLYDRHKSAHGYADVDLVVC

SEQ ID NO: 18422 - protein, 209 aa, Ostreococcus tauri
MTICAACGVDDDSHDRADARLLKKTHFRSGQIRVLRDVFHRVAKSDDKIDFKEFQLALYGDAGDEKSSDLFSERIFACFDARGDGTVSFEEFVVGLDVFHPDASVEDKTAFAFRVYDLRGVGAINREDVRKMLEAVLRQSRAMSLTKEMTESVLDKTFEDCDLNKNGTISLSEFQILVKKNDRIIANMTMENLASLTKRYPEFLFADYS

SEQ ID NO: 18423 - protein, 961 aa, Clostridium thermocellum
MTDSPQKRILKRKNRCKGLITAVIIAAQLLTSSILFAEAPPATFTPAENWEDYDYFNFAEALQKSLYFYDAQKCGVEAGYDHGGRLEWRGACHEVDERIPISNTSLSEAFLAKYRHIIDPDGDGTVDVHGGFHDAGDHVRFGLPQSYTAGTLGWGFYEFRESFRAIGEEEHMIEILRYFTDTFLRCSFMDEEGNIVAFCYMVGEGDEDHCYWGPPELYPEEYLRSRPADFATFDDPGSDVCASTAAALCTSYLNFKDEDPEYAEKCLTVAKALYDFAVKYRGLHKGDGYYTSDYDEDELAWAAVWLYECTGDMKYINDIVAVDETGNYVGYMKRIIPDTFKQNVWYNSWVHCWDAVWGGTFIKLNELFPENELFDFIARWNVEYLSGGKCPHEDPNDHNYCKPSPAGYTMINGWGSARYNAAAQLCALVYMKNNPDRTDFGEWAKSQMEYLMGRNPMGYSYIVGYGYEKGLPFAKHPHHRAAHGSKTNSMNDPEEHRHILWGALVGGPDLNDYHIDSTTEYAYNEVAVDYNAAFVGALAGLYKYYGQGHEPIPNFPPLEPETDDYFCEAKIVRETKDSTQVLLRIHNESTRPPHYETGMMARYFFNISELIENGQSIDDVIFTIEYDEQISMQQEPVVYRGPFKWDDAGTYYFEFDWSGRKIYGDRELQISFRVKQDSNYMTHWDSSNDYSRQGLTNEYAISKNVPVYLNGVKVYGEEPPKLSPTPTPTIDPSQTPDANASISVSYKCGVKDGTKNTIRATINIKNTGTTPVNLSDIKVRYWFTSDGNEQNNFVCDYAAFGTDKVKGIVKKIENSVPGADTYCEISFTEDAGRLAPGGSTGTIPFRIEGAAEYDQTDDYSYNSEMSDDFGDNTKITAYIKDKLKYGVEPVTIIDITLGDLNYDGKVNSTDYLVLKRYLLGTIDKESDPNFLKAADLNRDGRVNSTDMSLMKRYLLGIITSF

SEQ ID NO: 18424 - protein, 707 aa, Clostridium thermocellum
MKKIGILVLITALLAGIIPKSALAEEPKFNYVDAFAKSILFYEANWCGPDAGNNRIKWRGPCHIEDGKDVGLDLTGGFHDCGDHVKFGLPQCASASTLAWAYHEFSDVFIEKGQDEYMLNILKHFCDYFMKCYPEKNKFYYQVGDGDVDHQYWGPPELQSYDRPTYYVATPENPGSDVAGDTAAALALMYLNYKDRDLEYAEKCLAYAKDIYEFGMTYRGNSKGQSYYLPRDYLDELMWGSLWLYVATGEQKYMDNLEKLMVEKRIGDEAGNSFNDNWTQCWDYVLTGVFIKLATLTDKPLYKQIAEDHLDYWQNRIKSTPGGLKYLDSWGVCKYPAAESMVQLVYYKYTGDKRCLDFAKSQIDYILGDNPKKMSYVVGFGDNYPKFPHHRAASGRLEGPPADETKNDPQRHILYGALVGGADINDEYYDDIDKYVYSETGLDYNAGLVGALAGMSKYFGQGQMPEDTPGIEGEPPVYYADAKIYEENESGITVDLNMYNIVTSPPQYESDLSCRYFVDLSEYAGENIDMSKFVTKVYYSPAGATISELKPYDKEKNIYYVEISFPNPVYARTYVQFCIYYYENKLWDSSNDFSYQGIGDTYKTLENIPIYKNGVLVAGKEPSGAGPVEPTPPPKNYVYGDVNGDGKVNSTDCSIVKRYLLKNIEDFPYEYGKEAGDVNGDGKVNSTDYSLLKRFVLRNIDKFPVEQ

SEQ ID NO: 18425 - protein, 649 aa, Triticum aestivum
LERHENALLKQENEKLRTENLTMTEAMRTPMCGGCGSPAMLGEVSLEEQHPRGQNARLKDELNRVCTLATKFLGKPVSLLSPLQLQPHLSMPLPNSSLELAVGGIGGIGSMQPSMHGMMSEYAGGASSSMGTVITPARATGPALASMVDIDRSVFLELAISAMDELVKMAQTDDPLWVTGSPGFPDKESLNFEEYLHSSQHCIGMKPVGFVSEASRESGLVIIDNSVALVETLMDERRWSDMFSCMIAKATILEEVSNGIGGSRNGALLLMKAELQVLSPLVPIREVIFLRFCKQLAEGAWAVVDVSIDGLLSNQNSATTSAGANLKCRRLPSGCVMQDTPNGYCKVTWVEHTEYDEASVHQFYRPLLRSGLAFGASRWLATLQRQCECLAILMSSATVSPNEPTAISQEGKRSMLKLARRMTENFCAGVSASSAREWSKLDGATGSIGEDVRVMARKSVSEPGEPPGVVLSAATSVWVPIAPEKLSDFLRDEQLRAEWDILSNGGPMQEMARIAKGHQNGNSVSLLRASAMSANQSSMLILQETCTDASGSIVVYAPVDIPAMQLVMNGGDSTYVALLPSGFAILPDGPSIGSEHKTGGSLLTVAFQILVNSQPTAKLTVESVETVNNLISCTIKKIKTALQCATPEC

SEQ ID NO: 18426 - protein, 627 aa, Legionella pneumophila
MLFQYIKKFFLFLWVQAVSISFLLAMASVSFAQLTAQDHAAHHQGEKESEGMGGMMKNIGTPSKELYPSLMNLPTLSPEKRLAIQQKAHQRITSGMALMKGGLNELLLASNNNDYAKMQEALEKLREGIAQYESALAALRALSEGKNPRDIALQWFKREMNLLPSTPQAKNVLGGPFFHLTIIALFGLFFLVMIWMYFFKMRRAAALLDRLTKQNATVSSETPPQFSKAPEPTPSLTSVEPIKSSQVSKVPSEIAPTTPPTCPAHKCPVPQFPVMRSLTEPEEKWEGQLRVCRIFQEAPGIKTFHLASTHEVALPFTYYPGQFITLTALINGKTVRRSYTMASTPTQLHYCAITVKREEQGVFSRYLHDEIKEGDLLEVMGPNGKFTFTGEEAKSIVLICGGVGITPMMSIIRYLTDIGWHNDIYLLYCCRTTSEFLFREELEQLQERYLNLHVYASMLRSEGTVWMGLQGLFTKNIISHLVPDIASHRIHVCGPPAMMEAILASLKELNVPADLILTEAFGPEKKPEIAQEELEAIKAETRAMISFRKSEKMVPILPDRTLLEIAEANGVTIDNACRTGQCGLCKVKLLSGEVTMACEDALSKEDKQQGLILACQAKATQNIEVDA

SEQ ID NO: 18427 - protein, 142 aa, Triticum aestivum
PGLQALAKFYHQASESYELACTRHISSLIYLQFERLFQFNRKVEELTYTIAAEEIPFQLGLSKTDLRRVLKSSLSGIDKSIGAMYRRLQKTLTSDELFPSLWDKCKKEFLDKYESFVQMVTRIYGNEPIMSVNEMKEVLASF

SEQ ID NO: 18428 - protein, 123 aa, Glycine max
  misc_feature (23)..(23): Xaa can be any naturally occurring amino acid
  misc_feature (45)..(45): Xaa can be any naturally occurring amino acid
  misc_feature (48)..(48): Xaa can be any naturally occurring amino acid
  misc_feature (67)..(67): Xaa can be any naturally occurring amino acid
  misc_feature (81)..(81): Xaa can be any naturally occurring amino acid
  misc_feature (87)..(87): Xaa can be any naturally occurring amino acid
  misc_feature (100)..(100): Xaa can be any naturally occurring amino acid
EARVSLLGTEFIKVATNIDPDCXMIINEKGRNAKCAMRKAFVDEXKSXLPKHILYKEHQQITDRDGXVETDSLKAHAEKPXPDRMIXNAANIFPFNTPTXRETYHYTMIIDRFFPQKSPRLTV

SEQ ID NO: 18429 - protein, 448 aa, Listeria monocytogenes
MAKHRYLPMTEQDEKEMLDVIGVKSIDDLFQDIPEKIRFKRDYDLKPAKSEPALLRELSKLASKNANTTEYASFLGAGVYSHYIPTVVDHVISRSEFYTAYTPYQPEISQGELQAIFEFQTMIAELTGMDLANSSMYDGGTALAEAAMLASGHTKRKKILISGAVHPESSNVLKTYATGQHIEVEVIPELDGKTDIEALKKALSDDIAGFVVQYPNFYGQVEPLAELEKLVHENNSLLLVSSNPLSLGLLTPPGEFGADIVVGDSQVFGIPESFGGPHCGFFAVTNKLMRKVPGRLVGETVDENGKRGYVLTLQAREQHIRRDKATSNICSNQALNALASSVAMATLGKTGLVEMAKQNLDKSHYAKQKFREKGFEVLFSDGFFNEFVVKLSKPIKEVNESLLDEGIIGGYDLGFYEEKYENHMLVAVTEMRTKEEIDAFVASLEGAK

SEQ ID NO: 18430 - protein, 282 aa, Chlamydia trachomatis
MEFPCTLTLKELLESGAHFGHQTSRWNPRMKPFIFEEKNGLYIIDLAKTLAQLKKAVACIQTTIGQEKSILFVGTKKQAKQIIREAAIECGEFFASERWLGGMLTNMATIRNSVKTLNRIELDLEASNSGLTKKELALLAKRHRKLLNNLEGIRHMNSLPGLLIVIDPGYERIAVAEAGKLGIPVMALVDTNCDPTPINHVIPCNDDSMKSIRLIVNVLKDAVIDAKKRLGIGILSPVRPAERPAEEAVEELPLPTGEAQDEASSKEGFLLWADIDNCEALK

SEQ ID NO: 18431 - protein, 482 aa, Listeria monocytogenes
MPLVFERSIPGRIGFSLPESDVPETKASDYFEQAYIRSVPADLPELSELEIMRHYTNLSNHNFGVDSGFYPLGSCTMKYNPKINEKVARFPGFANIHPNQPESSVQGALELLYDLQTSLVEITGMDEVTLQPAAGAHGEWTGLMLIRAFHEKNGDTKRTKVIIPDSAHGTNPASAAVAGFDVVTVKSNEKGLVDVADLKKVVGEDTAALMLTNPNTLGLFEKDIVEMAEIVHEAGGKLYYDGANLNAIMAKVRPGDMGFDVVHLNLHKTFTGPHGGGGPGSGPIGVKKELIPFLPTPVLTKKEEGYTFDYNYPDSIGRVKPYYGNFGINVRAYTYIRTMGPDGLKLVTEYAVLNANYMMRKLQEAYDLPFDQVCKHEFVLSGNRQKKLGVRTVDIAKRLLDHNFHPPTVYFPLIVGEAIMIEPTETESKETLDSFIDTMLKIAKEAEENPEIVQEAPHSTYVKRLDETRAARKPILRYQKEV

SEQ ID NO: 18432 - protein, 318 aa, Zymomonas mobilis
MSADPISTRVFILGSGPAGLTAAIYAARAGLNPIVAQGLQPGGQLTITTEVENFPGFREPIQGPWLMEEMQAQAENVGAKLVWDIITSVDFSQRPYRLMGDGGQVYLADSLIISTGAQARWLGLESETALRGKGISACATCDGFFFRGKKVVVIGGGNTAVEEALYLTNHSPEVTLIHRRDSLRAEKIMQKRLLANPKIKIRWNSEVAEFIAGEDSALSAVKLKDTKTGEESLLETEGAFIAIGHKPATELFQGHLKLDDEGYIEVTPGTTQTSIKGIFACGDVMDKHYRQAVTAAGTGCMAALEAERFLGEIDFKED

SEQ ID NO: 18433 - protein, 306 aa, Vibrio parahaemolyticus
MRYFPLFLDLVNKPVLVVGGGEVASRKVEALLKAGANVTIVSPTLVEFLSRLADEHQIHWVQRFYSSDLVTKRFVQVWATTDNPELNHQVYKNAKELGILVNVVDDKPYCDFITPSMINRGRIQIAISSGGASPVLIRNIREKLEAILPQNMGLMAEFANSKRNSIKEALPSVDLRRKFWEQFFSNPDVENARNNRELETIYQATMANPLDEKGSCTWIHLGKDVEMLPIKAVRYMQQAELALYSTKCESDTMELVRRDAEREAFSNAAELSDKLAKAKKDNLRVCVFIPQGTSEFMLLQGQDLVI

SEQ ID NO: 18434 - protein, 328 aa, Unknown
  Magnetococcus sp. MC-1
MSQPKPMNTIAVMTSGGDAPGMNSAIRAVVRTAIGAEMEVLGIRRGYSGLLEGDLIPMDAASVGNILQKGGTVLGTSRCAEFLKPEIRQEAANILRRKHVDGLVVIGGNGSFNGAYQLHQEHDIPVVGVPGTIDNDIQGTHYTIGFDTAVETGVYAVDKIRDTANAHDRIFLVEVMGRHSPAIAIHTGVCTGAEHVIHTPENTDYDTLVSGIRRGRKRGKNSFIIIVAEGQVPGSAYQVQKHLADNYQIASHVAILGHLQRGGSPTAHDRFIAASMGFHAVQALKTGEVATVTACRDGRIQLVPLQECLEKNDAIDAFSLNLTQQLAI

SEQ ID NO: 18435 - protein, 282 aa, Chlamydia trachomatis
MEFPCTLTLKELLESGAHFGHQTSRWNPKMKPFIFEEKNGLYIIDLAKTLGQLKKAVSCIQKIIEQERSILFVGTKKQAKQIIREVAIECGEFFASERWLGGMLTNMATIRNSVKTLNRIELDLEASNSGLTKKEIALLAKRHRKLLNNLEGVRHMNSLPGLLIVIDPGYERIAVAEAGKLGIPVMALVDTNCDPTPINHVIPCNDDSIKSIRLVVNVLKDAVIDAKKRSGIEILSPVRPVERPAEEAVEELPLPTGEAQDEASSKEGFLLWADIDNCGALK

SEQ ID NO: 18436 - protein, 957 aa, Thermobifida fusca
MSDRSVSRPPALTFPDRHIGPDPAERAAMLETVGYASTADLMTAALPADILTAPDAPAPLRLPEPVGEAEVLAELRALAARNRLLVSMIGQGYYGTVTPPVIRRNILENPAWYTAYTPYQPEISQGRLEALLNFQTMVADLTGLPIAGASLLDEATAAAEAMTLARRVDKGKRSVFVVDADVFGHTLAVLRTRAEPLGIDLVVADLSAGLPDVDAFGVLVQYPAASGQVRDLRPVVDAAHERGALVVVAADLLALTVLRSPGEFGADVAVGSTQRFGVPMGFGGPHAAYMAVRDGLQRQLPGRLVGVSVDAAGKPAYRLALQTREQHIRREKATSNICTAQVLLAVMAGMYAVYHGPHGLRAIAERVHRRTAELAAGLRKLGVEVLTDAFFDTLRVRVPSRAAAVVRTARDLGINLFFADEDTVGVSCDETTTSEHVAAVLRAFGATTPPQTGDVPSALPEGLRRDVDYLTHPVFHTYRSETAMLRYLRRLADRDLALDRTMIPLGSCTMKLNATAEMEAITWPEFAELHPFAPLDQAEGLVQIVRDLETWLAEITGYDAVSLQPNAGSQGEFAGLLAIRGYHRSRGEEQRDICLIPSSAHGTNAASAVMAGMRVSVVACDSGGNIDLADLRAKIDAAGDRLAALMVTYPSTHGVYEETIAEVCRLVHEAGGQVYVDGANLNALVGWAKPGKFGADVSHLNLHKTFCIPHGGGGPGVGPVAVRAHLAPFLPNHPAHTEAGPHTSAGPVAAAPFGSASILPISWAYIRLMGEEGLRAATEQAVLAANYVARRLAPYYPVLYMGRNGLVAHECIIDLRGLQKRTGISNEDVAKRLIDYGFHAPTMSFPVPGTLMIEPTESEDLAELDRFIDAMIAIRGEIDRVAEGSYDRADNPLKNAPHTAEEVTADEWKHAYSRSEAAYPVPSLRASKYWAPVGRIDQAYGDRNLVCACPPPEAFAQ

SEQ ID NO: 18437 - protein, 467 aa, Pasteurella multocida
MTKVASIVDVLQGKIAIGETVTVRGWIRTRRDSKAGLSFLAIYDGSCFDPIQAIVNNDIENYETEVLRLTTGCSVIVTGTVVESPAEGQAVELQAEKVEVAGWVEDPETYPMAAKRHSIEYLREVAHLRPRTNIIGAVARVRHCLAQAIHRFFHEQGFYWVATPLITASDTEGAGEMFRVSTLDLENLPRDDKGAVDFSQDFFGKESFLTVSGQLNGETYACALSKIYTFGPTFRAENSNTTRHLAEFWMVEPEIAFATLADNAKLAEDMLKYVFRAVLEERKDDLKFFEKHVDNDVISRLENFINSDFAQIDYTDAIEVLLQSGKKFEFPVSWGIDLSSEHERYLAEEHFKSPVVVKNYPKDIKAFYMRLNDDGKTVAAMDVLAPGIGEIIGGSQREERLDVLDKRMIEMGLNPEDYWWYRDLRRYGTVPHAGFGLGFERLIVYVTGVQNIRDVIPFPRSPRNANF

SEQ ID NO: 18438 - protein, 171 aa, Carlquistia muirii
YQAFELIHARWAMLGAAGCIIPEAFNKYGASCGPEAVWFKTGALLLDGNTLNYFGKNIPINLVVAVVAEVVLVGGAEYYRIINGLDLEDKLHPGGPFDPLGLAKDPDQFALLKVKEIKNGRLAMFSMFAFFIQAYVAGQGPVENLASHLSDPFGNNLLTVISGNIERVPTL

SEQ ID NO: 18439 - protein, 231 aa, Oryza sativa
MQQQQLCSSHCLPARAGSIASPGSGRRVVPLGRRRASLGKVTAYAYPTTRRVVDAAKSSLLQDVHVAASNPSLQLLQDYAPAKKSAKQQNGSRTKDGFYEVEMTVHDDELDEYGVVNNAIYASYIHSGRDVFLENVGVGVDYWTSTGNALALSELNLKFYTPLRKDDRFVVRMKVVKIKGVRIIVEHLIETLPDRKLVVDAKATAVCLDNKYRPTRVFPELSTKLHQFFLS

SEQ ID NO: 18440 - protein, 572 aa, Agrobacterium tumefaciens
MHSGDFMSVSTPTRDDFAALLEESFASNDLAEGYVAKGIVTAIEKDVAIVDVGLKVEGRVPLKEFGAKSKDGTLKVGDEVEVYVERIENALGEAVLSREKARREESWVKLEAKFEAGERVEGVIFNQVKGGFTVDLDGAVAFLPRSQVDIRPIRDVTPLMHNPQPFEILKMDKRRGNIVVSRRTVLEESRAEQRSEIVQNLEEGQVVDGVVKNITDYGAFVDLGGIDGLLHVTDMAWRRVNHPSEILNIGQQVKVQIIRINQETHRISLGMKQLESDPWDGISAKYPVGKKISGTVTNITDYGAFVELEPGIEGLIHISEMSWTKKNVHPGKILSTSQEVDVVVLEVDPSKRRISLGLKQTLENPWQAFAFSHPAGTEVEGEVKNKTEFGLFIGLEGDVDGMVHLSDLDWNRPGEQVIEEFNKGDVVKAVVLDVDVEKERISLGIKQLGKDAVGEAATSGDLRKNAVVSCEVIAVNDGGVEVKLVNHEDITSFIRRNDLARDRDDQRPERFAVGQVFDARVVNFSKKDRKVMLSIKALEIAEEKEAVAQFGSSDSGASLGDILGAALKNRGE

SEQ ID NO: 18441 - protein, 514 aa, Bdellovibrio bacteriovorus
MRNLRPFPSIPRLCREVAPILDCKGTKGFCARLLDKHAKERYFNRTVERVPMKTTLVKSLFRETEKHLDKEVYLSGWVRKIRDQKNFGFIELNDGTFFKGVQVVFDNNLANFADVAALSISSSVLVTGKVVKSQGAGQSFEVMASKIEIVQKADLEYPLQNKRHSMEFLREIAHLRPRTNTFSAVFRVRSVLAYAIHKFFNEQNFVYVNTPIITGSDAEGAGEMFRVTTLKLDKPPRKEDGSIDASQDFFGKETNLTVSGQLNGETFCAAFRNIYTFGPTFRAENSNTSRHAAEFWMIEPEIAFADLTANMELAEDMIKYIIRYVMEQCPEEMEFFNQFVEKGLFDKLNNVLNNNFGRVTYTEAIDILLKCGKKFEYPVQWGIDMQSEHERYLAEEHFKKPVFVTDYPKDIKAFYMKLNEDGKTVRAMDLLAPGIGEIIGGSQREDNLEKLESRMKQVGLHPEEYSFYTDLRRYGTFPHAGYGLGFERMLMYVTGMGNIRDVIPFPRTPKNALF

SEQ ID NO: 18442 - protein, 319 aa, Geobacillus stearothermophilus
MKRIGVLTSGGDSPGMNAAIRSVVRKAIYHGVEVYGVYHGYAGLIAGNIKKLEVGDVGDIIHRGGTILYTARCPEFKTEEGQKKGIEQLKKHGIQGLVVIGGDGSYQGAKKLTEHGFPCVGVPGTIDNDIPGTDFTIGFDTALNTVIDAIDKIRDTATSHERTYVIEVMGRHAGDIALWSGLAGGAETILIPEADYDMNDVIARLKRGHERGKKHSIIIVAEGVGSGVDFGRQIQEATGFETRVTVLGHVQRGGSPTAFDRVLASRLGARAVELLLEGKGGRCVGIQNNQLVDHDIAEALANKHTIDQRMYALSKELSI

SEQ ID NO: 18443 - protein, 174 aa, Borrelia miyamotoi
MNYEISTLFTEEKIRNKIQKLAQKIRNYYKDKNNVVFISILKGSFMFFADITREIGLNVKIDFLHVSSYNNKTHSSSKVLIKKDIDVNIENSYVILFDDIIDTGLTYKKIIEHLKSKNPKEIKICTLFNKPSRRLTKLKIDYIGFEIANYFVVGYGIDFNEKHRTLKNVAKINK

SEQ ID NO: 18444 - protein, 200 aa, Bdellovibrio bacteriovorus
MKHLFMFFAVLGMFVGLNSEAKTTKAAKKGNTVSTSEVAYLAGGCFWGMEDLLRKLPGVTQTEVGYMGGDTKNANYNIVKTGTTNHAETVKITFNPEKITYQDLLLYFYKIHDPTTTNRQGNDIGTQYRSAIFYTSDKQRDEAEIVRARVDKSGAWKSPVVTQIVKAADFWSAEEYHQDYLQKNPGGYTCHFERKIEFKD

SEQ ID NO: 18445 - protein, 376 aa, Streptococcus pneumoniae
MNNRSETMKYKRIVFKVGTSSLTNEDGSLSRSKVKDITQQLAMLHEAGHELILVSSGAIAAGFGALGFKKRPTKIADKQASAAVGQGLLLEEYTTNLLLRQIVSAQILLTQDDFVDKRRYKNAHQALSVLLNRGAIPIINENDSVVIDELKVGDNDTLSAQVAAMVQADLLVFLTDVDGLYTGNPNSDPRAKRLERIETINREIIDMAGGAGSSNGTGGMLTKIKAATIATESGVPVYICSSLKSDSMIEAAEETEDGSYFVAQEKGLRTQKQWLAFYAQSQGSIWVDKGAAEALSQHGKSLLLSGIVEAEGVFSYGDIVTVFDKESGKSLGKGRVQFGASALEDILRSQKAKGVLIYRDDWISITPEIQLLFTEF

SEQ ID NO: 18446 - protein, 1129 aa, Burkholderia vietnamiensis
MPAELKRIASQVANAGRKPFEPGRARRYQQLLLYGGGFAVTLFILMCALLVTRLDVQDYRAQARLTFLYRKAQFSRTLEMADMVLATYGGRIEQLWNQGARPSADALAQFSAAGGVLGASNGDGSETLLALARLTPDRPAPSYARYLGALFGLVRQDDRSGHVLPPALVSGGEPLGGYLIGLDAPFLAVLGTELVPRAHTLEPGTDLHTLIDGLMPTGIARQKTLMQSRPFVFDRRLDPLSGRVVMRFARRLDDAAGRPFGWLVINGLHRVDDVMAPRSDDEDVAIVDARHDIVFGRERDRSMIERALHDARAPLGDHVAVRRVGARFVVYDRLPGTGLVMMTSFSWRSMVREMRVGLGITFGAALLGIVLLWSAIVLFDRRALRPAHRRAIRLIESEAFNRTLARHAPAGLLLLSAADGETMVHNDAVRAYDGGAGGQRLGKRIWDAYRERAAAGDGRLDVMQHELAVEQADHGKVYLALQVVRTMFHGVDVLLCTLTDVTARKLTEDKLKEARTAAEDANKAKSTFLATMSHEIRTPLNAIVGNLELMARAQLPLAERRRLQTVMSSSDALLHTINDVLDLSKAESNQMALEAVPFDLRAVLHEVAAIFRALADAKHLRLECVIAAGLGDGYVGDPARVRQIVSNLVSNAIKFTEHGRVTVEALPAAVPGRGVEIVVRDTGIGIEPDSMPTLFDVYVQTDASIYRRFGGTGLGLPLCRRLARLMGGDVTVESRPGAGAVFTASLPLADAPLRGRAAVDARASGAKGAGARRAEVAGAEATEAEVTGADAARVDGTGADGTGATGTEAEAADAKATGTEAPGASGTEAKRTGADAMAAATRAAATPTNATSRPAATPKPIETHARTSALSPVQPPAPACSADGETPLRVLVAEDHPASRALLRDQLDALHCDATLVSNGIEAMRAFFAQPFDVVLTDLGMPELDGFALANCLREQGAKVPVIAMTAHATDEDRRRCAQAGAVEVVLKPLSIDALDAVLTRHARHAAAARSSTADSTDSADSDDRPIPPMTDEIRENLRTATLLSLALIDDALPRGDVERIRVELHSMRGGFALAGDTVAGAACAHAERIFSQGRTAALRAAWPACRAAIERSAERLRAAGSGAGSEPA

SEQ ID NO: 18447 - protein, 420 aa, Streptococcus pneumoniae
MVSRQEQFEQVQAVKKSINTASEEVKNQALLAMADHLVAATEEILAANALDMAAAKGKISDVMLDRLYLDADRIEAMARGIREVVALPDPIGEVLETSQLENGLVITKKRVAMGVIGIIYESRPNVTSDAAALTLKSGNAVVLRSGKDAYQTTHAIVTALKKGLETTTIHPNVIQLVEDTSRESSYAMMKAKGYLDLLIPRGGAGLINAVVENAIVPVIETGTGIVHVYVDKDADEDKALSIINNAKTSRPSVCNAMEVLLVHENKAASILPRLDQMLVAERKEAGLEPIQFRLDSKASQFVSGQAAETQDFDTEFLDYVLAVKVVSSLEEAVAHIESHSTHHSDAIVTENAEAAAYFTDQVDSAAVYVNASTRFTDGGQFGLGCEMGISTQKLHARGPMGLKELTSYKYVVAGDGQIRE

SEQ ID NO: 18448 - protein, 84 aa, Hyacinthus orientalis
PRAAAGRCLPCPRCKSKETKFCYFNNYNVNQPRHFCRNCHRYWTAGGTLRRVPVGAGRRKNRTPPPCGADGVGEADQAVWPAGS

SEQ ID NO: 18449 - protein, 742 aa, Unknown
  Rhodococcus sp. RHA1
MSDSCPVAHEGNTQSTSESENPVIPSPTPAANRPRNNRDWWPNQPELSVLHAHTSKSNPMGEDFDYAEEFAKLDVEALKRDVIDLMTTSQDWWPADYGHYGGLFIRMSWHAAGTYRIADGRGGGGQGAQRFAPLNSWPDNANLDKARRLLWPVKQKYGKQISWADLLVFAGNCALESMGFKTFGFGFGREDIWEPEEMYWGPEDTWLGDERYSGDRELSGPLGAVQMGLIYVNPEGPNGQPDPLAAARDIRETFSRMAMNDVETAALIAGGHTFGKTHGAGDADLVGPEPEGAPIEQQGLGWKSAYGTGVGKDAITSGLEVVWTPTPTKWDNSFLEVLYGYEWELTKSPAGAWQWTAKDGAGAGTIPDPFDSSAGRAPTMLTTDLSLRIDPAYEKITRRWLDHPEEFAEEFAKAWYKLLHRDMGPVTRYLGPWVPEAQLWQDPVPAVDHQLIGDSEIAALKGKILDSGLSIPQLVSTAWASAATHRSTDMRGGANGARIRLAPQKDWEINSPAELSTILQTLEQIQQDFNSSQSGGVKVSLADVIVLAGAAAVEKAAKNAGHDVTVPFTPGRTDATQEQTDVESFAVLEPKADGFRNYLRAGEKLPAEALLVDRAYMLNLTAPEMTVLVGGLRALNANFGQTKHGVFTDRPEALTNDFFVNLLDMGTEWKGASSAENVYEGTDRVTGAAKWTATAVDLVFGSNSQLRALAEVYAADDAQQKFVQDFVSAWNKVMNLDRFDLD

SEQ ID NO: 18450 - protein, 338 aa, Burkholderia vietnamiensis
MNLQRFPRYPLTFGPTPIQPLKRLSAHLGGKVELYAKREDCNSGLAFGGNKTRKLEYLIPDALAQGADTLVSIGGVQSNQTRQVAAVAAHLGMKCVLVQEHWVNYDDPVYDRVGNIQLSRMMGADVRLVADGFDIGIRRSWEDAMESVRQAGGKPYPIPAGCSEHPLGGLGFVGFAEEVREQEAQLGFRFDYVVVCSVTGSTQAGMVVGFAADGRADRVIGIDASATPERTREQITRIARHTAELVELGRPIADADVVLDTRYAGPEYGLPNDGTLEAIRLCARLEGVLTDPVYEGKSMHGMIDMVRRGEFEPGSKVLYAHLGGVPALSAYAEIFRDG

SEQ ID NO: 18451 - protein, 254 aa, Legionella pneumophila
MNNVSMRELLEAGAHFGHRTRFWNPKMSEYIFGSRNKIHIINLEKTLPMLNDVTNYVSRLAANKAKILFVGTKRAAQDSIREHAKRCGMPYVDHRWLGGMLTNYKTVRQSIFRLKELKEMKEKGLFNDMIKKEALMLTRELEKLERSLGGIENMGGLPDALFVVDVGFEHIAVEEARRLRIPVIGVVDTNNSPDNIDYVIPGNDDSMRAVDIYVRCVADAILDGKNSNTVGRVSSDSEFVEVTSNSNEEEKSGE

SEQ ID NO: 18452 - protein, 401 aa, Magnaporthe grisea
MAEGSGIDRKAEERMEFTTSKEVTVHPTFESMALKESLLRGIYAYGYESPSAVQSRAIVQVCKGRDTIAQAQSGTGKTATFSISMLQVIDTAVRETQALVLSPTRELATQIQSVVMALGDYMNVQCHACIGGTNVGEDIRKLDYGQHIVSGTPGRVADMIRRRHLRTRHIKMLVLDEADELLNQGFREQIYDVYRYLPPATQVVVVSATLPYDVLDMTTKFMTDPVRILVKRDELTLEGLKQYFIAIEKEDWKFDTLCDLYDTLTITQAVIFCNTRRKVDWLTDKMREANFTVSSMHGDMPQKERDSIMQDFRQGNSRVLISTDVWARGIDVQQVSLVINYDLPSNRENYIHRIGRSGRFGRKGVAINFVTSEDVRILRDIELYYSTQIDEMPMNVADLIA

SEQ ID NO: 18453 - protein, 432 aa, Legionella pneumophila
MEECMYLDALSRLDKAASFCRIDSEALEKLKHPKSCLEVSLPVRMDNGELKIFPAYRVHHNDSRGPMKGGIRYHPKLDLDEIKTLALWMTIKCAVADIPFGGAKGGVIVDPKQLSRMELERLSRSYIELIADFIGPDKDIPAPDMYTNEMIMGWMMDEYATIVRKNSPAVITGKPISLGGCLGREGATGLGAYYCIKILEKKKKWQSSELRVAVQGFGNAGQSIAKLLYDNGYKIVAISDSKGGIYNTKGIDIPRMIEIKNSSKDVQSIYCKESVCKLAKEATITNEELLELDVDLLIPAAAQNQITQENAARIKAPIIIEIANGPITLEADALLQKKGLLIVPDILANTGGVIVSYFEWVQNKSGYYWSLEKVQEELQTIISREFGNIWQLMEQYQTDMRQAAYVHALNRYDKAVTAQGTRGYFSNLSLSL

SEQ ID NO: 18454 - protein, 527 aa, Prochlorococcus marinus
MNGDLNSWDKFCNYLWFDKKLNIWLDISKINFTSKEINNLEDKFVDVFSSMKELENGAISNIDENRQVGHYWLRNPSISPSSKIAEEIRADINAISEFGKQILNGDIKNKNNKQYTDVLWIGIGGSGLGPLLITESLQKCSRGLNFSYIDNVDPFLISEKLEELSEKLSTTLFVVVSKSGGTPEPRIAMEIIKSHCEKNSLEWNSNAIAITMKDSKLFKKATSEYWLKIFNLQDWVGGRTSITSSVGLLPLALINENISEFIKGASLMDEATRISDFKNNPAALLSSAWYLTGDGTGKRDMVVLPYRDRLQVFSKYLQQLVMESLGKKFNRNGEVVNQGISVFGNKGSTDQHAYVQQLRDGIDNFFCIFIELLDTPSTNIFDDKENPKEYLSGFLQGTRSALSSENRQSITITLEKLNCFSLGALIALFERAVSFYAELVNINAYDQPGVEAGKKAAANIIEYQQKVSNLLDAGGEYSINDITSLFDNSVSESIFFILREMCFGNDNYLVKGDWSNPNSLVIQKLNS

SEQ ID NO: 18455 - protein, 378 aa, Clostridium thermocellum
MSVLIFGIIIEKPTVIDTVDIEFGKEYVDNLSKIIDPENIEYIVINHVEPDHAGALPALAAKAKNAKIVTTKLASELLKDMFKLHNREFAIIKDGDTLDIGGKTLSFFETPYLHTEETMITYVNENKILFPCDIFSTHIANYELFNDLAKGEYIEDFKVYYRLIMAPHRPYVRDMLEKIKKLNIEVIAPSHGYILRENTAKFIQMYDEMSSLAALKQPKKVTIVYSTMTGNTAKIAQKLVQGLESAGVETSVFNLKNSDLAEVRKKITESDGILVGSSTRYADMVGNVEELLKLLEGEEVKNKFAAAFGSYGWSGEAIMHIENYLDKIGFNVINQKYLIGSAGIDIPLFPLRIKFARQEGLELAEEAGRVFGEQVLTH

SEQ ID NO: 18456 - protein, 426 aa, Triticum aestivum
MAPEPEDDIMAEKNPRPLDEDDIALLKTYGLGPYSTSIKTAEKEIKELAKRINDLCGIKESDTGLAPPSQWDLVSDKQMMQEEQPLQVARCTKIINPNTDDAKYMINVKQIAKFVVGLGDKVSPTDIEEGMRVGVDRNKYQIQIPLPPKIDPSVTMMTVEEKPDVTYNDVGGCKEQIEKMREVVELPMLHPEKFVKLGIDPPKGVLCYGPPGTGKTLLARAVANRTDACFIRVIGSELVQKYVGEGARMVRELFQMARSKKACIIFFDEVDAIGGARFDDGAGGDNEVQRTMLEIVNQLDGFDARGNIKVLMATNRPDTLDPALLRPGRLDRKVEFGLPDLEGRTQIFKIHTRTMNCERDIRFELLARLCPNATGADIRSVCTEAGMYAIRARRKTVTEKDFLDSVNKVIKGYQKFSATPKYMVYN

SEQ ID NO: 18457 - protein, 135 aa, Volvox carteri
MARTKQTARKSTGGKAPRKQLATKAARKTPATGGVKKPHRYRPGTVALREIRKYQKSTELLIRKLPFQRLVREIAQDFKTDLRFQSQAVLALQEAAEAYLVGLFEDTNLCAIHAKRVTIMPKDIQLARRIRGERA

SEQ ID NO: 18458 - protein, 153 aa, Oryza sativa
GAFLKNAPGGSFDAVFGDSFDPIGPAQELFGKPFFQSVARALGPGGVVCPPAGGIGLHMHIFEDFVGNCPQVFKGSGNYVWAPVPTSPRGVIGFMLCPPGGPPVDFPPPFFTLGGKGFSPKWKGPLKFSNSGIPSASFCFPFFGKGVIGSKAH

SEQ ID NO: 18459 - protein, 282 aa, Chlamydia trachomatis
MELPCKLTLKELLESGAHFGHQTSRWNPKMKPFIFEEKNGLYIIDLAKTLGQLKKAVSCIQKTIEQERSILFVGTKKQAKQIIREAAIECGEFFASERWLGGMLTNMATIRNSVKTLNRIELDLEASNSGLTKKEIALLTKRHRKLLNNLEGVRHMNSLPGLLIVIDPGYERIAVAEAGKLGIPVMALVDTNCDPTPINHVIPCNDDSIKSIRLVVNVLKDAVIDAKKRSGIEILSPVRPVERPAEEAVEELPLPTGEAQDEASSKEGFLLWADIDNCGALK

SEQ ID NO: 18460 - protein, 112 aa, Bifidobacterium longum
MKLITAIIQPHKLDDVKEALAAAGVHGLTVSEANGYGRQRGHTEVYRGAEYTVDLIPKIRVEVLSDDADAETLVGVIIKSAGTGTIGDGKVWVAPLDSVARVRTGETGSAAI

SEQ ID NO: 18461 - protein, 282 aa, Chlamydia trachomatis
MELPCKLTLKELLESGAHFGHQTSRWNPKMKPFIFEEKNGLYIIDLAKTLGQLKKAVSCIQKIIEQERSILFVGTKKQAKQIIREAAIECGEFFASERWLGGMLTNMATIRNSVKTLNRIELDLEASNSGLTKKEIALLAKRHRKLLNNLEGVRHMNSLPGLLIVIDPGYERIAVAEAGKLGIPVMALVDTNCDPTPINHVIPCNDDSIKSIRLVVNVLKDAVIDAKKRSGIEILSPVRPVERPAEEAVEELHLPTGEAQDEASSKEGFLLWADIDNCGALK

SEQ ID NO: 18462 - protein, 938 aa, Pneumocystis carinii
MILKILLTLTLYWIYLVRVRCETVPVDFENNDYYHFHFSEEVDIEDFSRALGFKYHEKLEYLDNQHIFSIEKGVLEDEIKEKIENYFGLEKGRNAIDGFNSDKLFYYEKQKLVKRENRGAIRDDIYFDNEGLYNRRVVKNVVKDPTVDQAKKSTEDLKKRLKEIKGELNIEDRYFDKQWYLFNTKDPGVDINVTGLWLEGITGKGVTVAIVDNGVDYTNLDLAPNFNAEASLNFATGTFDVKPEYTYNNHGTRCAGEVAAARNTLCGIGVAYESNISGLRYVPSAHSSWNEGDALIYKYDVNYIYSCSWGPADTGNLIQDISYTSYSAIIKGINEGRNGLGSIYVFGSGNGGYFDDCNYDGYANSPYTITIAAIDAEEKRFRFSEPCPCILASTYSGKSGAYIYTTDVGTTECTFLHTGTSASTPLAAGVIALLLSACPNLTWRDVQALIVETAVPFNLEYPGWEQVHSKRYYNNYFGYGKLDAYRMVERAKTFQKLNPQTMFSTQLIPLNKKFSENGGHITSSFYIHRGYPTHYNFKSLEYVGVSFRYKHQRRGHLEFNITSPSGVTSVLAHRRNPDKHGGSILWTFMTVKHWGEPIVGNWTIDVEDKKDQNLDGEVFYWQLHFFGESSKSEGVPPASYPFLSIYPTTMPPPEPTTTLPPTPSSTSSSRPPPPAPQPQPQPQPQPDPGSLPSSDPESPPSSEPGSQPPSKPGPQPPSDPQPPSKPGPQPPSEPAPPSKPAPPSKPAPPSKPDPNPSSDPSSQKDPDTSLSSNPTSTSSSEPPPPSPPPPPPPPPAPAPAPPPPPPPPPPRPELEPEPEPVPQPPQPQPPQPQPEPPAPPPKPQPPQPPPPPPPPEQKPTSITSSTSTTSSSKTKISTTRKASSTKTSSTTKTSTRPSPTEGTFTGSSASHLSFFEKRHLLLQMILLLLFFLFLGYSF

SEQ ID NO: 18463 - protein, 340 aa, Sambucus nigra
MVAALVLIGLLMPTLQIAGAQSVGVCYGQKGNNLPSQRDVVNLYKKYGIRRMRVYDPAEPILQALRGKSIEIILDVPNSDLQNLASNPSAAVTWVQNNIRNYSRDVRFRYIAVGNEVDPYNENVQYISFVLPTMRNVHDAIVAAGLQGQIKVSTATYTGVLIVTSPPSAGLYRPNVRSFIDPIINFLVQNNLPLLVNVYPHIAITGNSDIQLPYALFTAPGVVVTDSDRNLEYRNLFVAILDAHYAALEKAGGPNVEIVVSESGWPTQGHPVATIDNAKTYNNNLIRHVKGRSGTPRRPGRDIETYIFAMFDETQKPSDMARHFGLFSPNQKLIYPISFK

SEQ ID NO: 18464 - protein, 73 aa, Rubrobacter xylanophilus
MAKEDVIEVEGTVTEALPNTQFRVELDNGHNVLAHISGKMRMNYIRILPGDRVKVELSPYDLSRGRITYRYRS

SEQ ID NO: 18465 - protein, 236 aa, Triticum aestivum
MTRRYWNINLKEMIEAGVHFGHGIKKWNPKMAPYISAKRKGTHIINLARTARFLSEACDLVFDAASQGKSFLIVGTKKRATDLVASAAIRARCHYVNKKWFSGMLTNWSITKTRLSQFRDLRAEEKMGKFHHLPKRDVAILKRKLSTLQRYLGGIKYMTRLPDIVIVLDQQKEYIALRECAILGIPTISLVDTNCDPDLANISIPANDDTMTSIRLILNKLVFSICEGRSLYIRNR

SEQ ID NO: 18466 - protein, 1029 aa, Oryza sativa
  misc_feature (473)..(473): Xaa can be any naturally occurring amino acid
MHLRLLLLLVGVAAAAADADADADALLAAKAAMSDPTGALASWGGNGTRTNTTAAAAAHCAWAGVTCSSRGAVVGLDVSGLNLSGALPAELTGLRGLMRLSVGANAFSGPIPASLGRLQFLTYLNLSNNAFNGSFPAGLARLRGLRVLDLYNNNLTSPLPMEVVQMPLLRHLHLGGNFFSGEIPPEYGRWGRMQYLAVSGNELSGKIPPELGNLTSLRELYIGYYNSYSGGLPPELGNLTELVRLDAANCGLSGEIPPELGKLQNLDTLFLQVNSLAGGIPSELGYLKSLSSLDLSNNVLTGEIPASFSELKNLTLLNLFRNKLRGDIPDFVGDLPSLEVLQLWENNFTGGVPRRLGRNGRLQLLDLSSNRLTGTLPPELCAGGKMHTLIALGNFLFGAIPDSLGECKSLSRVRLGENYLNGSIPKGLFELPKLTQVELQDNLLTGNFPAVSGAAAPNLGEISLSNNQLTGAXPASIGNFSGVQKLLLDRNSFSGVVPPEIGRLQKLSKADLSSNALEGGVPPEIGKCRLLTYLDLSRNNISGKIPPAISGMRILNYLNLSRNHLDGEIPPSIATMQSLTAVDFSYNNLSGLVPGTGQFSYFNATSFVGNPGLCGPYLGPCRPGVAGTDHGGHGHGGLSNGVKLLIVLGLLACSIAFAVGAILKARSLKKASEARVWKLTAFQRLDFTCDDVLDCLKEENIIGKGGAGIVYKGAMPNGDHVAVKRLPAMGRGSSHDHGFSAEIQTLGRIRHRHIVRLLGFCSNNETNLLVYEYMPNGSLGELLHGKKGGHLHWDTRYKIAIEAAKGLCYLHHDCSPLILHRDVKSNNILLDSDFEAHVADFGLAKFLQDTGASECMSAIAGSYGYIAPEYAYTLKVDEKSDVYSFGVVLLELVTGRKPVGEFGDGVDIVQWVRMMTDSNKEQVMKVLDPRLSTVPLHEVMHVFYVALLCIEEQSVQRPTMREVVQILSELPKLAPRQGEVLSHAVDGFASNPPAPVPSGSAEALTGDAKDQQQQQTNSESTTPPDLISI

SEQ ID NO: 18467 - protein, 225 aa, Arabidopsis thaliana
MILFGSVVTCSLHQIDEQCFFIMPTLYKKAGCQFQLTTMENNNGNNQLPPKGNEQLKSFWSKEMEGNLDFKNHDLPITRIKKIMKYDPDVTMIASEAPILLSKACEMFIMDLTMRSWLHAQESKRVTLQKSNVDAAVAQTVIFDFLLDDDIEVKRESVAAAADPVAMPPIDDGELPPGMVIGTPVCCSLGIHQPQPQMQAWPGAWTSVSGEEEEARGKKGGDDGN

SEQ ID NO: 18468 - protein, 293 aa, Zea mays
  misc_feature (82)..(82): Xaa can be any naturally occurring amino acid
MATGSEASKAAEAVVDWHKHDSKRMLHAVYRVGDLDRTIKYYTECFGMKLLRKRDVPDEKYTNAFLGFGPENTNFAVELKKXTYNYGVDKYDIGTGFGHFAIANDDVYKLAENIKSKGGKITREPGPVKGGSTVIAFAQDPDGYMFELIQRADTPEPLCQVMLRVGDLERSIKFYEKALGMKLLRKKDVPDYKYTIAMLGYADEDKTTVLELTYNYGVTEYSKGNAYAQVAIGTNDVYKSAEAVDLATKELGGKILRQPGPLPGINTKIASFVDPDGWKVVLVDNTDFLKELH

SEQ ID NO: 18469 - protein, 356 aa, Treponema pallidum
MASIAILGGGAWGTALAASLTVNGHTVMLWARRRQTCDAINARNENVQYLPGITLPAALCASPDMAYVCAGADLIVLAVPSCYLAEVAALMNTTPRFQRLRTAAVGQEYPLIGILTKGFIPDQEGMPHLITDALGALLPSGAHGQLVYISGPSHAQEVAQGKVTGLIAASQNPMAAIRVRELLRSKRVQVYSSLDVVGVQVCAAVKNVIAIAFGLLDAMAEHSEAFGDNTESMLLAAGLNEIQTIGKQLGSTHPETFTSLAGIGDLDVTCRSAYGRNRRFGRDIVHKGILDSFSGIQDLVSRLPEVGYLAEGVVACMHVQRLAERDRLKVPICAGLYAILNREKGADTFMQEILGW

SEQ ID NO: 18470 - protein, 306 aa, Vibrio vulnificus
MRYFPLFMDLENKPVLVVGGGEVASRKIEALLNVGAKVTIVSPTLVDELHRWVEENRCYWVKNFYSSELMDGAYVQVWATTNNPSLNHQVYRDAKQRNLLVNVVDDKPYCDFITPSMISRGRVQIAISSGGASPVLIRNLRESLEAVLPQNLSLLAEFAESKRVAVKERFPTVEERRMFWELFFDLPEVKSSQNHRELETLFAQAIKGEVQRTAQCTWIGCTEDVELLPIKALRYMQKAELVLAPEQIHPAFLEMVRRDAQRLSYETPAQLSEKIHQAKLEPIKICVLFAKNSQEFSFLQQGDLII

SEQ ID NO: 18471 - protein, 150 aa, Medicago truncatula
MATTPALYGTAVSTSFLRRQPMPVSISTTTKAFPSGFGLKSKTGKRGDLAVAMATYKVKLVTPEGTQEFDCPSDVYILDHAEEVGIDLPYSCRAGSCSSCAGKVAAGAVDQSDGSFLDDDQIEEGWVLTCVAYPTSDVTIETHKEEELTA

SEQ ID NO: 18472 - protein, 217 aa, Pisum sativum
MAGYRADDDYDYLFKVVLIGDSGVGKSNLLSRFTKNEFNLESKSTIGVEFATRTLNVDSKVIKAQIWDTAGQERYRAITSAYYRGAVGALLVYDVTRHATFENVDRWLKELRNHTDSNIVVMLVGNKADLRHLVAVSTEDGKSYAEKESLYFMETSALEATNVENAFAEVLTQIYHIVSKKTVEGAENGNASVPAKGEKIDLKNDVSALKRVGCCSS

SEQ ID NO: 18473 - protein, 408 aa, Unknown
  Rhizobium sp. NGR234
MSHIVIVGAGECGARAAFALREKGFEGEITLIGAEPHLPYERPPLSKSGLAGAEPPKYVAGPERYEEAGITLLTGASVEAIDRPRKAVQLADGRTIDYDRLLLATGARPRVLQGVPDNAERIRMLRTHADALAIRGALAPGRKLAIIGGGFIGLELAATARKLGAEVVLIEGLPRVLCRGVPEEIAAVVAERHRQEGVEIVCDARIAALEAGDNGARILFADGASRLADLIIVGIGAVPNTELAEAAGLLVENGIAVDETLRTSDPDIYAAGDCCSFPLSHYGGRRVRLEAWRNAQEQGTLAAANLLGVAEPVASVPWFWSDQYELTLQIAGLADGAATTVRRDLTDGAFILFHLDGEGRLVAASGIGPGNAVARDIRLAEMLIAAGSRPDPTALSSPETKLKKLLAA

SEQ ID NO: 18474 - protein, 155 aa, Glycine max
MGKVFNGVEEFSESRNVFKTVPALVLYLGAIHFNLALILWATVFLPLSKGLLVFGLLLVFVLIPVDENSIFGHKLSKYICKHICSYFPITLHVEEAKAFRPDQAYVFGYEPHSVFPIGIVALGDSTGFMPLAKTKFLASSAVFYIPFLRHIWTWL

SEQ ID NO: 18475 - protein, 595 aa, Bdellovibrio bacteriovorus
MNKAALEKQKVLAFLDAEDAKVPANPGILNAKADKAGDFDSLFEASMKEQDFKVGDVVTGSVVEVQSDYVLVDINYKSEGLIAINEFRIVDGVRDVKAGDKVEVLIDRIENENGMIVLSKDKADMLRAWTDISKAAENEEVIEGTVVAKVKGGLSVDIGVKAFLPGSQIDLRPVRNMDVYLGKKFKFKVIKFNKKRGNIVLSRRALLEEERDSLRSQTLDTMAEGSVVTGVVKNITDYGAFIDLGGMDGLLHITDMSWGRVKHPSEMLNVGDEIQVKVLKYDKEKERVSLGMKQLHADPWESVKASYPPGTKLKGKVVSLAEYGAFVELGEGIEGLIHVSEMSWTKRVKHPSQIVTVDQEVEVVVLEVDTENRRISLGMKQLQANPWVEMKESYAPGTIIEGEVKSVTDFGIFIGIEEGIDGLVHISDFSWTKRVNHPNELYAKGQKVRAVVLGVDIENERFSLGIKQLESDPWSNIENKYAIGTQHDVKVTKTADFGAFVELESDIEGLIHISELTTEKINSVEEFIKPGQSVKAEVISIDKDARKIGLSAKLVKLRESKADVDDYVKKATATSKSTFGDLFADQLKNVKTDKQ

SEQ ID NO: 18476 - protein, 218 aa, Pisum sativum
MAGYRADDEYDYLFKLVLIGDSGVGKSNLLSRFTRNEFNLESKSTIGVEFATKSLNIDSKVIKAQIWDTAGQERYRAITSAYYRGAVGALLVYDVTRRATFENAARWLKELRDHTDPNIVVMLIGNKSDLRHLVAVPTEDGKSFAERESLYFMETSALEATNVENAFSEVLSQIYHIVSKKAVEAGESGSSSAVPSIGQTINVKEDSSVFKRFGCCSN

SEQ ID NO: 18477 - protein, 358 aa, Unknown
  Azoarcus sp. EbN1
MSKFHDMRVASVRPETRDAIVVTFDVPPSLADSFHYAPGQHLTLRTEIGGEDVRRSYSICSGADERALRIAIKRVHGGLFSNWANDFMKPGVSVEVMPPSGHFGVAPDPQHHRNYAAFAAGSGITPILSQIKTILAAEQGSRFTLVYGNRSSSSVMFREELADLKDQYGERLNLVHVLSREQQDIELFNGRIDRERCDALLTRWIDAKRIDVAFICGPMDMMEAVSASLQAHGVAKSAIKMELFATSLPKGPRPVHSHPVKGTEDCEVTVIQDGRVRQFTMPKNRDSVLDAGLGQGIEMPYSCKGGVCSTCRCKVIDGEVDHDTNFALEDYEIARGFRLSCQSYPVTDKLVLDFDQET

SEQ ID NO: 18478 - protein, 286 aa, Hordeum vulgare
MAALAPTKMLGTRLDFAGSSRYATAAPTAGAQKIVSLFDRFNKKPAPKPKPAPVATSSAGIDDELAKWYGPDRRIYLPNGLLDRSEVPEYLNGEVPGDYGYDPFGLGKKPEDFAKYQAFELIHARWAMLGAAGFIIPEALNKFGANCGPEAVWFKTGALLLDGNTLNYFGNSIPINLILAVVAEVVLVGGAEYYRITNGLEFDDKLHPGGPFDPLGLATDPDQAALLKVKEIKNGRLAMFSMLGFFIQAYVTGEGPFENLCAHLSDPFGNNLLTVISGAAERVPSL

SEQ ID NO: 18479 - protein, 449 aa, Zea mays
MPTITHYVLDPFLETGSPAQAEKATPKPPPSPPDKATPVPVAPIRAQTSPASLYATPESTTLPDSPSSFPGTWSPYIINHKRRGASLAKTVPQGDVGSEGSQPKLPVILPALPKGGEPTAVEEPEFAFQQSGNDQAEGDSGVDEAPINGKNEMLLKGKGPVTAKNEHEQPEFEFHRGNLEALVRPVNVGRPLIGGAPKNDESDTFLELQDSMSVASNTETDDAGTQEWWWKPSSPLGISVGTPCAEFYDAFEEISSDGGTRSSRAMDDDLREMRLSLLTEIERRKQAEEALEIWQKEWKKLSHHLSHVALSLPSPSIAEDTDDSSIDPGAELCQQITVSQLVAAAISQDFARAEVESEMETVIAAKNFEIARLSDRVQYYEAANREMSQRNQEAIEMSRQQCKECKKQQKWLWGFAGLAVTLGATAIAWSYLPSSQPQTSADSNSTPSD

SEQ ID NO: 18480 - protein, 130 aa, Ostreococcus tauri
MLRASGSGAIVFNSSVSGLTSTATGSLYAMSKGAMNQLTRYLACEWAKDNIRVNAVAPWYIATPLAKQVLKNETYRRAVVDRTPAGRVGEPPEVGAVAAFLVAPASSYVTGVVIPIDGGFTAHGFIPPKL

SEQ ID NO: 18481 - protein, 156 aa, Hyacinthus orientalis
LGCVFPELLARNGVKFGEAVWFKAGAQIFSEGGLDYLGNPSLVHAQSILAIWATQVLLMGAVEGYRVAGGPLGEVVDPLYPGGSFDPLGLADDPEAFAELKVKEIKNGRLAMLSMFGFFVQAIVTGKGPLENLADHLADPVNNNAWAFATNFVPGK

SEQ ID NO: 18482 - protein, 503 aa, Burkholderia thailandensis
MRGRRRAARGLSKHLYWNELISMQQATGAFMKTLFLQAPSYDGFDGGAGSRYQAKREIRSFWYPTWLAQPAALVPGSRVLDAPADGLSVEETLKIAKDYDLVIIHTSTPSFPTDAMFAEDLKKMKPSMLVGMVGAKVAVDPHNSLTATQAIDFVCREEFDYTCKDIAEGKPFAEILGMSYRAKDGSIEHNGPRPMIENMDELPFVAPVYKRDLKIDNYFIGYLNYPYVSIYTGRGCRSKCTFCLWPQTVGGHRYRVRSVESVLAEVKWIRDNMPEVKEIMFDDDTFTDFKPRVEEIARGLGKLGVTWSCNAKANVPYSTLKIMKENGLRLLLVGYESGDDQILLNIKKGLRTDIARRFNEDCKKLGIKIHGTFILGLPGETKETIKKTIEYAKEINPHTIQVSLAAPYPGTRLYNQAIENGWMEENKTINLVSKEGVQLAAIGYPHLPKEEIYHQLEHFYREFYFRPSKIWEILREMLTSWDMMKRRLREGVEFFRFLRAHEA

SEQ ID NO: 18483 - protein, 250 aa, Zymomonas mobilis
MAVPTVTMQSLLDVGAHFGHQTHRWNPKMKPYIFGDRNGIHIMDLSQTVPLFTRALDFISQTVAHGGKVLFVGTKRQAQEPIADAARRSGQFFVNHRWLGGMLTNWRTISGSIKRLKSLEEKLSGDTAGFTKKEILQLTRERDKLELSLGGIRDMGTIPDIMFVVDANKEELAIKEANTLGIPVVAILDSNVSPDGIAFPIPANDDAARAVRYYCDAIAEAATRGDQQNRQELGEDLGAAVEPAAEEALA

SEQ ID NO: 18484 - protein, 722 aa, Rhodopseudomonas palustris
MFNIHSVEIDWGGRPLKLETGKVARQADGAVVATYGETVVLATVVAAKAPREGVDFLPLTVDYQEKAYAAGRIPGGYFKREGRPTEKETLVSRLIDRPIRPLFADGWRNETQVIVTVLSHDMENDPDVLAMVAASAALTLSGVPFKGPIGAARVGFINDEYVLNPVLDEMAETQLELVVAGTADAVLMVESEAKELSEEIMLGAVMFGHRHFQPVIDAIIDLAEKAAKEPRELTVVDDSEIEKEMLGLVEQELRAAYAIPVKQDRYAAVGKVKEKAIAHFFPEGQEPKYDKLRIAGVFKELEAKIVRWNILDTGKRIDGRDSKTVRNILAQVGVLPRTHGSALFTRGETQAMVVTTLGTGEDEQYVDSLSGTYKETFLLHYNFPPYSVGETGRLGGTKRREIGHGKLAWRAIHPVLPPHHEFPYTIRVVSEITESNGSSSMASVCGASLALMDAGVPLKRPTAGIAMGLILEGERFAVLSDILGDEDHLGDMDFKVAGTEAGITSLQMDIKIAGITEEIMKVALGQAKDGRIHILGEMSKALDRARAELGEHAPRIETFKIPTDKIREVIGTGGKVIREIVEKTGAKVNIEDDGTVKVASSDGESIKAAIKWIKSIASDPEVGEIYEGTVVKVMEFGAFVNFFGAKDGLVHISQLAAGRVQKTSDVVKEGDKVKVKLLGFDDRGKTRLSMKVVDQTTGEDLEAKQKAEAKAEGEAPAQAAGE

SEQ ID NO: 18485 - protein, 480 aa, Rhodopirellula baltica
METDSRSEFGRDGSSLSWNVQGDDVVIQFTMEVPVPKPKLTLVSMSGLRVGHEELLQRGLKLPGLARRASALSQLPPLGLLTIAALVPESWDIELVMDDGVTPECEVADQILSGTTSLNPPRVVAFSALTPSADRAARISRLVQRHNVTTVIGGLHATATPEHCRPHFDVVVQGDGESTFANLLADVMEGTPAASYRADGSFSLADSPLPRWELLGKNSPPRYTIQSMRGCPWACSFCAASRMLGPARVKPDDRFEAELQAISDQQSRPWIELADDNTFASGRDHGPMLESLQNHGARWFTESDWRIAKKPRLLQQIADSGCRQILIGLESSVFRYPGMGAKNADWERMLEAVVAIQEAGIVVNGCLIVGADGESKESITRLGDFLEEAPMGEIQLTLQTPFPGTSLYKTLLQSERLLPGDFSRYTLFDVVYQPDQMTAEQLQNEFNALIERVFRPEAQARRDSIQKKIRSFRRAARDQV

SEQ ID NO: 18486 - protein, 318 aa, Vibrio cholerae
MSNVKHSKLLILGSGPAGYTAAVYAARANLKPVLVTGMQQGGQLTTTTEVENWPGDAEGLTGPALMERMKEHAERFDTEIVFDHINSVDLSSRPFRLTGDSQEYTCDALIISTGASAKYLGLESEEAFKGRGVSACATCDGFFYRNQKVAVVGGGNTAVEEALYLSNIASEVHLVHRRDSFRSEKILIDRLMDKVANGNIVLHTHRTLDEVLGDEMGVTGVRLKDTQSDMTENLDVMGVFIAIGHQPNSQIFEGQLEMKNGYIVVKSGLEGNATQTSIEGVFAAGDVMDHNYRQAITSAGTGCMAALDAERYLDSQGK

SEQ ID NO: 18487 - protein, 429 aa, Oryza sativa
  misc_feature (105)..(105): Xaa can be any naturally occurring amino acid
  misc_feature (117)..(117): Xaa can be any naturally occurring amino acid
  misc_feature (124)..(124): Xaa can be any naturally occurring amino acid
  misc_feature (168)..(168): Xaa can be any naturally occurring amino acid
MARGAHQAPGGFWTVAAAPTRCSLPHSLPIPLHAAAAAAAWMAGVSAASAAGKIGSFLSKRPYAPPSWASHLSPAPSQTFSLGHFPTPIHKWNLPNLPNGTEVWXIKRDDISGMQLXSGNKVRXLEFLMADAVAQGADCVITVGGIQSNHCRATAVAAKYINLDCYLXILRTSKLLVDKDPGLVGNLLVERLVGAHIDLVSKEEYGKIGSVALADLLKKKLLEEGRKPYVIPVGGSNSLGTWGYIEAIREIEHQIQISGDVQFDDIVVACGSGGTIAGLALGSKLSSLKAKVHAFSVCDDPGYFHSYVQDLIDGLHSDLRSHDLVNIENAKGLGYAMNTAEELKFVKDIATATGIVLDPVYSGKAAYGMLKDMGANPAKWEGRKILFVHTGGLLGLYDKVDELSSLSGSWRRMDLEESVPRKDGTGKMF

SEQ ID NO: 18488 - protein, 283 aa, Oryza sativa
FYFDADGTKSPDVEIELEQPTMIHDFAITENFVVVPDHQVVFKLGEMFRGGSPVVLDREKTSRFGVLPKHATSSLEMVWVDVPDCFCFHLWNAWEEAESGEVVVVGSCMTPADSIFNESDEHLESVLTEIRLNTRTGESTRRAVLPPAAQVNLEVGMVNRAMLGRKTRYAYLAVAEPWPKVSGFAKVDLATGELTKFEYGEGRFGGEPCFVPMGGAGAAASPARGEDDGYILSFVRDEAAGTSELLVVNAADMRLEATVQLPSRVPYGFHGTFINAGELATQA

SEQ ID NO: 18489 - protein, 234 aa, Thermobifida fusca
MPLTLYDAAKAVVAPTTRALWPLHVEGLHHIPAHGPVILASNHLSNLDPLFLSVVVPRPVVFIAKKELFAEGNLAQRLFTRALRAVGHVSVDRRPGQSAQEAMDRSLAVLAEGRVFGIFPEGTRSPDGRLYKGQTGLAWLALTSGAPVVPAALVGTNRILPAGRRIPSFRRIGVRFGEPVDLSPWAGQAGRARARREATDAVMAAIQKLSGQEQVPRFAASVKAELAQQRGLAA

SEQ ID NO: 18490 - protein, 957 aa, Bradyrhizobium japonicum
MSLIEEIDFGTPRAKSETMVTLTIDGKEISVPEGTSIMRAAMEAGHQIPKLCATDMVDAFGSCRLCLVEIEGRAGTPASCTTPVMPGLVVHTQTDRLKKLRKGVMELYISDHPLDCLTCGANGDCELQDMAGAVGLRDVRYGYEGENHVFAKSNGEVNAAWMPKDESNPYFAYDPSKCIVCSRCVRACEEVQGTFALTISGRGFDSRVSPGMSESFLGSECVSCGACVQACPTATLTEKSVIEIGQPEHSVVTTCAYCGVGCAFKAEMRGEEVVRMVPYKDGKANRGHSCVKGRFAWGYTNHKERILKPMIRERIEDPWREVSWDEAFSFAAARMRGIQKKYGRDAIGGITSSRCTNEETYLVQKLIRAGFGNNNVDTCARVCHSPTGYGLSQTFGTSAGTQDFDSVENTDVAVVIGANPASAHPVFASRLKKRLRQGAKLIVIDPRRTEMVESPHVKALHLPLMPGTNVAVVTALAHVIVTEGLVNEAFVRERCDWTEFEEWAAFVAQPNNSPEATAILTGVDPKALREAARIYATGGNGAIYYGLGVTEHSQGSTTVIAIANLAMATGNIGRPGVGVNPLRGQNNVQGSCDMGSFPHELPGYRHISGNAVRDQFEALWNVKLNPEPGLRIPNMFDAAIEGTFMGIYVQGEDILQSDPNTSHVVAALAAMECVIVHDLFLNETANYAHVFLPGSSFLEKDGTFTNAERRIQRVRKVMTPKNGMADWEVTIGLAKAMGFEMNYSHPSEIMDEIAALTPTFTGVSYAKLDELGSVQWPCNEKAPEGTPVMHIDGFVRGKGKFIVTEYVATDERTGPRFPLLLTTGRILSQYNVGAQTRRTENVVWHAEDRLEIHPHDAEQRGVRDGDWVRLKSRAGETTLRAEITDRVAPGVVYTTFHHPDTQANVITTDYSDWATNCPEYKVTAVQISPSNGPSDWQKSYDAQARHSRRIAPAEAAE

SEQ ID NO: 18491 - protein, 110 aa, Cenarchaeum symbiosum
MGITQISDTKSWESDVMNSPTPVFVDFWAEWCGPCRMVTPVVEELASDYEGKVSFVKVNVDEANELASRYNVFSIPTLALFSKGKIIGQQVGAASKEAYKKMIDSALEKA

SEQ ID NO: 18492 - protein, 546 aa, Colwellia psychrerythraea
MSSRQTLASWKKLQLLAQDKKSQHMNTLFAQDSERFNKFSIELPNMLLDYSKNLIDTETLDALLALAEETQVCDWRAKMFAGEKINKTEDRAVLHTALRRQSDEAFIIEGENVTEHVKNQLAEMEVFVNKVRQGHWLGYSGKRITDIVNIGVGGSNLGPQMVTEALKHYSDGSVNVHYVSNVDGAQIAEVLRPLEPEKVLFIVSSKTFTTTETMTNARTAINWLTSASFDENSVAKHFVAVTANKENAMSFGIEEQNIFDMWDWVGGRFSLWSAIGLAIALDLGFDKFEELLAGAHDMDQHFINAPLKDNFPAILALISVWNTTFLGSQSQAILPYDQTLHMLTAYLQQAEMESNGKSVSWDGDEIDYATVPSIWGELGINGQHAFYQYLHQSNNVVPADFIGSVKSVTPVKGHHETLMANFFAQTQALMVGVNEEQVRADLKAKGRNAEYIDNVAPHKVHKGNRPTNTILLKCINPRNLGSLIAAYEHKIFVQGIILQICSFDQWGVELGKGLAAEIQTELQTDNISAQHDCSTSSLLKFYQSAK

SEQ ID NO: 18493 - protein, 420 aa, Unknown [sequence omitted]

SEQ ID NO: 18494 - protein, 370 aa, Oryza sativa
MGRRPVRCYRQIKNKPYPKSRYCRGVPDPKIRIFDVGQKKRSADDFPLCVHLVSWEKENVSSEALEAARIACNKYMAKHAGKDAFHLRVCAHPYHVLRINKMLSCAGADRLQTGMRGAFGKPTGTCARVRIGQVLLSVRCRDANAAHAQEALRRAKFKFPGRQRVIFSAKWGFTRFKRDEYLKLKSEGRIVPDGVNAKMKIIPVACLEDNYAYLIVDESTKSAAAVDPVEPEKVLAAAAEVGVRIDCVLTTHHHWDHAGGNEKMAQSVPGIKVYGGSLDNVKGCTDQYTVKNLKFILTVEPDNEKVKQKLEWAQKQREANQPTIPSTIGEEFETNTFMRVDLPEIQAKFGAKSPVEALREVRKTKDNWKS

SEQ ID NO: 18495 - protein, 383 aa, Brassica oleracea
MESGSNSTSCPMAFAGDNSDGPMCPMMMMMMPVITSHQQHHGHDQQHQHQQQHDGYAYQSHHQHSSLLFLQSLTPPSQEAKNKVRSSCSPSSGAPAYSFMEINHQNELLAGGLQSPVLSSLLVKAKIMAHPHYHRLLLAYVNCQKVGAPPEVQARLEETCSSAAAAAASMGPTGSLGEDPGLDQFMEAYCEMLVKYEQELSKPFKEAMVFLQHVECQFKSLSLSSPSSLGYGEAAIERNNNGSSEEEVDMNNEFVDPQAEDRELKGQLLRKYSGYLGSLKQEFMKKRKKGKLPKEARQQLLDWWSRHYKWPYPSEQQKLALAESTGLDQKQINNWFINQRKRHWKPSEDMQFVVMDATHPLHYFMGNVLGNPFPIDHISGTML

SEQ ID NO: 18496 - protein, 1068 aa, Unknown
  Oceanospirillum sp. MED92
MAIGQVSLIVSLVLISVLVGIFPDEANVERQARKAISETIAAKGSLFITQSDMRGLETVLQVIVERNPTLLSSVVRRNGRVISEVGPHVQYWEPIGDSLSTNTQVVIPLWSGEQKWGQVELRFSPIIEPGIWGIMTSPVFVFLTFLSLTSFVAFFFYLGKMLKHLDPSQAVPDRVRSALDTMAEGLLVLDKNQNVVLANQSFSDMVERSAEKMIGVKASVFPWHDRKGNPLNTEKAPWTKALESGQVIMNQVVRLTLPNESRLTFMVNCSPVLLPGGKVGGVMVSLDDVTLLEEKELELRRSKEEAEAANRAKSDFLANMSHEIRTPMNAILGFADILRRDKKKLQTDQLKHINTISTSGQHLLDLINDILDLSKVESGRLEVEALDCKPVQLIHHVLQFMKVKADEKGLELKFVADTSLPEQIETDPGRVRQILTNLIGNAIKFTEQGGVTVHVSVVGDNPKQMKIAVVDTGIGMTQQQTDSVFEAFVQADSSITRRFGGTGLGLSISQKFAHALGGDILVTSEKGVGTTFTLVLEVGSLDSVEWLSADQLHLVIESEESDDAVEWEFPPAHVLVVDDGNENRELIKLVLDGLGLKVATAVHGQDGLTQALEQSFDLILMDVQMPVMDGYTAVAKMREEGIELPIVALTAHAMKGIEARCLEAGYSHYMTKPIDINALVKLMAELLGGVQVESAESNAVPVLDDPIAPVESKVSPDNEEPDLEPIYSTLPTENPKFAELVKTFIGRLQEKVAEIERAVETKDYEELANLAHWLKGSGGSVGFMEFTEPAMLLEVAAKESNGIAVQERFDEIQILCKRAAISIDREPEVKRPEPVSNSIKSDSCAEPLADAAETILRSTLPLANEKIARLVEQFLRRLEEQIDLLSRCVTDKDFVQIAELAHWLKGSAGSVGFAAFTEPSAELELAAKQQDFQQVESYYQVILELTKRVEGIDIEALPLGLNGQSESVNETPIHSSLLQANEKFRPIVVQFCDKLGSQINEMQDSLKHNKFQELADLAHWLKGSGGSVGFTDFTDIAAELENQAKLNNREGSEQMLKQIEALSKRIEL

SEQ ID NO: 18497 - protein, 249 aa, Listeria innocua
MAEVHFVGAGPGDKELITLKGYQLLKNADVVIYAGSLVNPELLEYCKPDCEIHNSASMNLIEIIDCMEAGVTAGKEVVRLQTGDFSIYGSIREQVEEMKKRSIPFTCTPGVSSFLGAASSFGVEYTVPEVSQSVIITRMAGRTPVPSRESLRSYAAHQTSMVIFLSVQGIRKVVSELIKGGYKPETPAAVIYKATWAEEKKVTGTLQDIAEKVTEAGITKTALIMVGDFLGEEFYYSKLYDKDFKHEYR

SEQ ID NO: 18498 - protein, 171 aa, Hyacinthus orientalis
NYFTYRQHAPMGKAVATTIDHCNSAPAKGETMRCITSAEDMIDYLATSLVAKINITARSTDNSIQLGGNVLIGEVKAANGGKLGHVVSCHQAAFPYLLYRCHSVPETKLYEVEILDPETKAKISAATAICHFDTSVWSRDHVAFMALGYERGMEICQWVFPGAIAWTAATE

SEQ ID NO: 18499 - protein, 474 aa, Burkholderia vietnamiensis
MRPSGLSQSFYLNRSASAGMAMPHDRRADIARRHGRRRRRAPRHGRLRGSSITLFRSIIMFNRTTSTVANVDPEIFAAIEQENRRQEDHIELIASENYTSPAVMAAQGSQLTNKYAEGYPGKRYYGGCEYVDVVEQLAIDRVKQLFGAEAANVQPNSGSQANQGVFFAMLKPGDTIMGMSLAHGGHLTHGSPVNMSGKWFNVVSYGLNENEDIDYDAAEKLAQEHKPKLIVAGASAFALKIDFARMAQIAKSVGAYLMVDMAHYAGLIAAGVYPNPVPHADFVTTTTHKSLRGPRGGVILMKAEYEKQINSAIFPGIQGGPLMHVIAAKAVAFKEALSPEFKAYQQKVVENARVLAETLVKRGLRIVSGRTESHVMLVDLRAKHITGKAAEAALGAAHITVNKNAIPNDPEKPFVTSGVRLGSPAMTTRGFGPAEAEQVGNLIADVLENPEDAATLERVRAQVAELTKRFPVYG

SEQ ID NO: 18500 - protein, 420 aa, Agrobacterium tumefaciens
MSEKRVQPLARDAMAYVLAGGRGSRLKELTDRRAKPAVYFGGKARIIDFALSNALNSGIRRIGVATQYKAHSLIRHLQRGWDFFRPERNESFDILPASQRVSETQWYEGTADAVYQNIDIIEPYAPEYMVILAGDHIYKMDYEYMLQQHVDSGADVTIGCLEVPRMEATGFGVMHVNEKDEIIDFIEKPADPPGIPGNEGFALASMGIYVFHTKFLMEALRRDAADPTSSRDFGKDIIPYIVEHGKAVAHRFADSCVRSDFEHEPYWRDVGTIDAYWQANIDLTDVVPDLDIYDKSWPIWTYAEITPPAKFVHDDEDRRGSAVSSVVSGDCIISGAALNRSLLFTGVRANSYSRLENAVVLPSVKIGRHAQLSNVVIDHGVVIPEGLIVGEDPELDAKRFRRTESGICLITQSMIDKLDL

SEQ ID NO: 18501 - protein, 250 aa, Triticum aestivum
SAIKDMAVALHFQLRVVKSDRSRFIAKCNTEGCPWRVHVAKCHGVPTFTVRTLQGEHTCEGVQDLHHQQATVNWVARSVEARLRDNPQIKPKEILQDIRDQHGVAVSYMQAWRGKERSMAAVHGTLEDGYRLLPAYCDQIGKTNPGSVAVYKGAGPENSFQRLFVSFHASIYGFLNACRPLLEIDKADLKGKYLGTLLCASAVDADHMMFPVAFGVVDSESDENWMWFISELRKMLGVNTDKMPVFTIIS

SEQ ID NO: 18502 - protein, 575 aa, Unknown
  Candidatus Blochmannia floridanus
MIESFAQLFEESIKKTQTKSGSIVQGVVIAISKEIVLVDAGLKSESAIPINQFYNSHGELEVTVGDYIDVILDAVEDGFGETILSREKAKRHESWLYLEKAYQEVTTVTGVIHGKVKGGFTVELNGIRAFLPGSLVDIRPIKDSIDLEGQTCDFKVIKLDHKRNNVVVSRRAAIEFEHSAERDQLLHKLHEGIIIKGVVKNLTDYGAFIDLGGIDGLLHITDIAWKRVKHPSDIISIGDEISVKVLKFDRERTRVSLGLKQLEDDPWISIVRNYKEGDKITGKVTNLTDYGCFIEIAGGVEGLVHISEMDWTNKNIHPSKVVEVGECIEVMVLDIDEDRRRISLGLKQCKVNPWQRFSQIYARGDRVTGRIKSITDFGIFIGLEDGIDGLVHLSDIAWSVSNNNELISQYKKGDEVTAVVLQVDSERERISLSIKQLTEDPLNIFLSIHKKGSIVSGKITFIDHDTKKITLSLDNEFVIGCVCYLDVLHNASGIDNQTKNMLLRKFKSFQIGDIIQSKIEGIDRKNRVINLSVYNDDELNKKSIIGISNNEKKGKDKNDFSSVMIEAFKAATKHE

SEQ ID NO: 18503 - protein, 225 aa, Novosphingobium aromaticivorans
MRRPVLAAALLAGIVTASCQQTAQAEGAVAAPEAAVQADEAPGRKVAIFAGGCFWGVEGVFSHVKGVTSVVSGYHGGEKKTASYDVVGTGRTGHAEAVRVTYDPAKVRYDQLLRIFFAVVTDPTQLNYQGPDDGTQYRNALVPMDKEQARVAAGYLAQLKRLDLWKRPIVTAVEPYKTFYPAEGYHQDFMANNPDHGYIRRWDAPKVQALKRMFPDLYKPAFTRN

SEQ ID NO: 18504 - protein, 651 aa, Agrobacterium tumefaciens
MQIPPVFPKGATRTENGVEFTVYSRHASQIDLCLFDDAGEKETARLPMMRGEDDVHRLTHENAGPGTRYGFRAHGIYAPEHGLWFDPAKLLLDPYATEIDRPFRHDPSLYAFGAETGAIMPKAILSAHDPVKRQPPRFAEGGLIYELAVKSFTQLHPYVPEDIRGTVAALAHPAILAHLKKIGVDAVELMPITAWIDERHLPPLGLSNAWGYNPVGFIALDPRLCPGGVRELRDTVAALHAEGIGVILDLVFNHTGESDIEGSILSLRGLDNLTAFRHPQGKPGVLVNDTGTGNTVACDHPYIRQLIVDSLRHFVLNAGVDGFRFDLAPVLGRTAAGFDMASETLAAMHSDPVLYDRLLIAEPWDIGPGGYQLGNFPESFLEWNDRARDDMRRFWRGDAGTTGALANALSGSSPIFSRHGRLKSRSVNFLAAHDGFTLFDLVSHERKHNEKNGENNRDGHNDNHSWNNGFEGLTDDPAIVAARLADVKALLSTLFVSRGTLMLTAGDEGGRSQQGNNNAYCQDNEISWVDWSSLVPELIDHTAFLAALRKRFGVFSESGFFSGRGDVTWLAPGGEPMTVADWERPDGQAFAMVLSTPDRETGKATELAVLINRGRDIVPFTLPGDGWRSIGTDFGNPAFLPARSVVFYLRG

SEQ ID NO: 18505 - protein, 466 aa, Xylella fastidiosa
MTVASVEQMFSGKIQVGSEVTVRGWVRTRRDSKAGLSFVSVSDGSCFAAIQVVTPAHLPNYETEVRKLTTGCAVIVIGTLAPSLGQGQQFEIQAQSIEVVGWVEDPETYPIQPKQHSLEFLREVAHLRPRTNLFGAVARIRHCLSQAVHRFFHENGYYWITTPIITTSDAEGAGQMFRVSTLDLVNLPRTETGGIDFSHDFFGKETFLTVSGQLNVEAYALALSKVYTFGPTFRAENSHTPRHLAEFWMIEPEIAFADLAEDARVAEQFLKFLFKTVLEERTDDLAFITERVEKTTISKLEGFIKSPFERIEYTDAIKLLERSGKKFDFPVEWGLDLQTEHERWLTEKHIGRPVVVTNYPEHIKAFYMRLNDDGKTVAAMDVLAPGIGEIIGGSQREERLEMLDIRMAQFGLDPTHYQWYRDFRRYGSVPHAGFGLGFERLMVYVCGLSNIRDAIPYPRAPSSAEF

SEQ ID NO: 18506 - protein, 246 aa, Ostreococcus tauri
MAEHLASIFGTEKDRVNCPFYFKIGACRHGDRCSRLHNKPSASQTVLLTNMYRAEGAGGTVDPRDAASGKSASASAGQGHFEAFVEDLFEELDECGEIEGVNVCDNATDHMAGNVYVKFVDEDGARRALEKLQGRYYDGRPILVEYSPVTDFKESTCRQYEENSCTRGGYCNFMHLRPIGRSMRKQLRRRATGSSTMDASTRRGCPTTHDEPCSRSGTKRVRIDFLELKFLCVRIASTDHSRAKKY

SEQ ID NO: 18507 - protein, 894 aa, Oryza sativa
MPPWWGKSFSKDAKKTTKENLIDTFHRLISPNDQKGSTKSKRSCRRGNDSSVEKSCRSTTVSRPTSPSKEVSRCQSFSADRPHAHPLPIPGVRPPVTRTVSDITESKPILEKRGKPPLLLPLPKPNRPPRRHGNSEVVSEIVVASPSSNCSDSDDHGDSQLQSPVGNDAENATLVTLKNKSSNARKECPGPITAKNMKEIHRPANQVHGSHILSTSPRGVAADSYQSNLQNPRPLVLDSAPNSLMSSPSRSPRRICPDHIPTSAFWAVKPHTDVTFVGSGQCSSPGSGQTSGHNSVGGDMLAQLFWQPSRSSPECSPIPSPRMTSPGPSSRVHSGSVSPLHPRSGGMAPESPTNRHDDGKKKQTHKLPLPPLSISHSSFHPNNSTPTSPISVPRSPGRTENPPSPGSRWKKGKLIGRGTFGHVYVGFNSDSGEMCAMKEVTLFLDDPKSKESAKQLGQEISLLSRLQHPNIVQYYGSETVDDKLYIYLEYVSGGSIHKLLQEYGQLGEQAIRSYTQQILSGLAYLHAKNTVHRDIKGANILVDPSGRVKLADFGMAKHINGQQCPFSFKGSPYWMAPEVIKNSNGCNLAVDIWSLGCTVLEMATSKPPWSQYEGIAAMFKIGNSKELPPIPDHLSEPGKDFIRKCLQRDPSQRPTAMELLQHPFVQKAVSLEKSVLSEPLEHLAVISCRPSAKMAAHTRNISSLGLEGQTIYQRRGAKFSSKHSDIRIRSNISCPVSPCGSPLLKSRSPQHSNGRMSPSPISSPRTTSGTSTPLSGGNGAIPFNHLKQSTYSNEGFAIPSRSPDDLFASRPTDPDLGQFIRVHQVSQGLQERVVSEADILSPQFGKRLGNVFDLRDKLSPSERFTHHAFVDHVKLNPSLDLTSGSPHLGLKHGN

SEQ ID NO: 18508 - protein, 350 aa, Prunus persica
MTKSNSSSVGRCLSLISIVLLLGQLVVASLATKQHTGAPVGVCNGMVGDDLPPQAEVVALYKTNNIPRMRLYDPNPAALEALRGSNIKLLLGVPNENLQYIALSQANANAWVQNNVRNYANVKFKYIAVGNEVKPSDSFAQFLVPAMRNIQEAISLAGLAKKIKVSTAIDTGVLGETFPPSIGSFKSEYNALLYPIIRFLVSHQSPLLVNLYPYFAYSGNTQDIRLDYALFTAPSVVVQDGNFGYRNLFDAMLDGVYAALEKAGGGSLKVVISETGWPSAAGTATTIDNARTFISNLIQHVKEGTPRRPGRPIETYIFAMFDENRKTPELEKHWGLFSPTKQPKYQISFN

SEQ ID NO: 18509 - protein, 584 aa, Saccharomyces cerevisiae
MTISDHPETEPKWWKEATIYQIYPASFKDSNNDGWGDLKGITSKLQYIKDLGVDAIWVCPFYDSPQQDMGYDISNYEKVWPTYGTNEDCFELIDKTHKLGMKFITDLVINHCSTEHEWFKESRSSKTNPKRDWFFWRPPKGYDAEGKPIPPNNWKSFFGGSAWTFDETTNEFYLRLFASRQVDLNWENEDCRRAIFESAVGFWLDHGVDGFRIDTAGLYSKRPGLPDSPIFDKTSKLQHPNWGSHNGPRIHEYHQELHRFMKNRVKDGREIMTVGEVAHGSDNALYTSAARYEVSEVFSFTHVELGTSPFFRYNIVPFTLKQWKEAIASNFLFINGTDSWATTYIENHDQARSITRFADDSPKYRKISGKLLTLLECSLTGTLYVYQGQEIGQINFKEWPIEKYEDVDVKNNYEIIKKSFGKNSKEMKDFFKGIALLSRDHSRTPMPWTKDKPNAGFTGPDVKPWFFLNESFEQGINVEQESRDDDSVLNFWKRALQARKKYKELMIYGYDFQFIDLDSDQIFSFTKEYEDKTLFAALNFSGEEIEFSLPREGASLSFILGNYDDTDVSSRVLKPWEGRIYLVK

SEQ ID NO: 18510 - protein, 343 aa, Prunus persica
MAKSNSSVGRGPSMISIVFLLGLLMASFETTGAQIGVCYGMLGDRLPPPSEVIALYKQNNIRRMRLYDPNQAALAALKGSYIELMLGVPNDNLQSLASSQANANTWVQNNVRNYGNVRFKYIAVGNEVKPSDSYAQFLVPAMQNIQNAISSAGLGIKVSTAVDTGVLGNSFPPSKGEFKSEYGALLNPIIRFLVNNRSPLLVNLYPYFSYSSNTHDIRLDYALFTAPSVVVQDGQRGYRNLFDAILDAVYAALEKAGGGSLEIVISESGWPSAGGTATTIDNARTYNANLIQHVKGGTPRKPGRAIETYIFAMFDENRKNPELEKHWGLFSPSKQPKYPINFN

SEQ ID NO: 18511 - protein, 258 aa, Geobacter metallireducens
MTIVHFIGAGPGDAELITVKGARLLREADVVVYAGSLVDRELVRTYAPDAEVCDSAAMTLEETTAVLAQAVADGKRAVRLHTGDPSIYGAIQEQMAELDRLGIAYAVVPGVTSAFAAAATLRQELTLPEVSQTVVITRLAGRTPVPEREKLTEIARIGATLVIYLSISMVEQVVAELLQGAYTPATPVAVVSRASWPDEHVVEGTLADIAGKVRDAGIGKQAIILVGDVLKARREGLKSKSLLYDKGFSHEFRKGIVT

SEQ ID NO: 18512 - protein, 473 aa, Unknown
  Shewanella sp. ANA-3
MQHGDEMMKKMTGKSFALSALVAASFMAAGAMASDKTEPRNEVYKDKFANQYNSWHDTAKSEEITDALAGDPSLVILWAGYGFAKDYNAPRGHMYAVTDVRNTLRTGAPANAEDGPMPMACWSCKSPDVPRLIEEQGEEGYFKGKWAKGGPEVVNTIGCSDCHEKGTPKLRISRPFAERAMETIGTPFDKASKKDKQSMVCGQCHVEYYFEKKDDRKGFVKFPWDSGTTVEQMEAYYDAIEFSDWTHALSKTPMLKAQHPGYETWKLGVHGKNDVSCVDCHMPKVTNDKGRKYTDHKVGNPFDRFDETCATCHSQSKEFLEGITKERYAKVKELKARAEGQLVKAHFEAAKAWEVGATEAEMKPILTDIRHAQWRWDFAIASHGVAAHAPEEALRILGTAVDKAADARVKLAQLLAKKGVTDAVAIPDISTKAKAQAALGMDMDKMNAEKEAFKKDVLPKWDEEAKKREATYK

SEQ ID NO: 18513 - protein, 258 aa, Unknown
  marine gamma proteobacterium HTCC2080
MAQVSMRDLLQAGAHFGHQTRFWNPKMDQYIFGARNKIHIINLEHTVPAFNDALKQVQRLASNKSNIMFVGTKRAAGKVIEEQAARCGMPFVSHRWLGGMLTNYKTVRSSIKRLRELEEQEADGTFAKLTKKEALMRTRSKEKLDRSVGGIKDMTGLPDVLFVIDVDHERIAITEANKLGIPVIGIVDTNSNPDGIDYVIPGNDDAIRAIRLYVKAVADAVLEGKAERGEVPAVAEDLVEVEEAPTDATDEAESEAEA

SEQ ID NO: 18514 - protein, 301 aa, Debaryomyces hansenii
MGKSSKDKRDLYYRRAKEEGWRARSAFKLLQLNEQFQLFKGVKRVVDLCAAPGSWSQVLSRELFENQKQADAKIVSVDLQPMTPIEGVTTLQADITHPKTLQKILEIFGGEPADFVCSDGAPDVTGLHDLDEYIQAQLILSALQLTTCILKPGGAFVAKIFRGRDIDLLYSQLSYLFERVICAKPRSSRGTSLEAFIVCLGYKPREGWNPILDLTKSTEEFFEGANIGRSDNLEHLDLPEDEERLIAKFVACGDLNDVDSDATYTLDTNFKKLALDPVQMPTAPPYKKALEMKRRGDLVRR

SEQ ID NO: 18515 - protein, 979 aa, Bacillus thuringiensis
MNNNMVHITIDGKKYTAEPSSTILGVINENGIEHPQICYVPEVDPIQTCDTCIVEVDGKLMRSCSTVVTEGMNIERNSTRAKEAQTEAMDRLLENHLLYCTVCDNNNGNCKLHNTAELMEIEHQKYPYEPKVDVSEVDMTHPFYRYDPNQCIACGQCVEVCQNLQVNETLSIDWEAERPRVIWDEGVSINDSSCVSCGQCVTICPCNALMEKTMLGEAGFMTGLKPDILEPMVDLIKEVEPGYSGIFAVSEVEAAMRDTRTKKTKTVCTFCGVGCSFEVWTKGRKILKVQPSSDAPVNAISTCVKGKFGWDFVNSKERITKPLIRKNGTFVESTWEEALNVVANKLGSIKEEYGKDAIGFISSSKITNEDNYVIQKLARQVFETNNIDNCSRYCQSPATDGLFRTIGMGGDAGTIKDIAQSGLVIIVGCNPTEGHPVLATRIKRAHKLHGQKLIVADLRKTEMAERSDVFISPKQGTDQVWLMAVTKYMIDQGWHDQQFIDENVNFFEDFKESLTEYTLEYAEEVTGISKETLIQMAEMIRDADGTCILWGMGVTQNTGGSDTSAAISNLLLATGNYRRPGAGAYPLRGHNNVQGACDMGTLPGWLPGYQHVTNDMERAKFEMAYGVKINNAPGLNNIEMLHAIDEGKMKAMYLVGEDMALVDSNANHVHEVLSSLDFFVVQDVFLSKTAQYADVVLPAAPSLEKEGTFTNTERRVQRLYQVLPTLGDAKPDWWIVQAIANKLGANWNYSHPSEIFAEMASLSPLFSQANYEVLEGWNSFHWGSFDGTNTPLLFQDGFNFPDKKARFAIADWVRPAEFPAEFDLHINNGRMLEHFHEGNMTNKSTGIQTKVPGVFVEVSPALAKERGVKTGSLVRLVSPFGALKLRVLVTDRVKANELYLPMNSTDNETAINFLTGPAVDTRTNTPAYKQTKVRMEVLEVDGENPMPKANPRNKKRHPQSGIEVHRKWARPGYVHLTDK

SEQ ID NO: 18516 - protein, 451 aa, Geobacter metallireducens
  misc_feature (45)..(45): Xaa can be any naturally occurring amino acid
MAKEKLVVIGGDAAGMSAASQAKRRRPELEIVVFERSPHTSFSAXGIPYYVGRVVDKEEKLVIRSPEKFREKYGIDARALHEVVEIDAAQGKVRVRDLQRGGSAWESYDQLLIATGAVPLCPDLPGSDAVDICGVNTLESGLEIRRRLDKGGMKKGVVVGGGYIGLEMAEALVRHGLEVSLVNRAPQVMGTLDYDMGAMVSQALRDVGVSLYLEETLTAFETKGGKVTGVVTDRRTLPADIVILGLGVRPNTALASAAGIPLGEKGSIRVNERMQTGVAGIWAAGDCAESFHLVSRKPVHIALGTVANRHGRVAGINLGGGYATFPGVVGTAVTKICQVEVARTGLQEEELRELGIEWISAVIKSRTRAGYFPGAGGITVKVLAERGSGRLLGGQIVGMEGSAKRIDTLATALHAGFTVEEMINLDLGYAPPFSPVWDPVVIAAREVAKEL

SEQ ID NO: 18517 - protein, 767 aa, Cucumis sativus
MLKALPSGFLILLLLASVSAADNGFPRCNCDDEGSLWSIDSILECQRVSDFLIAVAYFSIPIELLYFVSCSNVPFKWVLFQFIAFIVLCGLTHLLNGWTYGPHSFQLMLALTVFKILTALVSCATAITLITLIPLLLKVKVREFMLKEKTWDLGREVGMILKQKEAGLHVRMLTQEIRKSLDRHTILYTTMFELSETLGLHYCAVWMPNESKTLMNLTHELKDRSFSNGYNVFIPISDSDVIKIKGSDGVNVLGPNSALVVANCGESDERGPAAAIRMPMLRVSNFKGGTPEIVPTYYAILVLVLPGGQPRSWNNQELEIIKVVADQVAVALSHAALLEESQLMRDKLAEQNRDLQQAKENALMASQARNSFQKVMSDGMRRPMHSIMGLLSMLQNENMNDDQRIILDAMVRTGNVVSTQIDDVMEHPIKDSARFPLELEMRSFRLHSMIKEAACLAKCLCAYKGFGFAFEVQRSLPDHVMGDERRVFQVLLHMVGSLLNDINQGGGYALFRVVAESGSQGRNDQRWGNWRQNSSDGDAFIRFEVGINKSNSQSEGSIPNMVSGDRRYASDGAEERLSFTICKKLVKLMQGNIWVIPNPQGFTRSMALVLRFQLRPSIAVAMPEPGESSEHPHSNSIFRGLQVILADADDMNRAVTRKMLEKLGCNVTAVSSGFECLTVMAPAGSSIQVVLLDLHMPELDGFEVTTRIRKFRSQNYRPVIIALTASAGEDWERCVQIGMNGVIRKPVQLQGIAHELRRALLQASKVV

SEQ ID NO: 18518 - protein, 723 aa, Desulfovibrio desulfuricans
ADNRPEKWVKGVCRYCGTGCGVLVGVKDGKAVAIQGNPNNHNAGLLCLKGSLLIPVLNSKERVTQPLVRRHKGGKLEPVSWDEALDLMASRFRSSIDMYGPNSVAWYGSGQCLTEESYVANKIFKGGFGTNNVDGNPRLCMASAVGGYVTSFGKDEPMGTYADIDQATCFFIIGSNTSEAHPVLFRRIARRKQVEPGVKIIVADPRRTNTSRIADMHVAFRPGTDLAFMHSMAWVIINEELDNPRFWQRYVNFMDAEGKPSDFEGYKAFLENYRPEKVAEICRVPVEQIYGAARAFAESAATMSLWCMGINQRVQGVFANNLIHNLHLITGQICRPGATSFSLTGQPNACGGVRDGGALSHLLPAGRAIPNAKHRAEMEKLWGLPEGRIAPEPGYHTVALFEALGRGDVKCMIICETNPAHTLPNLNKVHKAMSHPESFIVCIEAFPDAVTLEYADLVLPPAFWCERDGVYGCGERRYSLTEKAVDPPGQCRPTVNTLVEFARRAGVDPQLVNFRNAEDVWNEWRMVSKGTTYDFWGMTRERLRKESGLIWPCPSEDHPGTSLRYVRGQDPCVPADHPDRFFFYGKPDGRAVIWMRPAKGAAEEPDAEYPLYLTSMRVIDHWHTATMTGKVPELQKANPIAFVEINEEDAARTGIKHGDSVIVETRRDAMELPARVSDVCRPGLIAVPFFDPKKLVNKLFLDATDPVSREPEYKICAARVRKA

SEQ ID NO: 18519 - protein, 721 aa, Unknown
  Synechococcus sp. WH 8102
MQGQTQSISFDGREIRLTTGRFAPQAGGSVLVECGDTAVLVTATRSGGREGIDFLPLICDYEERLYAAGRIPGSYQRREGRPPERATLTARLIDRPMRPLFPAWLRDDLQVVATCLSLDERVPADVLAVTGASIATLLAGIPFNGPMAAVRVGLLGDDFVLNPSYREIERGDLDLIVAGTPDGVVMVEAGGNQLPEQDVIEAIDFGYEAICELIKAQEQLLKDLGIEQVKPETPTQDTTVPAYLEKQCTKAISEVLKKFDQTKDERDKALDAIKAEAAEAIAGLKEDDAIRVATASNSKLLGNSFKALTKTLMRQQILKDGKRVDGRALDEVRAISALAGVLPRRVHGSGLFQRGLTQVLSTATLGTPSDAQEMDDLHPSTEKLYLHHYNFPPYSVGETRPMRSPGRREIGHGALAERAILPVLPAKDTFPYVVRVVSEVLSSNGSTSMGSVCGSTLSLMDAGVPLKAPVSGAAMGLIKEGDDIRILTDIQGIEDFLGDMDFKVAGSEKGITALQMDMKITGLPVKTIAEAINQARPARLHILEKMLEAIDTPREGLSPHAPRLLSFRIDPELIGTVIGPGGRTIKGITERTNTKIDIEDSGIVTIASHDGAAADEAQKIIEGLTRKVNEGEVFSGSITRIIPIGAFVEILPGKEGMIHISQLSEARVEKVEDVVKVGDEVTVRVREIDNRGRINLTLRGVPQSGDGAGEEPQPTPVAPLS

SEQ ID NO: 18520 - protein, 418 aa, Thermococcus litoralis
VEQDPFEIAVKQLERAAQYMDISEEALEFLKRPQRIVEVSIPVEMDDGSVKVFTGFRVQYNWARGPTKGGIRWHPEETLSTVKALAAWMTWKTAVMDLPYGGGKGGVICNPKEMSDREKERLARGYVRAIYDVISPYTDIPAPDVYTNPQIMAWMMDEYETISRRKDPSFGVITGKPPSVGGIVARMDATARGASYTVREAAKALGMDLKGKTIAIQGYGNAGYYMAKIMSEEYGMKVVAVSDTKGGIYNPDGLNADEVLAWKKKTGSVKDFPGATNITNEELLELEVDVLAPSAIEEVITKKNADNIKAKIVAELANGPTTPEADEILYEKGILIIPDFLCNAGGVTVSYFEWVQNITGDYWTVEETRAKLDKKMTKAFWDVYNTHKEKNINMRDAAYVVAVSRVYQAMKDRGWIKK

SEQ ID NO: 18521 - protein, 125 aa, Glycine max
  misc_feature (99)..(99): Xaa can be any naturally occurring amino acid
ASSLISSPAVISVNPAGAGMVAPLTGLKCMAGFPTRKTNNDLPFIATNGGRVECMRVWPPVGKKKFETLSYLPYLDDARLAKEIKFLLRKGWIPCLEFXMEHCFSYREHSQSPGYYDGTYWTMRN

SEQ ID NO: 18522 - protein, 109 aa, Glycine max
LPNVLPLYICITGLNFNKPHGYYTYQSASAAITTDNAGITKTLPHSEINDYDFEPCGYSMNSDEGTGATTIHITPQDGFSHANLETVGTDFKQLNHNEMVNKVSACSLP

SEQ ID NO: 18523 - protein, 493 aa, Listeria innocua
MGKVMLIGAGPGDAQLLTVKGLAALQKADVIVYDRLVEPAMLQERKASCKLIYVGKEPLHHPIPQDEIEQILVREAATNELVVRLKAGDPYVFGRGGEEGETLHKAGIPFEVIPGITSAIGGLAYAGIPVTHRDFASSFHVITGHLKKRRDPLDWEALARLEGTLVFLMGMTNLPNICANLLANGQKPETGVAIVQWASRGKQLTVTGTLQTIEQKVAESGISSPALIVVGDVVSLRPQLNFFEEMPLFHTKVLLPRARAGKSMLAEKIRDLGGEVTMYPNIQVLDILPTKTKAELCETSELLFTSKEAVERFFDYLATLELDIRSLKNTHLTAIGKQTKEAFSEKGIIPDSFIKRRSTELILEHIARFQKNASNLIIGSVVDTAEVSAILSEVKTTEMMPLYDMRPVTERPFDLESFEQICFSSSRSVQNLLDVLTTEEKAILQTKTILSIGRFTSATLQSFGINEFEEAENATPESLIELIQKTKLEGVPQ

SEQ ID NO: 18524 - protein, 637 aa, Adiantum capillus-veneris
MACTIVWFRRDLRVEDNPALVAAVRAGTVVPLFIWTPEEEGQFLPGRVSRWWLKQSLIQLHQSLTSLGSPLIMRRAQSAISVLSQIIKQTGATQVFFNHLYDPVSLVRDHKVKQELLQAGVTVTTFNADLLYEPWEINDEQGRPFTTFAGFWSLCMDMAIEPEAPLLPPKRITKWPGIAATSPIEDLELENESEKGSNDLLARAWAPGWANADRALEAFVSGPLMEYASNRQKVDSATTSLLSPHLHYGELSVRKVFHSVRMKQVLWVKEGNADAEESVNLFLRSIGLREYSRYLCFNFPFTHERSLLSNLKFFPWRNDEGYFKVWRQGRTGYPLVDAGMRELWATGWLHNRIRVIVSSFFVKFLQLPWRWGMKYFWDTLLDADLESDVLGWQYISGSLPDGHELYRIDNPQLEGYRYDPCGEYVRRWLPELSRLPSEWIHHPWDAPPNVLRAAGIELGSNYPRPIVEVAAARERLEQALAEMMEKEAAATRAAFEGSLQGVGLEPSQADNMDIDRGPSDAPGRNLSDRSPHDQMVPSMFMETGRPAADGVGSHASERGANVQEAHDNGSAPVASREGGSCRRNWQPFKVGTVTPTLLRSHHLRTGITLSLPLQVYQLGRAIGHLIQLCIRMTLRYL

SEQ ID NO: 18525 - protein, 609 aa, Streptomyces aureofaciens
MCGIVGVVDYDAPAEHRRDLLQAMTDTMACRGPDAEGLWFGRAAGLGHRRLSVIDPEHGRQPMTAEHEGRGAAITFSGEIYNFRELRAELTSHGHRFRTSCDTEVVLRGYLQWGAALVERLNGMFAFAVWDEHSEELLLVRDRMGVKPLYYWPTAAGVRFGSEPKAVLADRTLSRRVGPDGLCEVLDMVKTPEAAVFSGLVEVRPGQLVRVGRGGVRRQTYWRLEAREHTDDLPTTIGTVRDLLADTVTRQLVSDVPLGTLLSGGLDSSAVTALAARSGPVRSFSVDFRGAADAFASDAVRREADAPYVRELAGHVGADHLEVLLDSPGLSDPAVRSAVLRATDLPPAYWGDMWPSLYLFFRAVRENVTVALSGEAADELFGGYRWFRNPLALRAATFPWLTPGSARYFGGSSLFQAGLLDKLDLDGYRAARYAEALAEVPVLPGESAPERRMREIGHLNLTRFVQTLLDRKDRMSMAVGLEVRVPFCDHRLVEYVFNVPWEMKSFDGREKSLLRAAVADLLPRSVVERVKTPYPATQDPGYEGALRAELAGVLADPDAPVLPLLDRERALAAAARPTGAVSRPYDRGSLELVLWLNSWLAEYEVTLDL

SEQ ID NO: 18526 - protein, 305 aa, Glycine max
MDRIKGPWSPEEDEALQKLVEKHGPRNWSLISKSIPGRSGKSCRLRWCNQLSPQVEHRAFTHEEDDTIIRAHARFGNKWATIARLLHGRTDNAIKNHWNSTLKRKCTSTMIDDDNTPPLKRSLSAGAAIPVSTGLYMNPPTPGSPSGSDVSESSVLVASSSHVFRPVPRTGAVLPPVETTTTLSSNDPPTSLSLSLPGVDSSEVSNRTTEPIHAAPPPPPQPQPQPLNTIPLLPMMTVPSVSPTGMAPFNFSAEFLAVMQEMIRKEVRSYMELHNQKNGMCFQAAVNDGFRNASVKRIGISRVDS

SEQ ID NO: 18527 - protein, 303 aa, Oryza sativa
MATAGDEQQQQAAAAQTAEVTEAAAKEVVSVEMPAPEGWTKKFTPQRGGRFEIVFVSPTGEEIKNKRQLSQYLKAHPGGPASSEFDWGTGDTPRRSARISEKVKAFDSPEGEKIPKRSRNSSGRKGKQEKKEATENEEAKDAEADKEAPSEDAPKETDVETKPAEEAKEAPSEDAPKDTDVEMKTAEDASKTADADTPAPAPAGTEKEDAKPAESEAAPPAPSEGGEKKEDAKPAEPEAAAAPPSNPTEPSAPKAAAAAPVENSADKGPHQDSQPPSAAAPAKESSPVNNGQLPAGASAVKCT

SEQ ID NO: 18528 - protein, 679 aa, Adiantum capillus-veneris
MAAHTIVAHTIVWFRRDLRIEDNPALVAAVRAGPVLPVFIWSPEEEGQFLPGRVSRWWLKQSLVHLNESLTILGAPLVMRRASNVLAALLEIKKATGATQVFYNHLYDPVSLVRDHRVKQGLSQAGIIVNSFNADLLYEPWEVNDDNGQAFTTFSGFWAKCMDMPAEPEAQILPPKRILKFPGPSLSCSIEDLDLEDELEKGSNALLARAWQPGWANADRALESFINGSLMEYAANRQKVDSATTSLLSPHLHYGEVSVRKIFHNVRMKQVLWVKEGRVEAEESVNLFLRSIGFREYSRYLSFNFPFTHERSLLYNLKFFPWRVDESYFKAWRQGRTGYPLVDAGMRELWATGWLHNQIRVIVSSFCVKFLQLPWRWGMKYFWDTLLDADLESDVLGWQYISGSLPDGHELDRIDNPQIEGYKFDPYGEYVRRWLPELSRLPTEWIHHPWDAPPSVLRAAGIELGSNYPRPIVEIAAARERLEQALAEMWANEAADKATLANGLEEGLGDTVEVQGMRNGFPANMDIDRGPGEKALLVRSPHDQMVPNVGVRRSTTGAVQGGAANQGSALQAVLREVPANGHVQAVQAQSQRMAAPPMAMQNGYDDTHSTAESTSARHWSLAIGLPVWSQYVPVCLHMRQDDSQVPLVPDLHHGVMSRRLPHAPPMVNFEATKTSSLSV

SEQ ID NO: 18529 - protein, 514 aa, Desulfovibrio desulfuricans
MNKRIVTTALALATLLGVALLSGCQDVSTELKAPKYKTGIAETETKMSAFKGQFPQQYASYMKNNEDRIMTDYKGSVPYHKNDNVNPLPKGFKHAQPYLKNLWLGYPFMYEYNETRGHTYAIDDFLNIDRINRFAADGKGNLPATCWNCKTPKMMEWVSQYGDKFWSMDVNEFRAKDKINAHDETIGCANCHDPATMELRLYSEPLKDWLKRSGKDWQKMSRNEKRTLVCAQCHVEYYFTHKDNGPAAKPVFPWDNGFNPEDMYQYYKGHGAKGPDGKPGPFVDWVHAASKVPMIKMQHPEYETFQDGPHGAAGVSCADCHMQYVREDGKKISSHWMTSPMKDPEMRACRQCHADKTGEYLRQRVLYTQQKTFDQLLKAQEMSVKAHEAVRLANAYEGHRAANYEALMAEAREMVRKGQLFWDYVSAENSVGFHNPAKALDTLMTSMECSQKAVDLATEATDFGIAPALAGDIKKLVPPILTLSRKLQQDPEFLKQNPWTRLLPALPKAEQVWE

SEQ ID NO: 18530 - protein, 88 aa, Hyacinthus orientalis
AMACPCAQVGELIGGSQREERLGVLVERIKEAGLPLEPYEWYLDLRRFGTVKHSGFGLGFERMIMFATGIDNIRDVIPFPRYPGRADL

SEQ ID NO: 18531 - protein, 469 aa, Bacillus anthracis
MENLQIGVVGVGVMGKSLALNFESKGYSVALYDISKEKVDETIEENRGKNLVGTHIVEEFVNSLESPRKILLMVNAGEITDKAIDSLVPHLDKGDILIDGGNTYFVDTIRRNKRLAEEGINFIGAGVSGGEEGALKGPSIMPGGQKDAYEKVKDMLENISAKVNNEPCCSYIGPNGAGHYVKMVHNGIEYGDMQLICEAYFFLKQTLDLTAEEFHEIFAEWNKGELNSYLIEITADIFKKKDEETGKPLVDVILDTAGQKGTGKWTSQSALDLGISLPIITESVFARCISALKEERVNASKVLSGPKDKTAIGVEKAELIEAVRQALYMSKICSYAQGFTQLKAASEEYNWNLDFGSISMLWRGGCIIRAAFLQNIKEAYETNTDLPNLLLDPYFKEIVESYQGGLRQIISMAVQQGIPIPAFSAAISYYDSYRTAKLPANLLQAQRDYFGAHTYKRVDKEGTFHTKWI

SEQ ID NO: 18532 - protein, 237 aa, Unknown
  Cichorium intybus x Cichorium endivia
GVCYGRVEGLSSQQDVVNLYKNNSITRMRIYQPNQAILQGLKGTNIELVIGIPNDALESLSNQNTANTWVRDNIQNYPDVRFRYVAVGNEVDPDNGNSQYVNFVLPAMQNVQNAINAASLGNQIKVSTATYSGLLGVSYPPGNGAFRDTVREFIEPIVEFLSENNSPMLVNIYPYFASIGNPNSNLPYALFTAPGTILSDNGRRYSNLFDAIIDAHYAAQASLGGENVEIVVSESGC

SEQ ID NO: 18533 - protein, 237 aa, Unknown
  Cichorium intybus x Cichorium endivia
GVCYGRVEGLSSQQDVVNLYKNNSITRMRIYQPNQAILQGLKGTNIELVIGIPNDALESLNSQNTANTWVRDNIQNYPDVRFRYVAVGNEVDPDNGNSQYVNFVLPAMQNVQNAINAASLGNQIEVSTATYSGLLGASYPPSNGAFRDTASEFIEPIVKFLSENNSPMLVNIYPYFASIGNPNSNLPYALFTAPGTILSDNGRRYSNLFDAIIDAHYAAQASLGGENVEIVVSESGC

SEQ ID NO: 18534 - protein, 323 aa, Unknown
  Candidatus Blochmannia floridanus
MPITTLKQHCKLLILGSGPAGYTAAIYASRANLNPTLITGLEHGGQLNTTTSIENWPGDPENLTGPQLMNRMKMHAINLNTKIINDHIIKVNFQKYPFHLYGGNTNEYTCDSLIISTGGSARYLGLPSETKYKGKGVSSCATCDGFFFNKQNVAVVGGGNTAIEESLYLSNIANQVYLIHRSMNFRAEKILMDRLMYKVNHENITVHTNCIVQEILGNEKEVTGINIQDKNHNKEHIINVQGVFIAIGHDPNTAIFNNQLTLNNHGYIHVKSGLDGSFTATSVNGIFAAGDVIDYHYRQAITAAGSGCMAAIDAERFLSNIQK

SEQ ID NO: 18535 - protein, 72 aa, Unknown
  Candidatus Blochmannia floridanus
MIKEDNIEMHGIVLDTLPNTMFRVQLENGHKITAHISGKIRKNYIRILTGDKVTVELTPYDLSKGRIIFRSR

SEQ ID NO: 18536 - protein, 494 aa, Cryptococcus neoformans
MLEDEDIAKTGLIYWSANGTTFTCPNPTEFSKVVLPRYFKHNNWQSFVRQLNMYSYVNDIYSTSTDPQAWEFRHSLFRRGEAHLLPSIKRKSSRPSAPDGSNTVTSPTDELPPSTSNPIKPVAGWMRDAVPVPYRMPSPPHIHGQPQRSATYPYSDGFATRKDDGRSPTRGMAWDPLPAVQRMPPPPDNQIPIRYHPDPNRPVLTTQRFYHPGYPESPLYGPAHSPSAETLLNQMSVLEDKVQKLTDVLNNDRIEHVRNNLDFTSYLLQMIGWAAGDQHTLSRQNADMRHKYEAFMASDALAIMASGGGRERSDSRDSTRERNARLGFEIPPFPGHPHPSITDLRLPQTAQSSSSAILSQRAAPRTSPRNSTSSDLLLTRPSTSESIREREIYPTYFPPQTSHGIGPASSIPSRGPETITPSLYGGGPSVPPPLYRPAPIVEKHREIEKGEEHKDMNGPSTVELGREERDNEDSRMTMAGEEAESKTGLRNLLN

SEQ ID NO: 18537 - protein, 369 aa, Acholeplasma laidlawii
MAKRDYYDVLGISKSASQDEIKKAYRSLAKKYHPDVSKEKDAETKFKEVQEAYDVLNDSNKKAQYDRFGHAGTGQDPFGGAGGGFGGFGGFDDIISQFFGGGQTRRTRQTSNVGEDLNMRMTIDFMEAVLGTTKNVSVDITQDCGHCHGSGAESSKDVHTCSKCHGQGFINVDQRTMFGTMRSQQVCPQCQGEGQTIDNKCHVCSGAGRVKAKKTVDVKVPAGVDNEMTLRVPGYGNGGRKGAESGDLYITFRVKPHKIFKRRGSDIILDVPITFTQAALGDKIDIPTIYGEVELTIPAGIQSGTELKLKNKGTKDPRTGKTGDQHVIVNIETPKNLSSEEKKLFEQLSKLDSPRKKSGWDKFKSFFTN

SEQ ID NO: 18538 - protein, 395 aa, Myxococcus xanthus
MLASDGKWNRLAPRQSLSGRLLLDLPLTPALRINLGKRAGVTGGLLGVLCVCVEFCFLFPHLLVSNDGRAFYVEHLGVFRGILQAAIVATFALGALSVLTLRSKAHGGIAMLLALVAMLLGGSQAEPLTHQPRALSAGLDYFALELLVLGLLFIPMERLWGLHPQRIFREGWQTDLKHFFVSHVGVQLISFSVMIPVQVFFSWAVRMDFQAHVAAQPVWLQFFEILLVVDLVSYWVHRAFHQVPWMWKFHAIHHSSQQMDWLASSRSHLVDVLVNRFAGFIPVFLLGFSPAAIYGYLVFVSFHAVYIHANVSHRWPYLRWVFATPEFHHWHHTSDEEGIDKNFAVFLSFIDVIFGTAHLPEHWPSRYGTTKFQPPETYLGQLAYPFQRHEETPYG

SEQ ID NO: 18539 - protein, 379 aa, Colwellia maris
MSKRDYYETLEVSQDASEKEIKKAYKKLAMKYHPDRTQGDKSKEETFKEVKEAYEILNDDQKRAAYDQYGHAAFEQGGHGGGGGGHGGGFGQDFGDIFGDIFGGGGGGGRGRQRQQRGSDLRYNVELSLEDAVKGKSLEIKVPTYVSCEPCDGSGAKKGTSAKTCSTCHGHGQVQMRQGLFAVQQTCPTCSGKGKVIADKCTSCRGQGRVEKTKTLSVKIPAGVDTGDRIRLSGEGEAGEHGAPAGDLYVQVNVRDHDIFVRDENHLYCEVPISFVTASLGGEIEVPTLGGKVKLKVPKETQTGKMFRLRGKGVKSVRSTSTGDLMCKVVIETPVNLSGDQADLLRQLEEKMASSSKKHSPKETGFFDGVKKFFDDLKS

SEQ ID NO: 18540 - protein, 848 aa, Unknown
  uncultured bacterium
MKIVIVGHGMVGHKFLESLAETGIQNAEVTVLCEEPRAAYDRVHLSEFFSGKTAEDLSLVEAGFFERTGYSLRLAARAASIDRRAHTVTTLDGEVLPYDKLVLATGSSAFVPPVPGRDRPNCFVYRTIEDLEAMTECGARSKTGVVVGGGLLGLECGKALVDLGLETHVVEFAPRLMTVQVDDGGGRVLRNKIEALGVQVHTSRNTVEITDGATARHRMVFADSTWLETDMIVFSAGIRPRDELARQCALAIGPRGGVVIDSECRTSDKNIYAIGECASWNEQTFGLVAPGYDMARVAAKHIAGITDAAFVGADMSTKLKLMGVDVASIGDAQGKTPNSRSYQFVDEVKQIYKKIVVSPDGKQLLGAVLVGNADEYGTLLQMALNGITLPESPEFLILPSSDGQAKPGLGVDALPDSAQICSCNSVTKGQICAAVCDGATDIGKLKACTKAGATCGGCVPLVTQVMKFEMKKQGMEVNNHVCEHFPYSRQELYHLVRVGEIKSFAALLDKHGHGLGCDICKPVAASVFASCWNDFVLKKELAGLQDSNDYFLGNIQKDGTYSVVPRMPGGEVTPDGLIAVGTVAKKYGLYTKVTGGARVDMFGARVEQLPLIWEELIAAGFESGHAYGKSLRTVKSCVGSTWCRYGVDDSVGLAVELENRYKGLRAPHKIKFGVSGCTRECAEAQGKDIGIIATEKGWNLYVCGNGGMKPRHAELFASDLSKEELIRLIDRVLMFYVRTADRLQRTSTWRDNMEGGLAYLQNVILNDSLGLNAELEAQMQHVVNTYQCEWKSAVNDPETRKRFRSFVNSDKLDEHVMFVQERGQIRPARPEERAEAAPSFAPTADSLA

SEQ ID NO: 18541 - protein, 343 aa, Arabidopsis thaliana
MEGDVGIGLVCQNTMDGKASNGNGLEKTVPSCCLKAMACVPEDDAKCHSTVVSGWFSEPHPRSGEAHSLKVEKVLFKDKSDFQEVLVFESATYGKVLVLDGIVQLTEKDECAYQEMIAHLPLCSISSPKNVLVVGGGDGGVLREISRHSSVEVIDICEIDKMVIDVSKKFFPELAVGFDDPRVQLHIGDAAEFLRKSPEGKYDAIIVDSSDPVGPALALVEKPFFETLARALKPGGVLCNMAESMWLHTHLIEDMISICRQTFKSVHYAWSSVPTYPSGVIGFVLCSTEGPAVDFKNPINPIEKLDGAMTHKRELKFYNSDMHRAAFALPTFLRREVASLLAS

SEQ ID NO: 18542 - protein, 432 aa, Nicotiana sp.
MAQILAPSGEWQMRMTKSSTDANPLTSKMWSSVVIKIIKELAVKSSAKFRVFALESDSGTVNQSEQLLNLDVTPYTDLIIAEYIWIGGSGIDMRSKSRTISKPVKHASELPKWNYDGSSTGQAPGEDSEVILYPQAIFKDPFRGGNNILVICDAYWPAGEPIPSNLRHKAAQIFSDSLVVSEVPWFEIEQEYTLLQQNVKWPLGWPVGGYPGTQGPYYLCAGADKSFGLDISDAHYKACLYAGINISGTNGEVMPGQWEFQVGPSVGIEAGDHIWCARYILERITGQAGVVLSLDPLPIEGDTNGAGCHTNYSTLSMREDGGFEVIKKANLNLSLRHLEHINAYGEGILEKLTGNHETASIDYFSWGVAFRGASIRVGADTEKQGKGYLEDRRPASNMDPYVVTGLLAQTTILWEPTLEAEALAAQKLALKV

SEQ ID NO: 18543 - protein, 463 aa, Trichodesmium erythraeum
MTKQRIAKILGSGQPDAKVTIQGWVRTKRELKEFAFVEVNDGSCLANLQVVLNPDLPNYQESLQQMNTGASVEMTGILVESPAKGQRIELKAESITAYGDADPETYPLQKKRHSFEFLRTIAHLRGRTNTYGAVFRVRNTCANAIHQFFQERGFLWVHTPIITASDCEGAGEMFTVTNLDLKKIPLTEKQDIDFSQDFFGKSAFLTVSGQLEAEIMATALSNVYTFGPTFRAENSNTSRHLAEFWMIEPEMAFCDLEGDMDLAEEFLKYIFKSVLEGCPEDMEFFNKRIDKTVFETADTIINNSFERITYTEAVSLLEKADKKFDYPVDWGLDLQSEHERYLCEELFKKPVIVTDYPAKIKAFYMRLNDDAKTVRAMDVLVPKVGEIIGGSQREERLDVLERRIDEQEMNKEELWWYLDLRRYGTVPHAGFGLGFERVVQFMTGMGNIRDVIPFPRAPLTVDF

SEQ ID NO: 18544 - protein, 557 aa, Gibberella zeae
MAPANTLPAWSDLQSHRDSVGKSFVLKEAFASDPQRFDKFTRTFTSGGVSSEILFDFSKNFLNDETLDLLVKLAEQAGVEKKRDAMFAGEKINFTEDRAVYHTALRNVGGWDMKVEGVDVMNTQGGVNDVLQHMKEFSEQVRSGEWKGYTGKKLTTIINIGIGGSDLGPVMVTEALKHYGADDMKLHFVSNIDGTHIAEALKESDPETTLFLIASKTFTTAETTTNANTAKKWFLEKTDNKGEIAKHFVALSTNEEEVTKFGIDSKNMFGFESWVGGRYSVWSAIGLSIALYVGFDNFHKFLSGAHAMDKHFRETPLKENIPILGGLLSVWYSDFFQAQTHLVAPFDQYLHRFPAYLQQLSMESNGKTITSDGSSAKYTTANQSGPILFGEPCTNAQHSFFQLVHQGTKLIPTDFILAAKSHNPVSDNLHQKMLASNYFAQAEALMVGKTDEQVRAEGAPEELVPHKRFLGNRPTTSILVGGAIGPAELGALIVYYEHLTFTEGAIWDINSFDQWGVELGKVLAKKILKELDEEGNGEGHDASTGGLIGAFKKYGQN

SEQ ID NO: 18545 - protein, 295 aa, Vibrio cholerae
MSDFPTLEDYVGQTPLVRLQRLNAGRSTVLVKLEGNNPAGSVKDRPALNMIVQAEARGSLQPGDTIIEATSGNTGIALAMAAAIKGYKMILIMPDNATQERKDSMRAYGAELILVSKEQGMEGARDLALQMQQEGKGKVLDQFNNLDNPDAHYRSTGPEIWQQSQGKITHFVSSMGTTGTIMGVSRYLKQQNPQIQIIGLQPSEGSAIPGIRRWPQAYLPGIFDAARVDQVLDVTQTDAEQTARALAREEGICAGVSSGGAVFAALQIAQQNPGSVVVAIVCDRGDRYLSSGLFS

SEQ ID NO: 18546 - protein, 371 aa, Campylobacter upsaliensis
MEISYYEILEITQSADKESIKKAYRKLALKYHPDRNQGDKEAEDKFKLINEAYEVLSDDEKRAIYDRYGKEALKGRAGGSAGFGDFEDIRDIFTSFFGEGFGGRKSRQKNNEDKFNADFVVGLNLSFKEAVFGCTKEIDFTYKNSCKTCNGSGAKDGKMQICPKCQGRGQIVMKQSFLSFAQTCPDCSGSGSCASDKCPQCKGLGYEELKDKVELKVPEGVDSGMNLRVSEKGNITKNGIRGDLFVKIHAEEDETFIRDDEDIYIEFPVFFTQAILGQSVKVPTIRGEATLNLPKGAKDGQRFVLENEGVKNVRSSHIGRQIVQIAIKFPNSLNEEQTKLLEQLSESFGIKDGMHHEQKGLFDKIATWFKG

SEQ ID NO: 18547 - protein, 266 aa, Xylella fastidiosa
MPQVTMRQMLEAGVHFGHQTRYRHPKMSPNIFGARGKIHIINLEKTVPLFNDAMNFLSAVAQKRGSVLFVGTKRSARDAIKEEAERCGMPYMIQRWLGGTLTNFRTVKQSVARLKELELAETDGTFSKLVKHEVLRLRRESGKLQASLGGIKDMNRIPDAIFVIDIGHEDIAIKEAKKLGIPVVAVVDTNYDPSLVDYPIPGNDDAIRAVQLYARAAADAVLEGKAAMPNAAAVREEEFASAPDAGKKGRQAQPKKGKRASDAAAE

SEQ ID NO: 18548 - protein, 182 aa, Brassica napus
  misc_feature (8)..(8): Xaa can be any naturally occurring amino acid
  misc_feature (112)..(112): Xaa can be any naturally occurring amino acid
  misc_feature (126)..(126): Xaa can be any naturally occurring amino acid
  misc_feature (148)..(148): Xaa can be any naturally occurring amino acid
MASSMLSXAAVVTSPAQATMVAPFTGLKSSAAFPVTRKANNDITSIASNGGRVSCMKVWPPVGKKKFETLSYLPDLTEVELGKEVDYLLRNKWIPCVEFELEHGFVYREHGXTPGYYDGRYWTMWXKLPLFGCTDSAQVLKEVQECKXEYPNAFIRIIGFDNNRQVQCISFIAYKPPSFTGA

SEQ ID NO: 18549 - protein, 491 aa, Desulfovibrio desulfuricans
MSTKAQSTSFDWKRLCFMLLGVTAFLVIYYSPAWPDAVDPLGERFPLSKEAKGALAVFMFAGLWWVFEVVPIGITSLGIGVLQVLFFVRPPEKAFKDFMDPSVLFIFASIMIGLVFTKTGLTKRLAYKMLMVVGEKTSRIYLGVFVVTALLTHIMAHTAVAATVYPLLLAIYALYDDTGSKTRFGKGLFIGMAYVAGAGSIITLLGAARGAVAVGFFKEIVGTEVSFFELTYYMAPIGWLMVFLLWGFFMIFCKPERDTIPGLREKARELNKQMGPLTRKEIMAALIVGIVILVMSLRSFFPMLKMLDKTAIILISSIAFFVFKILDIKDLEDVPWNIILLFAGAMSIGYCLWETGAAKWLAVNWLVMFEKAHWFVFVMSICFFVLMMTNFIMNVAAIAISLPVALVIAPYLGVSPEVILFGALVVAGMPFLLLVGAAPNAIAYDSGQFTSGEFFKYGLVASALLLVVVGVFVLVVWPLMGMPITVPRVGM

SEQ ID NO: 18550 - protein, 594 aa, Schizosaccharomyces pombe
MTSFTESKKLDEIESPVPEIIVPSTTNGNGTIESYKEKSVGTSFLDFFRSYKLRPDNEFAEVHNSEDFLKPRHLQMIAIGSCIGTGLFVSTGKSLKNAGPGSLMINFIILSAMILALILSLGEMCCFLPNQSSITMYTGRLLNNNIGFAQSWLYFWIWLTVLPSEISAACEVVDFWTTQHLNPAIWVTIFLAYVVLVNAFGARSYGECEFVSSFLKVVIVIIFFFVAIIINCGAAPKGGYIGAHYWHHPGSFRNGFKGFCSVFISSAYSLSGTENIGTAAGNTSNPQRAIPSAVKKVFYRMGFFYIITIFLITLVVPYDNPDLGNVSPFIIAIKNGGIHVLPHITNAVILVSVLSVGNAAVFAASRNAMALVKQGWAPRFLGRVDQKGRPVISYLCSLAMACIAYVNAAPDGSVVFDWLMSVSGGGAFVIWGLSFIDHIRLRYAMKAQKIPDTVLPYKFPGSVYLSYYGVLINFLALCALVYISIFPVTHEKPSAYGFFVSFLGPSVFIAYLLISPIFVKPTFQSLKDVDLTTGRYDLVNSQMYVAESSTSELSEKDLTKPNLQSNDNKNSEDLESNTPPQKKSALQKVADFLC

SEQ ID NO: 18551 - protein, 956 aa, Solanum lycopersicum
  misc_feature (918)..(918): Xaa can be any naturally occurring amino acid
  misc_feature (948)..(948): Xaa can be any naturally occurring amino acid
MEKLDRRRSHYQKYYPRNRGKNRANRNSPNPSNENEQIATSWMAIAPASTKLASPIYSKINYRWRRRFNSKAAVDEVGAAAQRAAEWGLVLKTDDETGKLQGVKVRTSGDDTNGKTETSRRDSGNSGRSSGEFSDDGAGKERGIPRVSEDLRDALSTFQQTFVVSDATKPDYPILYASAGFFKMTGYTSKEVIGRNCRFMQGSGTDPEDVATIREALQSGSTYCGRLLNYKKGGTPFWNLLTIAPIKDDAGKVLKFIGMQVEVSKHTEGSKEKTVRPNGLPESLIRYDVRQKEMASNSVNELLEEIKNPRRARALSESTNNRPTFMRKSEGDQVEQDKQDTHKLNLVNKAPARRHSHAGTRTTTMKMEKINEVPEKKPKKSARLSFMGIMKKKRSSTTMTTDDDDFEARMTMDNDDDDDDESDNDGRPVSVDDKVRKKEMRKGIDLATTLERIEKNFVITDPRLPDNPIIFASDSFLELTEYSREEILGRNCRFLQGPETDPATVKKIRQAIDNQTDVTVQLINYTKTGKKFWNLFHLQPMRDQKGEVQYFIGVQLDGSQHVEPLQNSIPEDKATESAKLIKETAGNVDEAVRELPDANSKPEDLWRNHSKVVQPKPHRKDSPSWKAIQKILESGEPIGLKHFKPIKPLGSGDTGSVHLVELCGTDQHFAMKAMDKSIMLNRNKVHRACAEREILDMLDHPFLPALYASFQTKTHICLITDYYPGGELFMLLDRQQTKVLKEDAARFYAAEVVVALEYLHCQGIIYRDLKPENVLLQSGGHVSLTDFDLSCLTSCKPQLLVPEINEKKKHQKGQHNPIFMAEPMRASNSFVGTEEYIAPEIITGAGHTSAVDWWALGILLYEMLYGYTPFRGKTRQKTFSNILHKDLKFPGSIQSSLHAKQLMYRLLHRDPKNRLGSXEGANEIKQHPFFRGVNWALIRCMNPPKLDXAPFLGTVI

SEQ ID NO: 18552 - protein, 718 aa, Adiantum capillus-veneris
MAKSCTVVWFRRDLRLEDNPALAAAARAGAVVPVFIWSPDEEGQFRPGRVSRWWLKQSLIQLDISLRSLGVSLVMINANDTVSALLELVKTTGASQVVYNHLYDPVSLVRDHRVKQSLVQNGIQVQSFNGDLLYEPWEVLDDHGKPFTYFESYWAKCLTMPFEPESPLLPPRRLTAAPAGIVHSLTPDELGLEDEADKSSNALLARAWAPGWSNADKALEAFLAGPFLNYSRNRHEIDGPTTSLLSPHLHFGEVSVRKVFHSVRRLQVLWAKDGSMLGEESINYFMRSIGFREYSRYLCFNFPFTHERSLLSNLKSFPWRVDEGLFKAWRQGRTGYPLVDAGMRELWATGWLHNRVRVIVSSFCVKFLQLPWRWGMKYFWDTLLDADLESDILGWQYISGSLPDGHELDRMDNPQTEGYKHDPLGEYVRRWLPELVRLPTEWIHHPWDAPPGVLRAAGVELGSNYPRPVVEVAAARERLRDAVTHMWEQEAALKAAGDKGIEEASVGDSIAKVNCQPEVAAQPCKIPKASVSQATNGDMEVSSAGSSRRDQMVPTFAKELKTQADALCGDYGSIALPLPSQQNLPCPSTNFSAIRGVSKLSPGNRGDMVDTTEALRNTHSEPLPPVSDTNPMTESSSSSSPREQISSIKDDPPMIWVPAIAHQRPSSDFGCVPYAGDAEQLRKHLLILQNARTDDKVEDGVQLNGSQWARGSKRKAKS

SEQ ID NO: 18553 - protein, 474 aa, Unknown
  Oceanospirillum sp. MED92
MDYLPLFFKLTGQNVLLVGGGNVALRKARLLCRSGALVTVISHKVCEELQDLLDENQGQSIIGEYHSALLEGKMLVIAATDDNPLNERVHFDAVERNIPVNVVDSPKLCTFVFPAIVDRSPIVIGISSGGSAPVLARLLRARLETWIPKSYGKLASIANHFRDRVKQTFDTVNHRRVFWENVLQGQIAEKVFAGREQEAIDLIEDKLTNEDPDHSVGEVYLVGGGPGDPELLTFKALRLMQQADVVLYDALVSDAVLDLCRRDADLIFVGKKRDNHAVPQEGINELLVKHAKAGQRVVRLKGGDPFIFGRGGEELQTLKAHDIPFQVVPGITAASACSTYAGIPLTHRNYAQSVKFVTGQLKNRTSDLNFAELVHPNQTVVFYMGLHTLPTLCAKMIEHGKPANTPTAIVSRGTSADQKVLTGTLENIAERQAQAKLPAPALIIVGEVVEMHDNLSWFGDEVLAQNLTPVKAEP

SEQ ID NO: 18554 - protein, 585 aa, Thermoactinomyces vulgaris
MLLEAIFHEAKGSYAYPISETQLRVRLRAKKGDVVRCEVLYADRYASPEEELAHALAGKAGSDERFDYFEALLECSTKRVKYVFLLTGPQGEAVYFGETGFSAERSKAGVFQYAYIHRSEVFTTPEWAKEAVIYQIFPERFANGDPSNDPPGTEQWAKDARPRHDSFYGGDLKGVIDRLPYLEELGVTALYFTPIFASPSHHKYDTADYLAIDPQFGDLPTFRRLVDEAHRRGIKIILDAVFNHAGDQFFAFRDVLQKGEQSRYKDWFFIEDFPVSKTSRTNYETFAVQVPAMPKLRTENPEVKEYLFDVARFWMEQGIDGWRLDVANEVDHAFWREFRRLVKSLNPDALIVGEIWHDASGWLMGDQFDSVMNYLFRESVIRFFATGEIHAERFDAELTRARMLYPEQAAQGLWNLLDSHDTERFLTSCGGNEAKFRLAVLFQMTYLGTPLIYYGDEIGMAGATDPDCRRPMIWEEKEQNRGLFEFYKELIRLRHRLASLTRGNVRSWHADKQANLYAFVRTVQDQHVGVVLNNRGEKQTVLLQVPESGGKTWLDCLTGEEVHGKQGQLKLTLRPYQGMILWNGR

SEQ ID NO: 18555 - protein, 113 aa, Xylella fastidiosa
MSDYVLHVSDANFDAMVLLSDQPVLVDFWAKWCGPCKIISTLLDDLAQSYEGRLKIAKVDIDENRALAIKYHVCSIPMLLLFKDGQVQITQIGAVGKGRLTQMIDKVLANTDS

SEQ ID NO: 18556 - protein, 632 aa, Arabidopsis thaliana
MVAFLSAWPWENFGNLKYLLYAPLAAQVVYSWVYEEDISKVLWCIHILIICGLKALVHELWSVFNNMLFVTRTLRINPKGIDFKQIDHEWHWDNYIILQAIIVSLICYMSPPLMMMINSLPLWNTKGLIALIVLHVTFSEPLYYFLHRSFHRNNYFFTHYHSFHHSSPVPHPMTAGNATLLENIILCVVAGVPLIGCCLFGVGSLSAIYGYAVMFDFMRCLGHCNVEIFSHKLFEILPVLRYLIYTPTYHSLHHQEMGTNFCLFMPLFDVLGDTQNPNSWELQKKIRLSAGERKRVPEFVFLAHGVDVMSAMHAPFVFRSFASMPYTTRIFLLPMWPFTFCVMLGMWAWSKTFLFSFYTLRNNLCQTWGVPRFGFQYFLPFATKGINDQIEAAILRADKIGVKVISLAALNKNEALNGGGTLFVNKHPDLRVRVVHGNTLTAAVILYEIPKDVNEVFLTGATSKLGRAIALYLCRRGVRVLMLTLSMERFQKIQKEAPVEFQNNLVQVTKYNAAQHCKTWIVGKWLTPREQSWAPAGTHFHQFVVPPILKFRRNCTYGDLAAMKLPKDVEGLGTCEYTMERGVVHACHAGGVVHMLEGWKHHEVGAIDVDRIDLVWEAAMKYGLSAVSSLTN

SEQ ID NO: 18557 - protein, 595 aa, Pseudomonas putida
MCGLAGELRFTPIDQAPRPADLAAVERITHHLAPRGPDAWGFHSQGPIALGHRRLKIMDLSDGSAQPMVDNTLGLSLAFNGAIYNFPELRQELQDLGYSFWSDGDTEVLLKGYHAWGAALLPKLNGMFALAIWERDNQRLFLARDRLGVKPLYLSRNGERLRFASTLPALLKGGDIDPMLDPVALNHYLNFHAVVPAPRTLLANVQKLEPGTWMRIDRHGEVERQTWWQLQYGANPDERDLDLEGWTTRVLDATRDAVAIRQRAAVDVGVLLSGGVDSSLLVGLLREVGVDDLSTFSIGFEDAGGERGDEFQYSDLIAKHYGTRHHQLRIAEHEIIDQLPAAFRAMSEPMVSHDCIAFYLLSREVAKHCKGVQSGQGADELFAGYHWYPQVAGAEDAFAAYRDAFFDRSHAEYRDTVQAPWLLETDAAGDFVREHFARPGARDAVDKALRLDSTVMLVDDPVKRVDNMTMAWGLEARTPFLDYRLVELSARIPARFKLPDGGKQVLKQAARRVIPHEVIDRKKGYFPVPGLKHLEGATLGWVRELLTDPSQDRGLFNPAMLDRLLSNPHGQLTPLRGSKLWQLAALNLWLSEQGI

SEQ ID NO: 18558 - protein, 417 aa, Pseudomonas syringae
MFSKQDQIQGYDDALLSAMNAEEQRQEDHIELIASENYTSKRVMQAQGSGLTNKYAEGYPGKRYYGGCEHVDKVEQLAIERARQLFGADYANVQPHSGSQANAAVYLALLQAGDTVLGMSLAHGGHLTHGAKVSFSGKLYNAVQYGIDTTTGLIDYDEVERIAVECQPKMLIAGFSAYSKTLDFPRFRAIADKVGAYLFVDMAHVAGLVAAGLYPNPLPYADVVTTTTHKTLRGPRGGLILAKANEELEKKFNSAVFPGGQGGPLMHVIAAKAVCFKEAMEPGFKTYQQQVIDNAQAMAQVFITRGFDVVSGGTDNHLFLVSLIRQGLTGKEADAALGRAHITVNKNSVPNDPQSPFVTSGLRIGTPAVTTRGFKVTQCIELAGWICDILDNLGAADVEANVASQVAALCADFPVYR

SEQ ID NO: 18559 - protein, 140 aa, Thermus thermophilus
MVVTCPKCGAKNRLGTPPPGQVPVCGACKTPLPWVVEADEKGFAQEVAGAPLTLVDFFAPWCGPCRLVSPILEELAREHAGRLKVVKVNVDEHPGLAARYGVRSVPTLVLFRRGAPVATWVGASPKRVLEERLRPYLEGR

SEQ ID NO: 18560 - protein, 88 aa, Methylobacillus flagellatus
MAKEELIEMQGKVDEILPDSRFRVTLDNGHILVAYTGGKMRKNHIRILAGDKVTVEMSPYDLAKGRIIFRHIEASSSRPFKPAKRFAR

SEQ ID NO: 18561 - protein, 334 aa, Hordeum vulgare
MAGQGVASMLALALLLGAFASIPQSVESIGVCYGMSANNLPAASTVVNMFKSNGINSMRLYAPDQAALQAVGGTGVNVVVGAPNDVLSNLAASPAAAASWVRSNIQAYPKVSFRYVCVGNEVAGGATQNLVPAMKNVQGALASAGLGHIKVTTSVSQAILGVYSPPSAGSFTGEADAFMGPVVQFLARTGAPLMANIYPYLAWAYNPSAMDMSYALFTASGTVVQDGSYGYQNLFDTTVDAFYTAMAKHGGSNVKLVVSESGWPSAGGTAATPANARIYNQYLINHVGRGTPRHPGAIETYVFSMFNENQKDNGVEQNWGLFYPNMQHVYPISF

SEQ ID NO: 18562 - protein, 275 aa, Arabidopsis thaliana
MIKLLFTYICTYTYKLYALYHMDYACVCMYKYKGIVTLQVCLFYIKLRVFLSNFTFSSSILALKNPNNSLIKIMAILPENSSNLDLTISVPGFSSSPLSDEGSGGGRDQLRLDMNRLPSSEDGDDEEFSHDDGSAPPRKKLRLTREQSRLLEDSFRQNHTLNPKQKEVLAKHLMLRPRQIEVWFQNRRARSKLKQTEMECEYLKRWFGSLTEENHRLHREVEELRAMKVGPTTVNSASSLTMCPRCERVTPAASPSRAVVPVPAKKTFPPQERDR

SEQ ID NO: 18563 - protein, 374 aa, Bacteroides thetaiotaomicron
MKKKILFIDRDGTLVIEPPIDYQLDSLEKLEFYPRVFRNLGFIRSKLDFEFVMVTNQDGLGTSSFPEDTFWPAHNLMLKTLAGEGITFDDILIDRSFPEDNAPTRKPRTGMLTKYIDNPEYDLAESFVIGDRPTDVELAKNLGCRAIYLQEATDDLKEKGLEEVCALATTDWDQVAEFLFAGERKAEVRRTTKETDIYVSLNLDGNGGCDISTGLGFFDHMLEQIGKHSGMDLTIRVKGDLEVDEHHTIEDTAIALGECIYQALGSKRGIERYGYALPMDDCLCQVCLDFGGRPWLVWDAEFNREKIGEMPTEMFLHFFKSLSDAAKMNLNIKAEGQNEHHKIEGIFKALARALKMALKRDIYHFELPSSKGVL

SEQ ID NO: 18564 - protein, 611 aa, Clostridium thermocellum
MRKNLFAKRAVAFLLGIVITAAGIVSFNTVSTSAAGEYNYAKALQYSMFFYDANMCGTGVDENSLLSWRGDCHVYDARLPLDSQNTNMSDGFISSNRSVLDPDGDGKVDVSGGFHDAGDHVKFGLPEAYAASTVGWGYYEFKDQFRATGQAVHAEVILRYFNDYFMRCTFRDASGNVVAFCHQVGDGDIDHAFWGAPENDTMFRRGWFITKEKPGTDIISATAASLAINYMNFKDTDPQYAAKSLDYAKALFDFAEKNPKGVVQGEDGPKGYYGSSKWQDDYCWAAAWLYLATQNEHYLDEAFKYYDYYAPPGWIHCWNDVWSGTACILAEINDLYDKDSQNFEDRYKRASNKNQWEQIDFWKPIQDLLDKWSGGGITVTPGGYVFLNQWGSARYNTAAQLIALVYDKHHGDTPSKYANWARSQMDYLLGKNPLNRCYVVGYSSNSVKYPHHRAASGLKDANDSSPHKYVLYGALVGGPDASDQHVDRTNDYIYNEVAIDYNAAFVGACAGLYRFFGDSSMQIDPSMPSHNVPVPPTPTPPDTQIVYGDLNGDQKVTSTDYTMLKRYLMKSIDRFNTSEQAADLNRDGKINSTDLTILKRYLLYSIPSLPI

SEQ ID NO: 18565 - protein, 438 aa, Glycine max
  misc_feature (149)..(149): Xaa can be any naturally occurring amino acid
  misc_feature (204)..(204): Xaa can be any naturally occurring amino acid
MAITPFSSTSAAQWGIHPQLLLRSSITGKVASSSHNSTGRVSFMAATSSSFFSQDSTLLNVGAPQTFNHRKGSRLIVRANADYYSVLGVSRNASKSEIKSAYRKLARNYHPDVNKEPGAEQKFKEISNAYEVLSDDEKRSIYDRFGEAXGLKGSGMGMGDFSNPFDLFESLFEGMNRGAGSKSSWNGAIDGEDEYYSLGLNFKXAVFGIEKEIEISRLESCGTCNGSGAKPGTTPSRCSTCGGQGRVVSSTRTPLGIFQQSMTCSSCNGTGEISTPCNTCSGDGRVRKSKRISLKVPAGVDSGSRLRVRNEGNAGRRGGSPGDLFVVIEVIPDPILKRDDTNILYTCKVSYIDAILGTTIKVPTVDGTVDLKIPAGTQPNTTLVMAKKGVPFLNKDNMRGDQLVRVQVEIPKRLSNDERKLIEELADLSKGKTATGRR

SEQ ID NO: 18566 - protein, 379 aa, Lactococcus lactis
MNNTEYYERLGVDKNASQDEIKKAYRKMSKKYHPDLNKEEGAEDKYKEVQEAYETLSDEQKRAAYDQYGEAGRNGGFGGGGFGGASGFSGFGGRSGGFGGFEDIFSSFFGGGGAQVNPNAPRQGDDLQYRINLKFEEAIFGVEKQVKYNREELCHTCGGSGAKAGTHPETCHKCGGRGQINVVRDTPLGRMQTQTTCDVCHGTGKEIKEKSTTCHGSGHEKVAHTVKVTVPAGVETGQKMRLQGQGDAGVNGGPYGDLYVVFQVEASDKFERDGAEIYYKMPMDFVQAALGDEVEVPTVHGNVKLKIPAGTQTGANFRLKGKGAPKLRGSGNGDQYVIINIVTPKNMNQAQKEALQAFAKASGIEVSGSGQKGFFDKFK

SEQ ID NO: 18567 - protein, 130 aa, Methanosarcina mazei
MEEKSVKEITAIIRMNRVQKTKDVLLECGFPSFTVRRVMGRGKQKGLCFEFNPPLPEPEKEAETCIHFIPKRMFTIVVDDENVNEVVRKIIEVNQTGHPGDGKIFVSSISEAYRIRTGESGEATVNKEMV

SEQ ID NO: 18568 - protein, 372 aa, Pasteurella multocida
MAKKDYYDVLGVERGADEKEIKRAYKKLAMKYHPDRTQGNKELEEKFKEIQEAYEVLSDKQKRANYDQYGHAAFEQGGFGGGGFSGADFGDIFGDMFGDIFGGGRARQRVVRGDDLRYDLEISLEEAVRGTTKDIQINTLAHCDSCDGSGAEKGSKVETCSTCHGAGRVRRQQGFFVTEQVCPSCHGSGKKIEKPCKSCHGDGRVHKKKNLSVKIPAGVDTGNQLRLSGEGAAGENGAPNGDLYVVIHVRDHHIFERDGSNLYCEVPISFTMAALGGEIEVPTLDGRVKLKIPAETQTGKLFRMRGKGVTSARSAYAGDLICKIIVETPVKLNEEQKALLRQLEESLEGSSNKPKSSSFFDGVKKFFDNLGK

SEQ ID NO: 18569 - protein, 563 aa, Geobacter metallireducens
MRILLVSRPHPEGARDPFTSLLPTGLGYLNAVLRENGFTSSLANLSTASWRQVEELLRRERPAILGISVFTHNRFESLRLAALAKKVDPTCLTIFGGPHATHAFESILVKYREVDGVILGEGEETFLDLARAVERGDRSLTGIVGLAYRKGAKVHSVKRPPVADLDVLPLPALHMNDAWGCDVRRQLEFIITSRGCPAACRFCSSPRFWGKSLRFRSPRAMVDEIRAIRDRYGLIYFSLRDDTFTVRKDRVIDFCRLLLEEKVHILWNCQSRVNAVDEEMLIWMRRAGCECVQYGVESGSEKILAYLGKQITPEQVRRAAKATRRAGISLSIYLISGVPGETDDDLQATLTLISNILPHDGHVAPLAYYPGTALFDEAVREGRVGADLFERERGAALYVRRDPFVARSMETLLRALTRVERKARFGPADFTAQREFLGYCHGTNLGQGEWLEAKGDIGKAEALYREIVERQPENPWGWLALGGLHGSRGDVTRAGKAFERAISLVPAHVPAYLALGDLRLEEGDQRGAKQLYETAKRLNPRDTDVGERLRMVVAERGTKKGDT

SEQ ID NO: 18570 - protein, 289 aa, Fulvimarina pelagi
MAGESTIHVTCAQFEPRIGEIEGNRETSIALVSEAADNGADLVVLPELCQSGYVIESRSEAYALAETVPGGPTIEAWAALAQERKIHIVAGFLERDDDRLYNSAVVVGPGGILGTYRKNHLWDEEALFFERGNRNFPIFHTPFGRLGVLICYDGWFPEAWRLLAIAGADIVCVPTNWVPMPGQPDGLPAMANLLCMSAAHVNSFVVAACDRVGLERGQPFIGQSLIVDHTGWPVAGPASVDEPAMISAEINLGEARRKRNWNDFNQIVRDRRTDLYGEMLGHAATPDWH

SEQ ID NO: 18571 - protein, 90 aa, Zea mays
  misc_feature (74)..(74): Xaa can be any naturally occurring amino acid
KELSNKVNKNTTDYNNYNKIYKTIGQPVENELKEQLKENVLLNHLQKILNSNSTGNGETSDYSVNCQKIKLKQXLAYECQKQYRSIEWSM

SEQ ID NO: 18572 - protein, 370 aa, Nicotiana plumbaginifolia
MDTSHKHIALQMAAIILLGLLVSSTEIVGAQSVGVCYGMLGNNLPPASQVVQLYKSKNIRRMRLYDPNQAALQALRGSNIEVMLGVPNSDLQNIAANPSNANNWVQRNVRNFWPAVKFRYIAVGNEVSPVTGTSSLTRYLLPAMRNIRNAISSAGLQNNIKVSSSVDMTLIGNSFPPSQGSFRNDVRSFIDPIIGFVRRINSPLLVNIYPYFSYAGNPRDISLPYALFTAPNVVVQDGSLGYRNLFDAMSDAVYAALSRAGGGSIEIVVSESGWPSAGAFAATTNNAATYYKNLIQHVKRGSPRRPNKVIETYLFAMFDENNKNPELEKHFGLFSPNKQPKYPLSFGFSDRYWDISAENNATAASLISEM

SEQ ID NO: 18573 - protein, 203 aa, Catharanthus roseus
MSEEIISVSDRFLLSLIEEHLLSDNSDDSSSELTSTEENWEEIFADFLNWSGSEIQKRGSPSSESCQSNSMAESCQEDSVVGTPPEAAAGGGCSKDWNRYKGVRRRPWGKFAAEIRDPKKKGSRIWLGTYETPEDAALAYDAAAFNMRGAKARLNFPHLIGSNISGPVRVNPRKRFPAEPSTTSSSSSSSSSENSGGRKKRRY

SEQ ID NO: 18574 - protein, 253 aa, Prochlorococcus marinus
MLIQDTIFYRPDWRWHNFLKYLTNNLSKYNCLEKTIPSEYSYKDSTYGSKKSKKNVNLSTWGVTHKKRIKFARAVCINSPNYSVLNFLIIPNTIYNVPFFGVDFVSLPNSYLLVLDFQPSLKIQNQYNNDLLEKLIKLKNHCHSSLPLAEKMSADVARFFSPGVIWSKLPKEERSDFLITNQLYTSFKEYLDLYLEILFESKEVNIELQKELTNGQINYLNYRRDNDPARPMLSSLFGQEFTESLIEEVLFTT

SEQ ID NO: 18575 - protein, 421 aa, Saccharomyces cerevisiae
KIKDPKILGIDPNVTQYTGYLDVEDEDKHFFFWTFESRNDPAKDPVILWLNGGPGCSSLTGLFFALGPSSIGPDLKPIGNPYSWNSNATVIFLDQPVNVGFSYSGSSGVSNTVAAGKDVYNFLELFFDQFPEYVNKGQDFHIAGASYAGHYIPVFASEILSHKDRNFNLTSVLIGNGLTDPLTQYNYYEPMACGEGGEPSVLPSEECSAMEDSLERCLGLIESCYDSQSVWSCVPATIYCNNAQLAPYQRTGRNVYDIRKDCEGGNLCYPTLQDIDDYLNQDYVKEAVGAEVDHYESCNFDINRNFLFAGDWMKPYHTAVTDLLNQDLPILVYAGDKDFICNWLGNKAWTDVLPWKYDEEFASQKVRNWTASITDEVAGEVKSYKHFTYLRVFNGGHMVPFDVPENALSMVNEWIHGGFSL

SEQ ID NO: 18576 - protein, 173 aa, Pseudomonas putida
MSLNDLNTLPGVTAQADPATAQFVFNHTMLRVKDIEKSLDFYTRVLGFKLVDKRDFVEAKFSLYFLALVDPATIPADDDARHQWMKSIPGVLELTHNHGTERDADFAYHHGNTDPRGFGHICVSVPDVVAACERFEALQVPFQKRLSDGRMNHLAFIKDPDGYWVEVIQPTPL

SEQ ID NO: 18577 - protein, 420 aa, Wolinella succinogenes
MLEFQHFFTASFSDEEREALLGRVKKEREEGVSAYYDLPFQRRALEDSDRYMKANAALLERLETILVVGVGGSSLGLKAIDSLLSHLPERRAIDLHFLEHTDPIAIEKSLRGIQTKSSLFIVISKSGSTIETSSLTKYVLKRFELLKEENRSHLLVITDEGSPLEQWSKQEDVACVTIHPKVGGRFSVLSAVGILPLSLLGYPANEILEGAKGMAVEFFAGRATQILDKALFYAKERNRLSINVLFSYASAFKEFNAWYVQLWGESLGKLNAQGNRTGMTPAALIGSIDQHSFLQLIVQGPLDKSVTFLSIKEPLKEPIEIPNWSMEFLEGTDFVNGSSFKDLLRHQREATMETVIEEGVPTDLILIDRLEGRSVGALLYYYELLTSCVGTLLEINTYDQPGVEFGKRRLREKFHSKDTL

SEQ ID NO: 18578 - protein, 319 aa, Wolinella succinogenes
MRIGLVCSGGDCAGMNPATKKFVEYSLELGYEPYFIREGLEGLIEGKIEPATLKEVSGILHKGGTILQSSRSKRFFDPAFRLQAYQNLQRHSIEALVTLGGDGSFRAMEVLAKEHSLLYAGIPATIDNDIRASDYALGVDSALNVILESTDRLRDTAESFRRAFVVEVMGRDCGYLALASAIACGAEVCIIPEMGYSLQSLGARLKEELGTGKRRYVLAIVSEGAKASSEVVSWLKEEVGIETRITILGHVQRGGSPSVYDRLMGFRFMQKALDSLSLGKSGVVVLREGRVEFLSSQEASSAPASLPLDMVRLASRLMF

SEQ ID NO: 18579 - protein, 331 aa, Rhizobium tropici
SAFRKLAMQFHPDKNPDDSNAERKFKEINEAYETLKDPQKRAAYDRYGHAAFEHGGMGGGGGFGAGFGGGGFSDIFEDIFGEMMGGGRARGRSSGGRERGADLRYNMEISLEEAFSGKTAQIRVPTSITCDVCSGSGAKPGTQPKTCGTCQGSGRVRAAQGFFSVERTCPTCHGRGQIIPDPCTKCHGQGRVTEERSLSVNIPAGIEDGTRIRLQGEGEAGLRGGPSGDLYIFLSVKPHEFFQRDGADLYCAVPISMTTAALGGTFDVATLDGTKSRVSVPEGTQVGKQFRLKGKGMPVLRSSQVGDLYIQIQIETPQKLTKRQRELLQEF

SEQ ID NO: 18580 - protein, 934 aa, Nocardia farcinica
MTRSFADRHIGPDAAELSRILEVVGVDSLDALAAAALPASILDDAGAGPLAALPPAVSEHEALAELAALAQSNTVTTSMIGLGYYDTLTPPVLVRNLLENPAWYTAYTPYQPEISQGRLEALLNFQTMVSDLTGMEVANASMLDEATAAAEAMTLLRRAGRSRSNRLLIDADLFPQTRTVLHTRAEPLGIEIVEADLAAAGLPEGGFFGVIVQVPGASGRVVDWTALIAAAHERGALVAAGADLLAMTLIVPPGEQGADVCFGTTQRFGVPMGFGGPHAGYLAVRSAHARQLPGRLVGVSKDADGNPAYRLALQTREQHIRREKATSNICTAQVLLAIVAAMYACYHGADGLRAIARRVHGHAARIAGALGEALVHDTYFDTVLARVPGHAEAVVAKAAACGITLRLVDPDHVAVACDEATTDAHVEAVLDAFGVAPAEPVDAGIATRTSEFLTHPAFTRYRTETAMLRYLRSLSDKDIALDRSMIPLGSCTMKLNATAEMEPITWPGFAKLHPYAPVEHAPGLLKLIGDLESWLAEITGYDAVSLQPNAGSQGEYAGLLAIRRYHLDRGDTHRDTCLIPSSAHGTNAASAAMAGLRVEVVKCRENGDVDLDDLRAKITDHAERLACIMITYPSTHGVYEHEIAELCALVHDAGGQVYVDGANLNALVGLARPGRFGGDVSHLNLHKTFCIPHGGGGPGVGPVAVRAHLAQYLPGDPLESGSHAVSAARYGSASILPITWAYIRMMGAEGLRKATLTAIASANYLARRLDEYFPVLYTGENGMVAHECILDLRELTKRTGVTVDDVAKRLADYGFHAPTMSFPVAGTLMVEPTESENLAELDEFVAAMIAIRAEIDQVGAGVWPAEDNPLRGAPHTAECLVGEWTHPYSREIAVYPRGLGHARAKVWPAVRRIDGAYGDRNLVCSCPPLEAYAE

SEQ ID NO: 18581 - protein, 277 aa, Gibberella zeae
MKSKPFTSYPAHMKVPKRTQQDTLLQRGLLDPVVYSPLPLVKKTQVTPNVLHLTFSLPTTSTVLGLPIGQHVTIKADVRGETVARSYTPVSNNSDLGILELVIKVYPDGKLTNNYLAHLQVGDEVLFRGPKGAMKYQPNICKKIGLIAGGTGITPMFQVIRAVCEHDRDTTEISLIYANRTEQDILLREELDRFARRYPKNFKVYYMLDEPPSDWEYGSGYVTQELMKDKMPAPSMDSKVFLCGPPGMVNASKKGLVDLGYQQPGASAKMSDQIFVF

SEQ ID NO: 18582 - protein, 377 aa, Mycoplasma pulmonis
MNKKEDYYKILGIDKSANEKEIKKAYRKLAMEHHPDRSSSKESEAKMREINEAYEVLSNPEKKAIYDKYGHEAANNPGFNGFNAGSAGFGNFGGFSNFGGFDSIFEEFFGGSRSHSKQNSNYPYPGESYSTQVKISFLDSVHGRVISQKLDKYKDCESCNGTGARSKSDIKTCSTCNGRGSVEKLVNSLFGKIKQSVTCSTCNGLGQEITHKCPSCKGAKKIKESISQKISIPAGVISGQEVLLRGFGGPGFNGGPNGDLYIRVYVTEHPYYQRINDDIYVDFPISIVNLILEKPVVVPTPYGDEKIKIKSTFKNDQIITFKGKGFKRKNRVGDLKIRLKFEIPNFSSKVKKNLESLLSETNDSINEDFVKKVNSIK

SEQ ID NO: 18583 - protein, 498 aa, Oryza sativa
MAMATALRKLSSDALRRQPLSRITPLYYMWPKQLNAPLEEVDPEIADIIEHEKARQWKGLELIPSENFTSVSVMQAVGSVMTNKYSEGYPGARYYGGNEYIDMAESLCQKRALEAFRLDPAKWGVNVQPLSGSPANFHVYTALLKPHERIMALDLPHGGHLSHGYQTDTKKISAVSIFFETMPYRLDESTGLIDYDQMEKSAVLFRPKLIVAGASAYARLYDYDRMRKVCDKQKAILLADMAHISGLVAAGVVPSPFDYADVVTTTTHKSLRGPRGAMIFYRKGVKGVNKQGKEVMYDFEDKINAAVFPGLQGGPHNHTITGLAVALKQATTPEYRAYQEQVMSNCAKFAQSLTAKGYELVSGGTDNHLVLVNLKSKGIDGSRVEKVLENVHIAANKNTVPGDVSAMLHDHAGTPALTSRGFVEEDFAKVADFFDAAVNLALKVKAAAGGTKLKDFVATLQSDSNIQSEIAKLRHDVEEYAKQFPTIGFEKETMKYKN

SEQ ID NO: 18584 - protein, 591 aa, Aspergillus nidulans
MSYAHVKPPSEIHRAWWKESSVYQIWPASFKDSNDDGIGDIPGIISKLDYIRDLGVDIVWLCPSYKSPQVDMGYDIADYYSIADEYGTVADVEKLIKGCHDRGMKLLMDLVVNHTSDKHEWFKKSRSSKDNEFRDWYVWKPPRYDENGNRQPPNNWVSHFQGSAWEFDEATGEYYLHLYAVEQPDLNWENPAVRKAVHDIVRFWLDKGADGFRMDVINFISKDQAFPDAPEQDKDAVWQWGDKYYANGPRLHEYLQGIGKILKEYDTFSVGEMPFVKDTNEVLKAVRYDRNEINMIFNFEHVDIDHGPWGNKFKPGGWKLTDLKAFFERWQVFMYDNGGWNALYWENHDQPRSIDRYVNPPQALRPAAGKMLATILALHAGSPFIYQGQEIGMGNVPIEWGMEEYKDIDCLNHWKGLLETRPTDTEVQKIARQEYRKKSRDNARTPVQWSSEPNAGFTGPNVKPWMSVNPEYTRVNAADQVKDPNSLYHYWASVLHLRKTYLDIFVYGNYELVDRDSQEVYAYTRACHTSKALVLANWTDRGLTWNAAAHKADQFEQVLLDTYESANAAQGRFSGGQWTLRPYEAVVILLK

SEQ ID NO: 18585 - protein, 710 aa, Unknown
  Candidatus Blochmannia floridanus
MKRMLINATQKEELRVALVDGQRLYDLDIEIIGHEQKKANIYKGKIVRIEPSLEAVFVDYGSEKHGFLPIKEISQEYFLCSSSHNKSSIKEILREGQELIVQIDKEERGTKGAALTTFISLAGSYLVLMPNNPKSGGISRRIEGNERIELKETLSTLDLPEGMSLIIRTAGVGKSIEALEWDLTSRLQHWKTIQNTASTQLAPFLIHQDSNVIVRAFRDYLKPDIGEILIDNPDILNIAKEHITSLGRPDFVKKIKLYNGDIPLFSHYQIESQIESAFLHEVRLPSGGSIIIDTTEALTAIDINSARSTKGLDIEDTAFNTNLEATDEIARQLRLRDVGGLIVIDFIDMISVKHQREIENTLRTTVRQDRARIQIGRISKFGLLELSRQRLRPSLDESSHHVCPRCSGTGSIRDNKSLSLSILRLIEEEALKENTYEVHAIVPVAIATYLLNEKRKAISDIEQRQKGVRAIIVPYELMKTPNYEVRRIRKGETNNKPSYLLATHHHNESFPSISEKTLTLHHRGIVHKKLFNKTKFLYFQNLYTYKTPYINNLPQLKLKKVTIWIHKITNFWFIFNTFTTYFSIIKKQLKTLKKNNIFKKIYIIFFLKNTNILHSTKYPHKSLYQNNIYSIHKKYMHNKSKHRYNTYYKKTIHYFNDHKSNLYTHKHINNNIYFSKLIKNNINNSLINSTIDNAKKNNHQSKNKTHKYNI

SEQ ID NO: 18586 - protein, 586 aa, Pisum sativum
MCGILAVLGCSDDSQAKRVRILELSRRLKHRGPDWSGLHQHGDNYLAHQRLAIVDPASGDQPLFNEDKSIIVTVNGEIYNHEELRKQLPNHKFFTQCDCDVIAHLYEEHGENFVDMLDGIFSFVLLDTRDNSFIVARDAIGVTSLYIGWGLDGSVWIASELKGLNDECEHFEVFPPGHLYSSKEREFRRWYNPPWFNEAIIPSTPYDPLVLRNAFEKAVIKRLMTDVPFGVLLSGGLDSSLVASVTARYLAGTKAAKQWGAKLPSFCVGLKGAPDLKAGKEVADFLGTVHHEFEFTIQDGIDAIEDVIYHTETYDVTTIRAATPMFLMSRKIKSSGVKWVISGEGSDEIFGGYLYFHKAPNREEFHQETCRKIKALHRYDCLRANKSTYAWGLEARVPFLDKDFIKVAMDIDPEFKMIKHDEGRIEKWILRKAFDDEENPYLPKHILYRQKEQFSDGVGYGWIDGIKDHAAKHVTDRMMFNASHIFPFNTPNTKEAYYYRMIFERFFPQNSARLTVPGGPSVACSTEKAIEWDASWSNNLDPSGRAALGVHVSAYEHQINPVTKGVEPEKIIPKIGVSPLGVAIQT

SEQ ID NO: 18587 - protein, 332 aa, Glycine max
MMMDQRQREKLLHKTEACAFVAGVVPELSLVTVPGNNTNNVNNNNNVVSHSQSNGSGRIQENNHHLGLVAAVTSAFGTVQRKKRMARQRRSTKPTSLMNHLNNHKHNKPRSLPSPSASSSYVPLSSATLQPAREIDQRRLRFLFQKELKNSDVSSLRRMILPKKAAEAFLPALESKEGIVISMDDIDGLHVWSFKYRFWPNNNSRMYVLENTGDFVNTHGLRFGDSILVYQDSENNNYVIQAKKASDQDEFMEETSDTINDIFLNDYEVNKPGCFNVTYPAVNDTGMSFIYETTFSNDSPLDFLGGSMTNFSRIGPVETFGSVENLSLDDFY

SEQ ID NO: 18588 - protein, 583 aa, Pisum sativum
MCGILAVLGCSDPSRAKRVRVLELSRRLKHRGPEWSGLHQHGDCYLAQQRLAIVDPASGDQPLFNEDNPSIVTVNGEIYNHEDLRKQLSNHTFRTGSDCDVIAHLYEEYGEDFVDMLDGIFSFVPLDTRDNSYIVARDAIGVTSLYIGWGLDGSVWISSEMKGLNDDCEHFECFPPGHLYSSKDSGFRRWYNPSWYSEAIPSAPYDPLALRHAFEKAVVKRLMTDVPFGVLLSGGLDSSLVASITSRYLATTKAAEQWGSKLHSFCVGLEGSPDLKAGKEVADYLGTVHHEFTFTVQDGIDAIEDVIYHVETYDVTSIRASTPMFLMSRKIKSLGVKWVISGEGSDEIFGGYLYFHKAPNKEEFHEETCRKIKALHQYDCQRANKSTYAWGLEARVPFLDKAFINVAMNIDPENKMIKRDEGRIEKYILRKAFDDEENPYLPKHILYRQKEQFSDGVGYSWIDGLKAHAAKHVTDKMMLNAGNIFPHNTPNTKEAYYYRMIFERFFPQNSARLTVPGGPTVACSTAKAVEWDAAWSNNLDPSGRAALGVHDSAYENHNKVNKTVEFEKIIPLEAAPVELAIQG

SEQ ID NO: 18589 - protein, 931 aa, Bartonella quintana
MQERSFFSRHIGLRSDETQKMLDVLGLDCIDTLVSQAIPHSIHLGRVLNLPKAVSEGQALEELSKIMGRNHVHKSFIGQGYHGTCVPPVILRNLFENPAWYTAYTPYQAEISQGRLELLFYFQTLISELTGLPVAAASLLDEATALAEANAVAVRFAREKKTKISLQSLLHPQILSVVQTRAETQGISISENSEICSNTAAIVLSWPDTKGFFNDYSEVIKEAKAKGALVIVVADPLALTLMEPPAQWGADIVVGSMQRYGVPMGFGGPHAGYLAVSDALIRLIPGRIVGQSVDTKGRVGFRLALQTREQHIRRDKATSNICTAQALLANMATAYAVWHGPQGLQEIAQRIHSLTCRFMGGLEAAGIPCEGESFFDCVSVVVKGKAQEIARQAKAGGRLVRILDDDRVAVNFDELSTEEDACTLAQLFGAQLVDQVSPRLWGKGRDAAFLSQPFFHVVHSETDMMRFLRRLSDKDLALDRAMIPLGSCTMKLNAAAELMPVSWPTVANIHPFVPKEDAAGYQEMINQLNAWLCEITGFAQVSFQPNSGAQGEYAGLLAIRRYYQSRGENQRTLCLVPASAHGTNPASAHMAGMEVVVVKCLSDGDVDIDDLKMKAQLHKDRLAALMITYPSTHGVYEENIKDICSLIHENGGQVYFDGANLNALVGLTRPADIGADVCHMNLHKTFAIPHGGGGPGVGPIGVAEHLKPFLPGHAQNGTTHAVSAAPYGSASILVITWMYIRMMGAKGLKYATQTAILNANYIAERLSQAYSILYRGKHGRVAHECIVDTRVLKEQYGVSVDDIAKRLIDYGFHAPTMSFPVPGTLMIEPTESEPKAEIDRFCDALLSIAEEAKKVGAGVWPKDDNPLVNAPHTLVDTLDDAWVHPYSRQEAAFPNHHLDPTNKYWPPVSRIDNVAGDRVLICSCPPLGNTS

SEQ ID NO: 18590 - protein, 368 aa, Peanut witches'-broom
MKQKKDYYEVLELSRDAKLDDIKKAYRRLSKKYHPDVCKEANADAKFKEVQEAFDVLSNTNKRAQYDQMGHNFNNQGFNSDFQGFQSANFEEFEDLFSSFFGRRKSNRHQEDIKGEDHHIKLTISFMESVLGTQKTVTFNVKENCEKCDGTGAKTKNDIRICNVCKGNGYISYTQQGWFVSVFGKQICPECGGNKKIYFRPECKFCKGVGMVKSEHKVTLNIPAGVESGMRLKSPNQGHQGPSGAPNGDLYVDINVQPHKTFQRKGNDIFSSILINFYQAALGTIINVDTIHGNVQLKIPAGTQTDTKFRLKNKGVPYVNSPFSIGDHYVIVKIYTPQNLSNTQKKLFEQLEELEELNRKSKTNSSWF

SEQ ID NO: 18591 - protein, 380 aa, Geobacillus thermoglucosidasius
MAKRDYYEILGVSKNATKEEIKKAYRKLSKKYHPDINKEPDAAEKFKEIKEAYEVLSDDQKRAHYDQFGHADPNQGFGGFRSDDFDFGGFSGFSGFDDIFSTFFGGGRRRDPNAPRAGADLQYTMTLTFEEAVFGKETDIEIPREETCNTCHGTGAKPGTKKETCSYCHGTGQISTEQSTPFGRIVNRRTCPYCGGTGQYIKERCTTCGGTGRVKRRKKIHVKIPAGIDDGQQLRVAGQGEPGINGGPPGDLYIVFHVEPHEFFERDGDDIYCEIPLTFAQAALGDEIEVPTLHGKVRLKIPAGTQTGTKFRLKGKGVPNVRGYGYGDQHVIVRVVTPTKLTEKQKQLLREFDQLGGSSMHQGPHGRFFEKVKKAFKGES

SEQ ID NO: 18592 - protein, 337 aa, Bacteroides thetaiotaomicron
MKRIIFVVNPISGTQSKELILNLLDEKIDKARYTWEVVYTERAGHAVEIAAKAAEEKADVVVAIGGDGTINEIARSLVHTDTALGIIPCGSGNGLARHLHIPMEPKKALEVLNEGCLDTIDYGKINGTDFFCTCGVGFDAFVSLKFAHAGKRGLLTYLEKTLQESLKYQPETYELETENGVSKYKAFLIACGNASQYGNNAYIAPQATLTDGLLDVTILEPFTVLDVPSLAFQLFNKTIDQNSRIKTFRCKKLCIRRAVPGVVHFDGDPMETEADVNIELIKSGLRVVVPKTEEKDAANVLQRAQEYVNGIKLINEAIVDNITDKNKKILKKLTKKV

SEQ ID NO: 18593 - protein, 117 aa, Methanosarcina mazei
MVAMKYVIAMIRPERLDAVKRELQKIEVSRLTVSSVSGYGAQKGYMEIYRAMEYDANLLEKIKIEIAVNDEFLEPTIEAIKTGAKGSDGYVGSGKIFVLPLENVIRIRTNETGPEAI

SEQ ID NO: 18594 - protein, 99 aa, Bacteroides thetaiotaomicron
MEKFEDLIQSPIPVLVDFFAEWCGPCKAMKPVLEELKTMVGDKARIVKIDVDQHEDLATKYRIQAVPTFILFKNGEAVWRHSGVIHSSELKGIIEQNYI

SEQ ID NO: 18595 - protein, 294 aa, Bacteroides thetaiotaomicron
MKKIKVGLIQQSNTADIRVNLMNLAKSIEACAAHGAQLIVLQELHNSLYFCQTENTNLFDLAEPIPGPSTGFYSELAAANKVVLVASLFEKRAPGLYHNTAVVFDRDGSIAGKYRKMHIPDDPAYYEKFYFTPGDIGFEPIQTSLGKLGVLVCWDQWYPEAARLMALKGAELLIYPTAIGWESSDTDDEKARQLNAWIISQRAHAVANGLPVISVNRVGHEPDPSGQTNGIQFWGNSFVAGPQGEFLAQASNDHPENMVVEIDMERSENVRRWWPFLRDRRIDEYDGLTKRFLD

SEQ ID NO: 18596 - protein, 153 aa, Bacillus thuringiensis
MANYIKELRKKVGHDYVFLNFAGGCVFNKEGEVLLQKRGDFNAWGFPGGAMEIGESAAETAIREIKEETGYDVEINELIGVYTKYFQSYPNGDKAQSIMMCFSCSIVGGDKKVDGDETLDLKFFPLDDMPPLFCKQHEDCLQDLLEKRVGVYR

SEQ ID NO: 18597 - protein, 429 aa, Zymomonas mobilis
MTKETASFFTDRLAAADPDVLTAINHELNRQRKQIELIASENIVSRAVLEAQGSVFTNKYAEGYPGKRYYQGCAPSDEIETLAIERAKKLFGSEFVNVQPHSGAQANGAVLLAVAKPGDTIMGLSLDAGGHLTHGAKAAMSGKWFNAVQYAVHPETQLIDYDQVRDLALKNKPRVIIAGGSAYPRHIDFAFFRKVADEVGATFMVDMAHFAGLVAGGVHPSPVPHAHITTTTTHKTLRGPRGGMILTDDPALAKKINSAVFPGMQGGPLMHVIAAKAVAFGEALQPSFKEYAKAVVENAQALAARLKERGSDLVTGGTDTHLALVDLRPLGVTGRDADCALERAGITCNKNGIPFDPLPPVKTSGIRLGSPAATTRGFRKAEFLQVADMIADVLDALSSKGEQGDPAVETAVRQRVEALCDRFPLYPEL

SEQ ID NO: 18598 - protein, 597 aa, Oryza sativa
MASSKETYRVELRAAARQLGERGLYSAAKWAAELLVGIEPDATPAPSSVMDTPSSSGSAASGGRLLHLHRSGGSSFRRRLRPGAAEAGTPLGGVSYVSTPIPDDDAFDVGGDRYLLAKTYFDCREYRRAAHVLRGQTGRKAVFLRCYALYTAGEKRKEEETVELEGSLGKSNAVNQELVALERELATHRRTGAIDSFCLYLYGIVLRDKGSEALARTVLVESVNSYPWNWSAWLELQSLCTSSDILNNLNIKNHWMKDFFLASAHLELKMHEEALKRYERLMGVFRCSDYIQAQIATVQYSMRDLDEADMIFEELLRTDPFRVDSMDVYSNLLYAKESSTALSFLAHRVFLTDKYRPESCCIIANYYSLKGQHEKSVLYFQRALKLNRKYLSAWTLMGHEFVELKNTPAAIDAYRRAVDINPRDYRAWYGLGQIYEMMGMPFYAVYYFRKSSYLQPNDARLWNAMAQCYESDQLQMIEEAIKCYERSANNNDTEGIALHQLAKLHGMLGQSEEAAFYYKKDLERMEVEERQGQNFVEALLFLAKHCKSIGRFEEAEHYCTRLLDYTGPERETAKSILQGLKRAQSVLPLMDIDHFAM

SEQ ID NO: 18599 - protein, 340 aa, Yarrowia lipolytica
MRSFRAVRNFSTTAKRLSQAPKASTPNASSGNGFVLAFVAAAAGAGAYYYYANSPAAKVETFNATKADYQKVYDAIADKLIEDDDYDDGSYGPVLLRLAWHSSGTYNKSDNKFGSSGGTMRFKPEASHAANNGLVNARNFLKPIHEKFPWISTGDLYTLGGVTAVQELGGPIIPWKRGRVDEPESASPPDGSLPDASQGATHVRNVFNRQGFNDQEMVALIGAHALGRCHKQNSGFEGPWTFSPTMFTNDFYKLLLDDKWQWKKWDGNPQYEDVKTKSLMMLPTDMALATDKNFKKWATAYAKDQDLFFKDFSAAFSKMLNNGVDFPQGTEIWEFKPKNA

SEQ ID NO: 18600 - protein, 444 aa, Prosthecochloris aestuarii
MPFIANTDDDRRSMLQAIGVGSFEELIPDIPSEFCLKEALSLFPSMSEMEVASLLDRLASANRTSPDYVSFIGGGAYDHYIPAALKTIVSRSEFYTAYTPYQAEVSQGTLQAIYEYQSMICRLYGMSVANASLYDGATAMAEAVSMAMNVTGRSTVLVAGKIHPNTSAVLKTFIEAGGKASVVQNVLTDGVCDIAALESRMSDQIAAVIVQQPNFYGCLEDVEAIGALARSHGALFIVSADPVSLGLLNAPGRYGADIAVGEGQPLGSALNFGGPYLGIFAVAEKYVRKIPGRLVGMTKDRDGEDGFILTLQTREQHIRREKATSNICTNQALNALQAVVYLSLMGKDGLCQVAEHCLQKAHYLADKIADLPGYSLRFAGPFFREFVVNTPVDASVVVNTMMEKGFFAGYDLGIHDDSGLLIAVTEKRSRAEMDSFVENLGAIS

SEQ ID NO: 18601 - protein, 333 aa, Arabidopsis thaliana
  misc_feature (180)..(180): Xaa can be any naturally occurring amino acid
MSSTQEASVTDLPVKRPREAEEDNNGGAMETENGGGEIKEPSCMSSIIPGWFSEISPMWPGEAHSLKVEKILFQGKSDYQDVIVFQSATYGKVLVLDGVIQLTERDECAYQEMITHLPLCSISNPKKVLVIGGGDGGVLREVARHSSVEQIDICEIDKMVVDVAKQYFPNVAVGYGLPRXRVFTKNAAEGTYDAVIVDSSDPIGPAKELFEKPFFESVNRALRPGGVVCTQAESLWLHMDIIEDIVSNCRDIFKGSVNYAWTSVPTYPSGVIGFMLCSSEGPQVDFKKPVSLIDTDESSIKSHCPLKYYNAEIHSAAFCLPSFAKKVIDSKAN

SEQ ID NO: 18602 - protein, 405 aa, Vibrio parahaemolyticus
MAGVLGMILAGGEGSRLRPLTESRSKPSVPFGGSYRLIDFALNNFVNADLMRIYVLTQFKSQSLFHHLKKGWNINGITDRFIDPIPAQMRTGKRWYEGTADAIYQNLRFMELEEPDQVCIFGSDHIYKMDIKQMLNFHTEKKASLTVSALRMPLKEASQFGVIEVDAEGRMIGFEEKPANPKSIPGEPDFALVSMGNYVFEAQVLFSELVEDADNEASSHDFGKDIIPKMFPRGDVFVYDFSTNRISGEKEEVYWRDVGTIDAYWQAHMDLLEKDAPFSLYNRKWPLHTYYPPLPPATFTDSDNGRVQIIDSLVCNGSYVRGSRIEKSVLGFRSNIASACDISECILLGDVKIGEGCVLRRVIVDKDADIAPGTQIGVNLQEDKKHFHVSEEGIVVIPKGARVGY

SEQ ID NO: 18603 - protein, 337 aa, Beta vulgaris
MEPKTELSLGGGIRSSGFVTTKMEDTEEKEVIELPKPLENLHEIGPPPFLSKTFEIVEDPETDTIVSWGVTFDSFIVWDISKFSDLLSKYFKHRNFNSFVRQLNTYGFRKVHLDRLEYANSGFQKGKKHLLKTIKRRNHGANNNTALLLQRETAIENIKKEQEALKLEILDLKKEQQNSNTCLAALGERVKFVEWKQREFIMLIAKAMKRTSSFQQVLQNYRHNKVLSSGEFYKKRRLASTSDSLALADQFLANSPTTTQNKEDVSTFQYEANSFVGSAGQKSNLASETSSPDLSSGSYIMWEKLMADDVICKDDREEKYVHELENLITKPSSLICK

SEQ ID NO: 18604 - protein, 620 aa, Pyrus communis
MEKFVRVVSMAPLLLLLCFPFALAGHDYGQALSNSILFFEAQRSGFLPPNQRVTWRSNSGLYDGKANGVDLVGGYYDAGDNVKFGLPMAFTVTMMSWSIIEYGSQMAASGELGHAMDAVKWGTDYFIKAHPEPNVLYGEVGDGNTDHYCWQRPEDMTTNRQAYKISPSNPGSDLAGETAAAMAAASIVFRRSNPAYSRELLSHAYQLFDFADKYRGKYDSSITVAQKYYQSVSGYNDELLWAAAWLFQASNNQYYLDYLGNNGDSMGGTGWSMTEFGWDVKYPGVQTLVAKFLMQGKAGSHTAVFQKYQQKAEYFMCSCVGKGSQNARKTPGGLIYRQRWNNMQFVTSASFLATVYSDYLTSSRSTLQCASGNVAPNELLSFAQSQVDYILGDNPRATSYMVGYGNNYPQQVHHRASSIVSYKKDSSFVSCRGGYATWFSRKASYPNLLTGAIVGGPDAYDNFADQRDNYEQTEPATYNNAPLLGILARLNAGHGGYNQLLPVVTTQPKVAPLPKVAPASPAPSSSPIAISQRKTSSWISKGVTYYRYSAIVTNKSAKELTNLKLSISKLYGPIWGLTKAGNSYGFPSWINSLPVGKSMEFVYIHSASPANVLVSSYSLA

SEQ ID NO: 18605 - protein, 329 aa, Nicotiana tabacum
MAANTQRKESDRIKGPWSPEEDELLQSLVEKHGPRNWSLISKSVPGRSGKSCRLRWCNQLSPQVEHRAFTSEEDETIIRAHAKFGNKWATIARLLSGRTDNAIKNHWNSTLKRKCCSMSEDLSFETPQQPLKRSSSVGPSTNFSSGMNPGSPSGSDLSDSSLSGFPQSLVYRPVPRTGGIFPLPPLVQPIETAPFIPDPPTSLCLSLPGSGTRETSIQTAQPTQLTQPPQSPPPPPLALPPVDKPVPPPTAVFMSQLPQTKQSYDFCVPALPKSGEKQFFTPEFLGVLQDMIRKEVRNYMSGVEHNGLCMQTDAIRNAVVKRIGISKIE

SEQ ID NO: 18606 - protein, 1106 aa, Unknown
  Azoarcus sp. BH72
MPLNPPPGDDGLWYKDAVLYELHVKAFFDGNDDGIGDFAGLTRKLDYIHDLGVDTLWLLPFYPSPLKDDGYDVADYHGVLPAYGTRNDFRVFVREAHRRGLRVITELVVNHTSDQHAWFQAARRAPPGSSKRNYYVWSDDPKRYAGTRIIFTDTETSNWAWDPVAQSYYWHRFFSHQPDLNYENPNVLKAVLRTMRFWLDMGVDGFRLDAVPYLREREGTSNENLPETHATIREIRRVIDENYRGRVLLAEANQWPEDVREYFGGNERGEGDECHMAYHFPLMPRLFMALAQEDRFPVVDIMRQTPEIPDNCQWAIFLRNHDELTLEMVTDRERDYMWEFFANDPRMRLNVGIRRRLAPLLENSRDRIELMSFLLLTMPGSPTLYYGDELGMGDNVYLGDRNGVRTPMQWTSDRNAGFSRADPQQLYLPPIMDPIYGYQTINVESQARNPHSLLNFNRRLIQMRKGYRAFGRGNLVFLEPGNRKVLAYLREYVDPVAGEQRVLCVANLARTPQAVELDLARHEGRVPVEISGRTAFPPIGRLPYLLTLPGHGFYAFELSAQAPAPQWHEERLPASDLPVLVLTEGWRTFVRSSDESNRVRRAISSRSRAQLQDEVLLPYLRQRRWFAAKGDSIVRVEVVEEQEWVAEGASWLLVLLEVVIADAMPQTYFLPLAIAWEEGGEHPGDRFGAAALARVREKARMGLLYDAFVDPQFCRALARAVGGGGAMAFGSGELRFVTTPAWQTLADAIQEDFRLPATEQTNTGVFFGQRLYLKGYRRLQAGINPELEMGYFLARAGFERIATVVGSAEFVTADGSASALAMMQAYVDSQGNAWDYTLDHLGRLFSADTWPGADGERDTDGMNRVYLLQMATLGRRVGELHLALADDRGDPAFRPEPVDGAEVENWRASVLRDIGHTLAQLAARAPALDAEAGALATRVLGMGEELAARVRDLDLDAHHLFKTRYHGDLHLGQVLVVQNDFVIVDFEGEPARPMAQRRDKHLALRDVAGMLRSLDYAVRSIELRIALAQPARDGALARALADWQRNATDAFVTAYHEVVPPPAAAADFLTLFVVEKLLYELRYELDNRPDWVRIPLAALAESGAAG

SEQ ID NO: 18607 - protein, 460 aa, Bacillus licheniformis
MHTLEKMEQTNVQMARDYVTKAYETVRQRNLHESEFLQAVKEIFDSLVPVLARHPKYIEHRILERIAEPERMITFRVPWVDDEGNIQVNRGYRVQFNSAIGPYKGGIRFHPSVNASIIKFLGFEQIFKNSLTGQPIGGGKGGADFDPKGKSDREIMSFTQSFMNELYRHIGPDTDIPAGDIGVGAREVGFMFGQYKKIRGRYDAGVLTGKGLEYGGSLTRKEATGYGLVYFVEEMLKDQGLRFENSTVVVSGSGNVALYAMEKAAQFGGKVVACSDSDGYVYDEKGISLETVKRLKESGNGRIREYVSEHPEAHYFEGCSGIWSIPCDIALPCATQNEIDEEAAGVLISNGVKAVGEGANMPSEEGAVKRFLDAGVLFGPAKAANAGGVAVSALEMAQNSARLHWTAEETDEKLRMIMTDIYKRSVEAASEYGRPGNLLDGCNIAGFIKVADAMIAQGVV

SEQ ID NO: 18608 - protein, 150 aa, Triticum aestivum
RAKPSFCVAETCAQGASDKRVIACIGDGSFQVTAQDVSTMLRCEQNSIIFLINNGGYTIEVEIHDGPYNVIKNWNYTALVEAIHNGEGKCWTAKVKCEEELTAAIETALGEKKDSLCFIEVIAHKDDTSKELLEWGSRVSAANSRPPNPQ

SEQ ID NO: 18609 - protein, 103 aa, Listeria innocua
MVKEITDATFEQETSEGLVLTDFWATWCGPCRMVAPVLEEIQEERGEALKIVKMDVDENPETPGSFGVMSIPTLLIKKDGEVVETIIGYRPKEELDEVINKYV

SEQ ID NO: 18610 - protein, 316 aa, Legionella pneumophila
MSISNHHRLIILGSGPAGYTAAVYAARANLNPVLITGMQPGGQLTTTTDVDNWPGDIEGLQGPALMERMQKHAERFDTQVIFDHIVKADLAQAPFTLQGDSATYTCDALIIATGASARYLGLPSETAYQGRGVSACATCDGFFYRNKSVCVIGGGNTAVEEALYLSNLASSVTLIHRRDSLRAEKILQNKLFEKAHSGNIKIVWNSTLDEVLGDEKKVTGAMIRNLKTGETDQLAMDGIFIAIGHTPNTAIFQDQLAMRDGYILIKSGLDGMATSTSVPGVFACGDVADHVYRQAITSAGFGCMAALDAEKYLDSI

SEQ ID NO: 18611 - protein, 433 aa, Magnaporthe grisea
MASLGSYAKKHKVTIIGSGNWGSTIAKIVAESTREHKDVFEEDVQMWVFEEKVTIPKDSPYYESEEPQKLTEVINKHHENVKYLPGIKLPSNIIANPSLTDAVRDSSVLVFNLPHEFLGKVCQQLNGHIVPFARGISCIKGVDVSGSGINLFCEVIGEKLGIYCGALSGANVASQIAAEEGVSETTIAYDPPPIDSSRAATPRDRSPNYDSTSANKLPDLTVTSADSNGKDDRGRRTKAKLTPVPESYPPLDHETLQILFDRPYFSVSMVSDVAGVSLSGALKNIVALAAGFVDGKGWGSNVQSAVIRVGLAEMLKFAREFFGESVDPFTILLESAGVADVITSCISGRNFRCASMAVKRGVSVAEIEEKELNGQKLQGTSTAKEVNSLLKARGREGDYPLFTTVNEILEGKARVDDLPKLVIRQKHTIEKSG

SEQ ID NO: 18612 - protein, 482 aa, Vibrio vulnificus
MKGDIGVIGLAVMGQNLILNMNDHGFKVVAHNRTAAKVDEFLEGPAKGTNIIGAYSLEELVEKLETPRKVMLMVRAGAVVDQFIDALVPLLDKGDIIIDGGNTNYPDTNRRVAALREKGIHFIGTGVSGGEEGARFGPSIMPGGAPEAWEAVKPIFQGISAKTDAGEPCCDWVGNDGAGHFVKMVHNGIEYGDMQLITEAYQFMKDGLGMSADEMQAVFADWNKTELDSYLVEITADILGYKDEDGEPLVEKILDTAGQKGTGKWTGINALDLGIPLTLISESVFSRCLSALKDQRVEAEKLFGKTITPVEGDKQEWVDALRQALLASKIISYAQGFMLMREASNENGWDLNYGNVALMWRGGCIIRSAFLGNIRDAYEANPDLAFLGSDDYFKGILQNSLVAWRKVAAKSLEAGIPMPCTTSALTFLDGYTTARLPANLLQAQRDYFGAHTYERIDRERGEFFHTNWTGTGGNTASTTYDV

SEQ ID NO: 18613 - protein, 263 aa, Arabidopsis thaliana
MSQLLSTPLMAVNSNPRFLSSSSVLVTGGFAVKRHGFALKPTTKTVKLFSVKSRQTDYFEKQRFGDSSSSPSPAEGLPARFYVGHSIYKGKAALTVDPRAPEFVALDSGAFKLSKDGFLLLQFAPSAGVRQYDWSKKQVFSLSVTEIGTLVSLGPRESCEFFHDPFKGKSDEGKVRKVLKVEPLPDGSGHFFNLSVQNKLVNVDESIYIPITRAEFAVLISAFNFVLPYLIGWHAFANSIKPEETSRVNNASPNYGGDYEWNR

SEQ ID NO: 18614 - protein, 87 aa, Unknown
  Burkholderia sp. 383
MAKEELLELDGIVDEVLPDSKYRVTLENGVVVGAYASGRMRKNHIRILAGDRVTLELSVYDLTKGRINFRHKDANSPRPPRTGQPRR

SEQ ID NO: 18615 - protein, 470 aa, Unknown
  Candidatus Blochmannia floridanus
MNTISIVKILNEFDQLQNTEITLYGWIRTRRHSKTKITFLNLYDGSCLESLQIVVKNNLHNYETDILKLTTGCSIIAKGYITNSLGTKQRIELIATYIQVLGWIDNPSTYPITTKKHSMEYLRNVAHLRPRTHIFGAISRIRHVLFQSIHNLMNTKGFIWVPTPIITASDTEGNSKMFYVSELLNNSKKSQNICNSHQKIPELFFGKEAFLTVSGQLNVESYACALTKVYTFGPTFRAEHSNTNRHLAEFWMLEPEMAFTDLNIIIKIADSLLKDIVQTILEQCINDIEYCASHIKEYNLIKRLENFLHSKIIHIEYTDAIKLLSSCDKTFNNTIYWGMDLFSEHEKYLSEEYFQSPIVIKNHPKNIKAFYMRLNDDNKTVSSMDILVPGIGEIIGGSQREERLSILDKRLLENNLKTECYWWYRDLRRYGTVPHSGFGLGFERLIIYITGLTNIRDAVPFPRTINSINF

SEQ ID NO: 18616 - protein, 431 aa, Photobacterium profundum
MKASYQNHDLEMFFSTNLAQVDGAVNAGIEAELNRQNQQIELIASENIVSKAVMQAQGTCLTNKYAEGYAGHRYYGGCEHVDEVEKIAIARAKQLFQCEYVNVQPHSGAQANGAVMLALLQPGDTILGMSLDAGGHLTHGARPALSGKWFDAVQYGVNKDTLEIDYNQVRELAIEHKPKMIIAGGSAIPRIINFAKFREIADEVGAFLMVDMAHIAGLIAAGEHPSPIPHAHVITTTTHKTLRGPRGGMILTNLEDINKKINSAVFPGLQGGPLMHVIAGKAVAFGEALEPDFKIYIKNVISNAKVLAEVLQNRGCDIVTNGTDTHLMLVDLRPKGLKGNAAENALERAGITCNKNGIPFDTEKPMVTSGIRLGTPAGTSRGFGNDEFKQIGEWIGDVLDGLAANPEDNSEVEKHVKQQVQKLCSRFPLYQ

SEQ ID NO: 18617 - protein, 491 aa, Photobacterium profundum
MGNKDKFSIFSFTGKMKILHLSWFAFFITFMVWFNLAPFLQSVKESLGLTTAEIKTLLILNVAFTIPARVVIGMLTDKYGPRIVYSALLAICSIPCFAFALSETFIQAAISRFALGFIGAGFVVGIRLVSEWFPHNELGTAEGIYGGWGNFGSAAAAFTLPTVAVMLGGEDGWRYAMAITGVMSLLFSFVFYANVTDTPKGSTYFRPKNLGAMEVTSTGDFFLLLVMKLPMYGALALLAWKLSPAGISMLSDMVVNSIYAGLAALYLYEVWQVWKVNKKVFSEPVPKIHQYKFKQVAVLNILYFATFGSELAVISMLPLFFSEMFELTPVMAGMVASAYAFMNLMSRPGGGWLSDKFGRKPTLLILTAGLAVGYFFMGQVSSEWPLWLAVVAAMACSFFVQSGEGAVFATVPLIKRRMTGQIAGMTGAYGNVGAVCYLTVLSLVDYSTFFLVIAGTAVLGFITLLFMEEPSGQIAEVNDDGSVTLIDVANN

SEQ ID NO: 18618 - protein, 420 aa, Sulfolobus solfataricus
MMEEVLSSSLYTQQVKKLYKVGELLGLDNETLETLSQPERIIQVKIQIRGSDGKLKTFMGWRSQHNSALGPYKGGVRYHPNVTQDEVEALSMIMTWKNSLLLLPYGGGKGGVRVDPKKLTREELEQLSRKYIQAIYKYLGSELDIPAPDVNTDSQTMAWFLDEYIKITGKVDFAVFTGKPVELGGIGVRLYSTGLGVATIAKEAANKFIGGVEEARVIIQGFGNVGYYAGKFLSEMGAKIVGVSDSKGGVINEKGIDVGKAIEIKEKTGSVINYPEGRKVTNEELLISDCDILIPAALENVINKFNAPKVKAKLIVEGANGPLTADADEIMRQRGIAVVPDILANAGGVVGSYVEWANNKMGEIISDEEAKKLIVDRMNNAFNTLYDYHQKKLEDHDLRTAAMALAVDRVVRAMKARGIL

SEQ ID NO: 18619 - protein, 167 aa, Arabidopsis thaliana
MAISLATAYISPCFTPESSSSASPSRTLSSVRLPSQIRRFGSVQSPSSSTRFAPLTVRAAKKQTFNSFDDLLQNSDKPVLVDFYATWCGPCQLMVPILNEVSETLKDIIAVVKIDTEKYPSLANKYQIEALPTFILFKDGKLWDRFEGALPANQLVERIENSLQVKQ

SEQ ID NO: 18620 - protein, 959 aa, Photobacterium profundum
MTDMTLLNALSDDQDFAGRHNGPNAAQQNIMLKAISAESVEQLIAQTVPADIRLPEPMKLDPAQSEADMLTSLKAIASKNIINRSYIGQGYYNNLTPNVVLRNVLENPGWYTAYTPYQPEISQGRLESLLNYQQMIMDLTSMELANASLLDEATAAAEAMTLCLRAGKSKSKAFFVSNDLHPQTVDVVRTRAEYIGIEIITGSVEELDNHDVFGALVQYPGTTGSITDLTDIIEKAHAKKTLVAVASDLLALTLLKAPGEMGADVVIGSAQRFGVPMGFGGPHAGFMATKDKHKRTMPGRVIGVSKDARGNQSLRMAMQTREQHIRREKATSNICTAQALLANMAAFYALYHGPEGLRKIGRRVHHLTAILAAGLRNSGIELASDTFFDTITLNTGKKTDDFYKKALAAGINLRKFDVQLGISLDETTKVSDVEELLAIFTGNKLKASMFTADIAADEFAAIPESCRRTSKYLTHPVFNEHHSETQMMRYMKKLENKDYSLTHGMIPLGSCTMKLNAAAEMIPITWPEFGSLHPFAPADQTKGYQELASKLSEMLCSVTGYDAFSLQPNSGAQGEYAGLIAIQRYHQHNGDSHRNVCLIPSSAHGTNPASAAMVSMKVVVVGCDEKGNVDVEDLKVKIEKHRDNLSCIMITYPSTHGVYEEAVREVCDLVHDAGGQVYLDGANMNAQVGLTNPGFIGSDVSHLNLHKTFCIPHGGGGPGMGPIGVKSHLAPFLPGHVQSTSDEGQQYAVSAAELGSASILPISYAYIAMMGEEGLTEATKLAILNANYVMERLRPHYPVLYRGTEGRIAHECIIDIRPLKEASGISEEDVAKRLMDYGFHAPTMSFPVAGTLMIEPTESEDLAELDRFCDAMIAIRQEIARVQEGEWPIDDNPLVHAPHTQADLMETEWNRAYSREIACFPTDHTRASKYWPTVNRVDNVFGDRNLICSCPSIDSYIED

SEQ ID NO: 18621 - protein, 844 aa, Photobacterium profundum
MDKQRIVVVGNGMVGHMFIDTLVQDASADKFDIVTFSEEARLAYDRVKLSAYFSGTTADELALTDEGYYQQHGVNFVLSDKVVALDTVNNHVVTESGRQEPYDKLILATGSYPFVPPIPGNDQPHCLVYRTIEDLEAITKSGKDSQVGVVIGGGLLGLEAANALKHLGVETHVVEFAPRLMAVQLDDGGARLLQRKIEQLDVQVHTEKATTEIVAGETCRYRMNFADGSFLETDMIVFSAGIRPQDELARQYGLEVGERGGIVINDNCQTSVDNVYAVGECALWQGRIFGLVAPGYSMAKAAVSHIRGGTGSFTGADMSTKLKLLGVDVASIGDAHGQTAGAQSYTFNDEVEQIYKRLIISEDGKKILGAVLVGDVDAYGTLLQMMLNDMELPENPAALILPAVDGEATTGFGVDALPDSAQVCSCFDVTKGQIKEAVANGCTDMASIKGTTKASSGCGGCTGLAKQVLDAELASLGFEVKNDICEHFAYSRKELADIIRIKEIKTFDELLTSHGEGLGCEVCKPTIGSILASFWNDYVLDNQHIGLQDTNDIFLGNMQKDGTYSVVPRIAGGEITPEKLIALGQVAQEFNLYTKITGGQRIDLFGAQLHELPVIWKKLIDVGFETGHAYGKSVRTVKSCVGSTWCRYGIKDSVGFAIDIENRYKGLRAPHKLKFAVSGCTRECAEAQSKDVGIIATENGWNLYVCGNGGMRPRHADLFASDLDDKTLQQYVDRFLMFYIRTADRLQRTSVWLENLDGGLDYLKEVIIDDKLGLAEELENEMARNIRNYQCEWKTTIESSEKLKRFQHFINSSDPDNKLSYVTEREQRRPATKSERIDIVEVTD

SEQ ID NO: 18622 - protein, 216 aa, Xylella fastidiosa
MVLTIEALKHLWRLDESRVGRSEPLPLDNRHYVKGHPLCDAFTGLAQIQFGLGCFWGAERLFWQLPGVFSTAAGYAGGGVPYPTYREVCSGETGHAEVVLVVYDHTVISFEQLLQTFWESHDPTQGMRQGNDIGTQYRSVIHCTTSKQYAAASTSREVYQQQLNTAGYTAITTEILHPAPPFYYAENEHQQYLAKHPNGYCGLGGTGVTCPIRLQV

SEQ ID NO: 18623 - protein, 278 aa, Photobacterium profundum
MSNEPPTNSIVNFAAVTAKESPFSGKVSLVGAGPGDPDLLTLKALRVIQQADLILFDRLVSKEICQLFPPSTPALYVGKAKDRHSVPQDEINDLLVTKAQQGLNICRLKGGDAFVFGRGGEEMLRLIQEGIEVELVPGITAAAGCTSYAGIPLTHRGLSQGCTFVTAHAEKELDIRWDSLAQLDHTLVFYMGLSKASLIAEELIKSGLDSNTPAALIENGCCPKQRVVRGKLNQLAELVTEHDVKSPALIVIGKVVDLADQLQWFASLDNQKAERLMA

SEQ ID NO: 18624 - protein, 898 aa, Photobacterium profundum
MAINKVTPWVKSTCAYCGVGCGIEAKPTANGQLDIRGDVDHPANYGRLCSKGLALGETVTHEGRLQYPSINGQDVDWNSAIKHVATQFSDIIEQHGKDAVAFYVSGQLLTEDYYVANKLMKGFIGSGNIDTNSRLCMSSSVAGHKRAFGSDTVPGCYEDLELADMIVITGSNLAWCHPILYQRIKAEKQRRPSLQVIVIDPRKTDTCEIANQHLALKAGSDVALFNGLLSYLNQHHQLNNAYINAHTEGFEQAVERANKDAGDIATVAAKTGLSIEQLNTFYRLYAKNEKVVTLYSQGVNQSIQGTDKVNSILNCHLAMGRIGKPGSGPFSVTGQPNAMGGREVGGLANTLASHMDFGNPTHHQLISDYWQTDSLATQLGLKAVELFDAIDNGKIKAIWIMATNPVVSLPDAEKIKRALKKCPLVVVSDCIADTDTTRCADVLLPAQGWSEKSGTVTNSERRISRQRRLLPTPGEGKPDWWIISEVAKSMGFAKAFTYQHEAEIFNEYAIMTGLDNAKRDLNLTGLAHLTTEQYAQLLPQQWPVLHIDKEITHKRLFTDGRFFTPSGKAQFIAVQHQPTALQCNADFPLSLNSGRIRDQWHTMTRTGLSARLGAHKPEPFVSVNPIDAEHYALQHGTIATLTSPFGNVQVRVDISKQVNQGQLFMPIHWNNVTSSAGKVCNLISPKTDDISGQPEFKFTPVSIASFAYKSEAMLLSSTVLDMTEFDYWVRQKVTGGYLYRIASCLLPEQLMLRLSQYCQHENGRELSFNGASSGQYRYANIEKQRLRSCYLVADDLQQQDLDWLQNLLDEPIDITVERSLISGTAEGKLAAGKTVCACKQVGRNTICQAIREQHLKSVDQISACTKAGTGCGSCVPELQQILDEEGIAQTALMYEENG

SEQ ID NO: 18625 - protein, 748 aa, Zymomonas mobilis
MFDIKRQEIDWGGKKLTLETGQVARQADGAVIATLGETVVLCAVTAAKTVKEGQDFFPLTVHYQEKYSAAGRIPGGFFKRERGATERETLISRLIDRPIRPLFPEGFYNETLVIAQVMSYDGENEPDILAMIAASAALALSGVPFLGPIGAARVGYQDGEFILNPTLEQLEKSDLDLVVGATRDAVMMVESEANELPEEVMLNAVSFAHESLQPVIKAIINLAEQAAKEPWELVSYDDSALAAKVEELCYDNFDKAYRLTRKAERVDALSKAKAVLDEAFPEADPTEKLRIQKLAKKLEAKIVRTAILKEGRRIDGRDLKTVRPIRSQVGFLPRTHGSALFTRGETQALVSTTLGTADAEQMIDGLTGLHYERFMLHYNFPPYSVGEVGRFGAPGRREIGHGKLAWRALHPVLPSKADFPYTIRVLSDITESNGSSSMATVCGGCLALMDAGVPLTRPVSGIAMGLILEKDGFAILSDIMGDEDHLGDMDFKVAGTEKGITSLQMDIKVAGITEEIMQKALEQAKGGRAHILGEMSKALGEVRSEISNLAPRIETMSVPKDKIRDVIGTGGKVIREIVATTGAKVDIEDDGTVRLSSSDPANIEAAREWINGIVEEPEVGKIYNGKVVNIVDFGAFVNFMGGRDGLVHVSEIKNERVNKVSDVLSEGQEVKVKVLEIDNRGKVRLSMRVVDQETGAELDDNRPPRENAERRGGERPRRDRGPRRESGDRPARRDMEPEFAPAFLRKDS

SEQ ID NO: 18626 - protein, 394 aa, Triticum aestivum
  misc_feature (92)..(92): Xaa can be any naturally occurring amino acid
  misc_feature (117)..(117): Xaa can be any naturally occurring amino acid
  misc_feature (128)..(128): Xaa can be any naturally occurring amino acid
MAAPTSAIGFEGYEKRLDITFSEASIFADPHGRGLRALSRAQIDSVLDLARCTIVSELSNKDFDSYVLSESSLFIYSQKIVIKTCGTTMLLXLTIPRILELAEELCMPLAAVKYSRXGMFIFPGAQPXAPHRSFSEEVDVLNRYFGHLKSGGNAYVIGDPAKPGQKWHIYYATEQPEQPMVTLEMCMTGLDKKKASVFFKTSADGHVSCAKEMTKLSGISDIIPEMEVCDFDFEPCGYSMNAINGSAFSTIHVTPEDGFSYASYEVMGMDASALAYGDIVKRVLRCFGPSEFSVAVTIFGGRGHAATWGKKLDAEAYDCNNVVEQELPCGGVLIYQSFAANEEVAVSAGSPRSVFHCFEAETVESHPLVKEGKLANLLAWRAEDSLEEGVVLCE

SEQ ID NO: 18627 - protein, 293 aa, Oryza sativa
MEAAAIHAPTTTTSSDSGSCVTNGTREKREISKHKQLKRKRSTSPAPPPGCGGGQGQEAAVETDADAGAAGRGGGAGEEESSSCGGAGAGEGERKRGDAGRHPSYRGVRRRSWGKWVSEIREPRKKSRIWLGTFPTAEMAARAHDVAALGIKGRAAHLNFPSLAHTLPRPASTSPSDIQAAAALAAAAAATDQCESSSSAVAAATATDAEAAESTSSAAASPCAATSSVEENALFDLPDLLLDLSDGLWCSPVWTTAPADQYDAGDDGDDAAAPLLWAEQCWMDAPAAPVQPD

SEQ ID NO: 18628 - protein, 152 aa, Trifolium pratense
MATTPALYGTAVSTSFMRRQPVPMSVATTTTTKAFPSGFGLKSVSTKRGDLAVAMATYKVKLITPEGPQEFDCPDDVYILDHAEEVGIELPYSCRAGSCSSCAGKVVNGNVNQEDGSFLDDEQIEGGWVLTCVAFPTSDVTIETHKEEELTA

SEQ ID NO: 18629 - protein, 1132 aa, Xylella fastidiosa
MKRMLINATQAEELRVAIVDGQSLYDIDIEQPSKEQKKSNIYKGRITRLEPSLEAAFVDYGTDRHGFLPLKEISKDYFQAGLDHHKAGIRELLREGQEIVVQVDKEERGNKGAALTTFISLAGRYMVLMPNSPSAGGVSRRIEGEDRAALKEALEKLNIPNDMGVIIRTAGVGRDTQELQWDLDFLLHAWRAIAEAALSKPAPLLIYQESRLIIRALRDYFRADIGEILVDTEEMYQDAHEFMRHVMPQSLRKLKYYKDDIPLFNRFQIESQIEGAYERNVRLPSGGSIVVDQTEALTAIDVNSSRATKGNDIEETAFQTNLEAADEIARQLRLRDVGGLVVIDFIDMSSSKHQREIETRLQNCLKYDRARVQLSRISRFGLLEMSRQRLRPSLGESSQIVCPYCDGHGRMRSIESLSLSIIRIVEEHAMKENTGQVLVQTPVEIANYLLNEKRRAINEIEKRHDAPIIIIADEQLHTPHYEVTRLRENELSEETGKPSYQRNTPRKLPVHALTKSQLNIPPAPAVKSIPPPQLAPTQENIPTIREQSAENRAHPIPELVSSLASWLKRIFGNTDKRQTASNSSHPAPLQQNRNGNVQRNERNHRDGRIATSNTQPQQQSSNHRDNYRHNESNNYPQIQNQSTADTNGKLRNESQTPKSSAYVSKQPQMPRQPQPQLPKTPRTQSQPTQNSTKTTLDKQPAPVLYGEDNTLQKAKPIPLTAEAVLTNMPAPSMTATPSGKDQNALPTTSNVTQDTSNALIEAQSTTKTNIDTNTDIEPQQNNHEGTANNDGSNRRRRGRRGGRRRRRNTSLGNETNAVSESNSIKLSNDTETDNADNIEAPQALRPAMQENKRQPEFEFDDLAPAAPITAPLRKAIAAEREEISADLTTTAPQSMMETTSRTHVASQMAPQSETSAASTTSHTSVQATTTHTHKDVVSDSPSRTPYKAHSNTTRHTSGRRLETLSTAHTPAKASPSEHITPTSRSNANAKTTKTEIPNKPTNANSDTAARPTATDVLVVTNQPVMATKPSTTIEKAQTKVVPSTTYNNEHIETKRKIIATESETTQPPVRKPRLPMQNPLPKVVAPLEDKKQAPFVENTTQRNINNATTTSQNDKLLDFTKNNEKNSDNNTL

SEQ ID NO: 18630 - protein, 401 aa, Gibberella zeae
MAEGSGIDRKADERMEFSTSKEVTVHPTFESMSLKENLLRGIYAYGYESPSAVQSRAIVQVCKGRDTIAQAQSGTGKTATFSISMLQVIDTAVRETQALVLSPTRELATQIQSVVMALGDYMNVQCHACIGGTNVGEDIRKLDYGQHIVSGTPGRVADMIRRRHLRTRHIKMLVLDEADELLNKGFREQIYDVYRYLPPATQVVVVSATLPYDVLDMTTKFMTDPVRILVKRDELTLEGLKQYFIAVEKEDWKFDTLCDLYDTLTITQAVIFCNTRRKVDWLTDKMREANFTVSSMHGDMPQKERDSIMQDFRQGNSRVLISTDVWARGIDVQQVSLVINYDLPSNRENYIHRIGRSGRFGRKGVAINFVTTEDVRILRDIELYYSTQIDEMPMNVADLIA

SEQ ID NO: 18631 - protein, 340 aa, Oryza sativa
MATTQLLSTVEHRETLPEGYARPESDRPRLAEVATDSNIPLIDLASPDKPRVIAEIAQACRTYGFFQVTNHGIAEELLEKVMAVALEFFRLPPEEKEKLYSDEPSKKIRLSTSFNVRKETVHNWRDYLRLHCHPLEEFVPEWPSNPAQFKEIMSTYCREVRQLGLRLLGAISVSLGLEEDYIEKVLGEQEQHMAVNYYPRCPEPDLTYGLPKHTDPNALTILLPDPHVAGLQVLRDGDQWIVVNPRPNALVVNLGDQIQALSNDAYKSVWHRAVVNPVQERMSVASFMCPCNSAVISPARKLVADGDAPVYRSFTYDEYYKKFWSRNLDQEHCLELFKGQ

SEQ ID NO: 18632 - protein, 587 aa, Methanosarcina mazei
MEKLAKFKALGLSDSTLKALKKKGFEEPTPIQEKVIPLFLKGEADIIGQAQTGTGKTTAFGAPIIEKIPEKSGHVQAIILTPTRELAIQVSEELNSIKGDKKLYIVPIYGGQSMTQQLRVLKSGVDIVVGTPGRVIDHLERKSLNLEHIAYFVLDEADEMLNMGFIDDIKEILKSTGPNKRMLFFSATMPKAILGIVKKHMQNYEHITIEKEELTETLTEQIYFEVKESDKFEALCRIIDIEDEFYGLVFCRTKTDTSQLAQKLSDRGYLADALHGDLSQQEREKILNKFRKQKINILAATDVAARGIDIMDLTHVINYALPQDPESYVHRIGRTGRAGKQGTAITFVTSTEFRRLTYIKKTSKSEMKKGHIPEIKDVIKAKRARVRTELEETIKTEEYGDCLEMSQKLLEEYPAEKILAALLKFTFKDKFDESMYTEISSGSSYVDRKGKSRLFIAMGKADGMTPDKLSYFIQEELGDGELKVRDAEIFPHFSFVTLPFAQAETLIEIFKNKRRGSKPFVELAQKSRGRSSKDSGETRSDNRGTSRGNSRNGESRGDSRGESRGTKSTNYSRSTRSTRSTKKKDSY

SEQ ID NO: 18633 - protein, 194 aa, Zea mays
MSMPETGQAAERDEQQQSRGIALMQGICAVVYRKADNTPCPIKQGLYLGSVGAAFNKDALKSLNITHMLIVAKSLDPVFPAEFNYKKIEVLDIPDTDLLKHSDECFGFIDEAISSGGNVLGHCFAGRSRSVTIVVAYLMKKHQMSLQRAWSLVRSNRPQVAPNGGVYFPGWGKFPKILGKWDPGTGKRQPGGST

SEQ ID NO: 18634 - protein, 183 aa, Fagus sylvatica
DGHGGSHVAMRCRDRLHDIVKEEVESVTEGMEWKDTMEKSFDRMDKEVQEWLVPIKTTNCRCDVQTPQCDAVGFTAVVAIVTPEKIIVSNCGDSRAVLCRNGVAFPLSSDHKPDRPDELVRIQDAGGRVIYWDGARVLGVLAMSRAIGDNYLKPYVISEPEVTITDRTAEDECLILASDGLWD

SEQ ID NO: 18635 - protein, 547 aa, Clostridium perfringens
MSMFCSQCQETAGCKGCTVRGVCGKTEDVAKIQDLLFFVTKGLATVANEGRKVGIVDKKVNRMIIDNLFITITNANFDFKAIEKRVKDTLVAREELKERVQAKGGNPIGSDFKGCATWTATTSEEMMEKASQVGVLATENEDIRSLRELIMYGLKGLAAYMEHAMNLGHDKEEVHAFMAETLVKILDDSLSADELTALALETGKFGVDGMALLDEANTSTYGHPEITKVNYGVRNNPGILISGHDLKDLEMLLEQTEGTGVDVYTHGEMLPGHFYPKFKKYLPPGNYGNAGWSQNKEFASFNGPILMTTCIPPVQDSYRGRIFTTGAVGYEGCIHITADENGYKDFSQIIELAKTCKAPTEIETGEIVGGFAHNQVLALADQVVDAVKSGAIRRFFVMAGCDGRAKSRDYYREFAEKLPKDTVILTAGCAKYKYNKLPLGDINGIPRVLDAGQCNDSYSLVVIALKLAEVFGTDSVNELPISYNIAWYEQKAVIVLLSLLHLGVKNIHLGPTLPAFLSPNVAKVLVENFGIGGITNVEDDMKMFLGE

SEQ ID NO: 18636 - protein, 405 aa, Unknown
  Polaromonas sp. JS666
MSETVIIAGAGQAAGQAVASLRQEGFDGRIVLVGAEPVLPYQRPPLSKAFLAGTLPLERLFLKPPAFYEQARVDTLLGVAVTELDAARRQVRLDDGRELAFDHLLLATGGRARRLDCPGADHPRLHYLRTVADVDGIRAALRPGARLVLIGGGYVGLEIAAVAAKLGLAVTVLEAAPTVLARVTCPAVARFFESVHRQAGVTIRCATTVSGIEGDASLARVVTGDGERIDADLVIAGIGLLPNVELAQAAGLVCDNGIVVDEECRTSVPGIFAAGDCTQHPNAIYDSRLRLESVHNAIEQGKTAAAAMCGKARPYRQVPWFWSDQYDLKLQTAGLNRGYDQVVMRGSTDNRSFAAFYLRDGRLLAVDAVNRPVEFMVAKALIANRTVIAPERLADERIAAKDLAG

SEQ ID NO: 18637 - protein, 322 aa, Unknown
  Oceanospirillum sp. MED92
MNIYEDNSLTIGNTPLVHLKRLAPGLNIFGKIESRNPAGSVKCRIGANMIWSAEKSGALKPGMTMVEPTSGNTGIALAFVAASRGYDIVFTMPSSMSLERRKIMKALGATIVLTEPAKGMKGAIEKAQEIVDQNPDTHMMLQQFENPANPEIHEKTTGPEIWNDTDGTVDILVAGVGTGGTITGTSRYIKKEQGKAITSVAVEPVDSPVITQTINGDEVKPSPHKIQGIGAGFVPKNLDLELVDQVEQVSNEDAIATARLLMEKEGIMAGISCGAALCAALRVAKQPGNEGKNIVVILPDSGERYLSSALFEGMFSDNEMVQ

SEQ ID NO: 18638 - protein, 401 aa, Prosthecochloris aestuarii
MKKIGILTSGGDCGGLNAVIKGAAFMALSKGIEMYIIPNGYAGLYNLIDNEKLVLLDQARLDQFSGNFAGSEAGHSRVKIKAISNPEKYNRIKEGMKKFELDGLVVSGGDDSGSVMVDLNSNGIHCIHAPKTMDLDLQTYSVGGDSTINRIAQFVQDLKTTGRTHNRILVTEVFGRYAGHTAFRSGIAAEADCILIPEIPVDWDVVYEHIVGRFTRRIRQSDVSAGTYTIVVAEGMKNADGTDIIDESAGVDAFGHQKLAGAGKYVCQEMKKRLKADPDMPIFMKETGMFVEGIYEIPEIREIHPGHLVRSGNTSAYDVNFGYEAGAAAVILLSEGKSGVTISKVKGRKIEYIESTKAIEQRFVDLDQVALYESIGVCFGRHVAAYEPILREVDGVYDRIY

SEQ ID NO: 18639 - protein, 206 aa, Zea mays
  misc_feature (83)..(83): Xaa can be any naturally occurring amino acid
PITYIIVLDSTPSCISTNPNILILEQIAQLDLSSTWVFGVRWSPSGKTLAYAGHNSMIYFIDEVESSPVAQNLALRDLPLRDXVLFVSERTLIGVGFDCNPMIFAADDTGLWTFIRFLDERKAAPSASKASQLSEALGKLYGQSKQGTSSDTVEPSKPRGGSHENCITCIVPLRKGSDGSIKRFSTSGLDGKIVVWDLENHVSIAK

SEQ ID NO: 18640 - protein, 1526 aa, Oryza sativa
MSMAVASLRLLARGGRRRARFPAPLSVPGGRAAFLSGAAEEVAQADAPPPPPPGRKVLESFREEFEIGGRVISFETGKMARFANGSVVISMDDTHVLSTVAAAKSSEPVRDFLPLTVDYQEKQYAQGVIPTTYMRREGAPKERELLCGRIIDRPIRPLFPPGFYHEVQIMVNVISSDGKQDPDVMAANASSAALMLSDIPWNGPIGVIRVGRIDGNFVLNPTVDELGLSDLNLVYACSRDKTLMIDVQAREITERDLQAGMKLAHAEAVKCINPQLRLAKRAGKKKKEYKISLISDKSYEKIRTLSEAPIEEVFTDSTYGKFERGEALENITQSVKAKLEEECDEDSLKFLHKAVDTVRKQVIRKRIIEKGLRVDGRQLDEVRPLYCESSTYPILHGSALFSRGDTQVLCTVTLGAPGDAQRLDSIVGPPTKRFMLHYSFPPFSINEVAKRGGLNRREVGHDGLHGPIRLGDELRVWIEHKALDPTGFLLTNRLVFWERQWLSAGTLAEKALLAVLPPEGEFPYTVRVNSEVMASDGSTSMASVCGGSMALMDAGIPVREHVAGVSVGLVSEVDQTTGDISSYRILTDILGLEDHLGDMDFKIAGTRRGITAIQLDIKPAGIPLDIICESLEPARKARNQILDRMDQEISSARAFNDGSSPRLATLSFSSDSLRKLLFHRKKIEQETGARVSVSDGTVTIVAKTQPIMDKAIEKVEFLVGREIEVGRTYKGVVSSIKEYGAFVEFNGGQQGLLHISELSHDKVSKVSDVVSVGQVLSLTCIGQDLRGNIKLSLKATLPHAHEKKDLASNHTDPLPSQEVVGWTAVENMPSKDANAEPSISKDEDNMIEETPGCSTPAVIIRSAAECDAQDVTNDPKKKRPKVAKSSPKLSKPASERQEVKRTSAKKTSGASTTAKKNKKEKADSSNDVLDAIPEQNKSNIMNYSSPSNFRSGSMKLGDVVTAKVYQIRAYGLVLELSDGVRGMHKFAENGHKDFEVGEELLVKCSSFNAKGIPKYRTGRKIVAFSATRSHNDEACGSEAASDNRQEMNQKNEPKMRSSSRVAAMSNAGRRRRSLTSIAPSPVSSSSFPSGAREAQAPPSQLPSWKFSQVLGELPLAAAGEGHDNGTLQDDGDTISAIEFDGRGEHLAAGDHAGRVILFRRTDDESHPPPPPSRADLERTDYAAAAPPAYAYMAEFQSHEQELGDRREGEEAEMVRAAEQLVAVHARHQRPHRQALEASRQVSEHRSRKGNGQPRRRRSTPTSASLSEIALLGEGDSSVRNGYYYEWASKKARNYLSPDSAEHSEKASEVGEGYTAKCRRVFARAHVYNINSISNNCDGETFVSADDLRINLWHLEVTDQCFNVVDMKPADMEDLVEVITSAEFHPSSCSLLAFGSSRGFVRLVDLRQSALCDRNVRIFQDRGNSVQPRTLFTEIISCISDVKFTGDGKYLLTRDYMNLKLWDLRVESSPVATYKVHEFLRPKLSELYNNDCIFDRFSCCSSKGGDYFATGSYRFLLLQHINLISGV

SEQ ID NO: 18641 - protein, 216 aa, Nocardia farcinica
MTDTTLRHRTARVERVTKESSIVVELDLDGTGRTDISTGVPFYDHMLTALGAHASFDLSVRAEGDIQIEAHHTVEDTAIVFGQALGKALGDKAGIRRFGDAFIPMDETLAHAAVDVSGRPYCVHTGEPEHLLHAVIPGSPVRGTGEPGAPYSTVLNRHVFESIALNARIALHVRVLYGRDQHHVTEAEFKAVARALRAAVEFDPRVSGVPSTKGTL

SEQ ID NO: 18642 - protein, 217 aa, Aspergillus nidulans
MALTTEETALVETATVTINSIPVSEDYSVASAALSSDGRIFTGVNVYHFTGGPCAELVVMGVAAAAGVTHLKHIVAVGNNDRGVLSPCGRCRQVLLDLQPGVRVIIGKKGSEQSVPPSELLPCSYLYADPVIFKALVSSGPVVVDFFATWCGPCKAVAPVVGKFSETYTGVKFLQVDVDKARSIAQEHQIRAMPTFVLYKDDYQTAMRKPKANQKRN

SEQ ID NO: 18643 - protein, 778 aa, Oryza sativa
MPHRRRLLNPAPSLPPPPAAAPAGFHHHLLAVDDTRLPLLADYALLQGDAAAAPASAEWSAGSGFTGISTDPATATTATMASTATAPGSASNLTAATAGGGGRETWVRRAREGYYLQLSLAIRLTSEAFLAGVPPELLIGCGGGGEAENHADVAADAAAVSYRLWVNGCLSWGDKIAHGFYNILGVDPHVWAMCNAAAEDGRRLPTLVALRAVDSGESSVLEVVLVDKCGDPALADLERRALDLYRAAGVSLDLVRHLAVLVSDHMGGALRSEDGDLFMRWKAVSKQLRKRHRCVVVPIGSLSIGFCRHRAILFKSLADFIGLPCRIAQGCKYCSAPHRSSCLVKIDNERRFVREYVVDLVVEPGRLSSPDSSINGQLLSSVPSPFKTSCTMSSANYATPAASWNRAISGDRRNSILSNPQYSVAKYCVAEEKSSVQVATKEAMLPKCGQITQNGNCNKNSMAVFEVSKQMKAMEISSESGDKDNISSATPLKRLSIEPSFCADWLEISWDEIELKERVGAGSFGTVYRADWHGSDVAVKVLTDQDVGEAQLKEFLREIAIMKRVRHPNVVLFMGAVTKCPHLSIVTEYLPRGSLFRLINKASAGEMLDLRRRLRMALDVAKGINYLHCLNPPIVHWDLKTPNMLVDKNWSVKVGDFGLSRFKANTFISSKSVAGTPEWMAPEFLRGEPSNEKCDVYSFGVILWELMTMQQPWNGLSPAQVVGAVAFQNRRLPIPQETVPELAALVESCWDDDPRQRPSFSSIVDTLKKLLKSMLGGS

SEQ ID NO: 18644 - protein, 305 aa, Oryza sativa
MAGTPKITGKTTSMSGELKRDYEIGEEIGRGRFGVVHRCTSRATGEAFAVKSVDRSQLADDLDRELAELEPKLAQLAAAGNPGVVQVHAVYEDDAWTHMVMDLCSGPDLLDWIRLRRGAPVPEPVAAAVVAQLAEALAHCHRRGVAHRDVKPDNILLDVVDDGIDGGGTPRARLADFGSAAWVGESGGSAEGLVGTPHYVAPEVVAGGEYGEKADVWSAGVVLYVLLSGGALPFGGETAAEVLASVLRGSVRFPPRLFAGVSPAAKDLMRRMMCRDTWRRFSAEQVLGHPWIVSGGGARAMEQPT

SEQ ID NO: 18645 - protein, 119 aa, Nicotiana benthamiana
MAEVKLLGVSLSPFSRRVEWALNIKGVEYEFIEEDLQNKSPLLLESNPVHKKIPVLIHNGKPISESMVILEYIDETFEGPSILPKDPYERALARFWANFLDVKCITTIGKALFGKGEEQ

SEQ ID NO: 18646 - protein, 315 aa, Zea mays
  misc_feature (275)..(279): Xaa can be any naturally occurring amino acid
MSSKARSCLQSLQPLAITRRSLDEWPKADSDKVGEWPNPTTPGASKAGGRPSSARPGEGLRLDHSSLRSQGRKDQIAFFDKECSKVLCGDAVAKNRDILRKNGITHVLNCVGFVCPEYFKSDLVYRTLWLQDSPTEDITSILYDVFDYFEDVREQGGRVFVHCCQGVSRSTSLVIAYLMWREGQSFDDTFQFVKAARGIANPNMGFACQLLQCQKRVHAIPLSPNSVLRMYRMAPHSQYAPLHLVPKMLNDPSPATLDSRGAFIVHVLSSLYVWXXXXXVSSPSSPPSFSSSPPFAVSHSSAPLDPTVCTPPLPL

SEQ ID NO: 18647 - protein, 314 aa, Solanum peruvianum
KISFNKVPLYYRNVSGGSRLVSIRAQVTTEAPAKVEKISKKQEEGVIVNKFRPKEPYVGRCLLNTKITGDDAPGETWHMVFSTEGEVPYREGQSIGVIADGVDANGKPHKLRLYSIASSALGDFGDSKTVSLCVKRLVYTNDKGEEVKGVCSNFLCDLKPGAEVKITGPVGKEMLMPKDPNATVIMLATGTGIAPFRSFLWKMFFEKHEDYKFNGTAWLFLGVPTSSSLLYKEEFEKMKEKAPENFRLDFAVSREQTNEKGEKMYIQTRMAQYAEELWTLLQKDNTFIYMCGLKGMEQGIDEIMSSLAERDGIV

SEQ ID NO: 18648 - protein, 159 aa, Oryza sativa
PWQEISKPQRRKRAPRPPPPSSAMARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNLCAIHAKRVTIMPKDIQLARRIRGERA

SEQ ID NO: 18649 - protein, 392 aa, Staphylococcus epidermidis
MTEEFNESMINDIKEGDKVTGEVQQVEDKQVVVHINGGKFNGIIPISQLSTHHIENPSEVVKVGDEVEAYVTKIEFDEENDTGAYILSKRQLETEKSYEYLQEKLDNDEVIEAEVTEVVKGGLVVDVGQRGFVPASLISTDFIEDFSVFDGQTIRIKVEELDPENNRVILSRKAVEQLENDAKKASILDSLNEGDVIDGKVARLTNFGAFIDIGGVDGLVHVSELSHEHVQTPEEVVSVGEAVKVKVKSVEKDSERISLSIKDTLPTPFENIKGKFHEDDVIEGTVVRLANFGAFVEIAPSVQGLVHISEIDHKHIGSPNEVLEPGQQVNVKILGIDEDNERISLSIKATLPKENVIESDASTTQSYLEDDNDEDKPTLGDVFGDKFKDLKF

SEQ ID NO: 18650 - protein, 145 aa, Unknown
  Shewanella sp. ANA-3
MNWLKKIFSKHTSAPDDRDPNQSNAYDLIGGDKVIRAIANSFYQKMASSEETRALFAIHRAPIAESEQKLYEFLSGWLGGPQLYQQKYGHPALRARHMPFAVDETMRDQWLFCMKFAIEKHIKKPEHRAAIYEAISTLADHMRNQ

SEQ ID NO: 18651 - protein, 210 aa, Oryza sativa
  misc_feature (66)..(66): Xaa can be any naturally occurring amino acid
EYCEAMEEVTKAIMAVLGESLGVGGGYYREFFEDSSSPGLQEFGTGCPEPERTLGTGPHCDPSALXTVLLQDGDVDGLQVLVAGAWRPVRPLPGAFVVNIGDTFMALTNGRYKSCLHRAVVHREQERRSLAFFLCPREDRVVRPPAGAGAGERRLYPDFTWADFMRFTQRHYRADTRTLDAFARWLRPPACSGAAPVVGPPTTATQAATV

SEQ ID NO: 18652 - protein, 240 aa, Clostridium perfringens
MRIEKLSRVISDICNMGKEVVLVSSGAIGVGVGKLRLEKKPETIREKQAVAAVGQCALMHIYNKFFGEYSHVVAQVLLTRDVLENERMKNNVCNTFDTLLEKGIIPIVNENDAISIDEIQNILNFGDNDNLSAIVSTLVNADTLIILSDIDGFYDSDPRTNEDSKMLKEVYEITPEIEECAGGAGSNRGTGGMVTKLSAAKVATSNGIDMILANGENPEILIDILNGEDIGTMFVAKKGE

SEQ ID NO: 18653 - protein, 424 aa, Burkholderia pseudomallei
MGSRHGSGAFDPAPAIPARAWSVLFASTLAFLVCFVVWMMFGVLGVPLREDLHLNSTEFGLLTSTPVLTGALMRLPLGAWTDRFGGRIVMTVLLVVCSVPVYGVSYANALWQFLLIGLFLGCVGASFAVGTPYVARFFPPRRRGLAMGVFGAGTVGAAVNLFVTPLLLAAYGWRVVPRVYALALVVTAAVFWFASAPDPGAGEQKGSWVDSFKVLRDPRVWKLCQYYSITFGGFTALSLWIPQYLKNGYGMSLVAASAFAAGFSLPGSVLRALGGALADRYGAHAVTWWGLWVAWICLFLLSYPPTDLVIHTIDGTATLRLHVPLAAFVVLTFVLGAVFAFGMASTFKYVADDFPNNMGVVTGIVGLAGGLGGFLLPIIFGALVDLLRVRSTCFMFLYGIVWVSLILLYLAEIRRAPVTGAPPR

SEQ ID NO: 18654 - protein, 247 aa, Clostridium perfringens
MKKIRIIKNKEFLIKRCDEILEENKKDLEKAIEKGTSNAMLDRLKLDEERVKSIANAVADVVKLDDPIGEVTSMFKRPNGLRIGVQRVPLGVVGIIYEARPNVTADAAALCLKTGNAVILRGGSEAINSNLKIVEIISDALKEAGLPEGSVQILEDTSRETATDFMRLNDYLDVLIPRGGAGLIKAVVNNATVPVIETGVGNCHIYIDDEADINMGVDIIVNAKTSKPAVCNAAEKLLVNEKIAEEF

SEQ ID NO: 18655 - protein, 418 aa, Haemophilus somnus
MSLKEMGKNAKQAATILAQLSQQQKNTALQIIAEQLELQSDKILVENAKDIQLAKENGLSDAIIDRLLLTKERINSIAKDVRHIISLSDPIGQIIDGGILESGTKLERVRVPLGVIGVIYEARPNVTVDVATLCLKTSNAVILRGGKETNYSNKILVKVIQDALEQTGLPKNAVQAITDPDRNFVLELLKLDKYVDMIIPRGGAGLHEFCKQNSTIPVIIGGVGVCHVFVEESAEQDKALAVIDNAKTQRPSTCNTLETLLVQESIATEFLPKLVAHLKHKNVKYHADPTALSILEKQNAEVSIVQEQQLRQEWGSLDLNVVIVKDIQQAIAHITEYGTQHSEAILTSSPRLAHQFVSLVDAAAVYVNASTRFTDGGQFGLGAEVAVSTQKLHARGPMGLEALTTYKWVCSGDYTVRQ

SEQ ID NO: 18656 - protein, 165 aa, Arabidopsis thaliana
  misc_feature (62)..(62): Xaa can be any naturally occurring amino acid
  misc_feature (99)..(99): Xaa can be any naturally occurring amino acid
MGRRPARCYRQIKGKPYPKSRYCRGVPDPKIRIYDVGMKRKGVDEFPFCVHLGSRKKEECAXSKPLEAARMACNKYMVLLSVRCKDAHGHHAQEALRRXAKFKFPGRQKIIVSRKWGFTKFNRADFTKLRQEKRVVPDGVNAKFLSCHGPLANRQPGSAFLPAHY

SEQ ID NO: 18657 - protein, 361 aa, Daucus carota
MSSEVSAIGFEGFEKRLEISFFEPSFFADPEGKGLRVLSKNQLDEFLGPAECTIVASLSNEHVDSYVLSESSLFVYAYKIIIKTCGTTKLLKSIPPILKLADSLSLTVRSVRYTRGCFIFPGAQSYPHRSFSEEVSVLDNYFGKLGSGSKAYIMGGSDKQQKWHVYSACAASTRTLDPVYTMEMCMTSLNRDKASVFYKTNSSSATSVTDNSGLRDILPNSRICDFEFDPCGYSMNAVEGPAVSTIHITPEDGFSYSSFEAVGYDPKSVNLSDLVARVLNCFQPGEFSIALQADIASELLEKTSSVHVKGYRVEEKTCEELGMDGSIVYQKFVKTTERCESPRSVLKCCWKEEEKEEKEYQ

SEQ ID NO: 18658 - protein, 535 aa, Burkholderia pseudomallei
MLDAHLKTQLKSYLERITRPVELVASLDAGDQSRELRALLDEIAALSPQIFVTERRDAAERAPSFSVGEPGKAAGIRFAGMPMGHEFTSLVLALLQTGGHPIKLDDATIEQIRALDGDYAFETYISLTCQNCPEVVQALNVMALVNPRIRHVMIDGALFQDEVEARRIMAVPTIFLNGETFGQGRSSVKEILAKLDGGASRRAAQALAEKPVFDMLIVGGGPAGAAAAIYAARKGISTGVVAERFGGQVLDTMAIENFVSVQETEGPKFATALEQHVKQYDVDVIDVERADRLVPGRVHEIRLASGAVLKAKTVVLATGARWREIGVPGEREYRNRGVAYCPHCDGPLFKGKRVAVVGGGNSGVEAAIDLAGLAAAVTLIEYGEQLHADDVLQRKLRSLANVTVITQARTTELTGDGAKLNGLVYEDRRTGEAKRIALEGVFVQIGLVPNTEWLKETVELSRHGEIVVDTRGATSVPGVFAAGDVTTVPYKQIVIAVGEGAKASLGAFDHLIRSEAHAVQAADIEASANAEAMAA

SEQ ID NO: 18659 - protein, 353 aa, Vicia faba
MAVSAIGFEGFEKRLEISFSDPGLFSDPQGRGLRSLTKSQLDEILAPAECTIVSSLANEDVDSYVLSESSLFVYAYKIIIKTCGTTKLLLAIPPILKLAESISLDVRAVRYTRGSFIFPGAQSFPHRHFSEEVAVLDGFFGKLGSGSKAYIMGGSDEAQNWHVYCASADSVSPADSVYTLEMCMTGLDREKASVFFKQQTGSAAEMTVNSGIRKILPNSEICDFDFEPCGYSMNSVEGPAVSTIHITPEDGFSYASFETAGYDLKAMNLNEMVMRVLACFQPTEFSVAVHVDNASKSFEQGCLLDVKGYCCDEKSHQGLGMSGSVVYQKFVKASDCGSPRSTLKCWKDEDEEE

SEQ ID NO: 18660 - protein, 321 aa, Ehrlichia canis
MIHTYKTKVLIIGSGAAGCTAAIYAARANLEPILITGMCPGGQLTITTDVENFPGFAHAVQGPDLMEQMKQQAHNSGANVISDEIKEIHTDVYPFKCIGIFGDQYIAESIIIATGAQAKWLNIKSEETFKGRGVSACATCDGTFFTGSDVAVIGGGNTAVEEALYLTRHATKVFLVHRRDKLRAEPIMQERLLNNNKIQVIWDSVVEEILGNDENGTVEAVKLKSVKTGQFTTIKVKGVFIAIGHTPNTQILKNKDNSSIVELDQEGYIITKHGSTITSHPGIFAAGDVQDKIYRQAVVAAGSGCMAALEAAKFLSENTMH

SEQ ID NO: 18661 - protein, 352 aa, Glycine max
MGEVDAAFIQDPPHRPKLSTIQAEGIPIIDLSPITNHRVSDPSAIEGLVKEIGSACNEWGFFQVTNHGVPLTLRQNIEKASKLFFAQSAEEKRKVSRNESSPAGYYDTEHTKNVRDWKEVFDFLAKEPTFIPVTSDEHDDRVNQWTNQSPEYPLNFRVVTQEYIQEMEKLSFKILELIALSLGLEAKRFEEFFIKDQTSFIRLNHYPPCPYPDLALGVGRHKDPGALTILAQDEVGGLEVRRKADQEWIRVKPTPDAYIINIGDTVQVWSNDAYESVDHRVVVNSEKERFSIPFFFFPAHDTEVKPLEELINEQNPSKYRPYKWGKFLVHRGNSNFKKQNEENIQIYHYKIA

SEQ ID NO: 18662 - protein, 242 aa, Oryza sativa
  misc_feature (121)..(121): Xaa can be any naturally occurring amino acid
MSSSSTSGSAEPAAAVRVLGSWTSPFVMRVVVALKLKGVEEYELLQETRGKKSELLLRSNPVHKKIPVLLHHGKPLAESLIIVEYIDEVWPASDGAPAILPRDPYCRAVERFWAQYIDDKXSSGDSRVERNRGRRGTVVEMSTALKHLEEAFVKCSQGKKYFGGDKIGYLDIALGSFLGWIKAVEKFAGVELLDEAKVPNLAAWADRFCAHPAVVDAMPDADKLVEFAVKHAASMKALDAPK

SEQ ID NO: 18663 - protein, 362 aa, Ipomoea batatas
MALSTSAIGFEGYENRLEISFFEAGIFSDPEGRGLRALSKEQLDKVLKPAECTIVSSLSNNEVDSYVLSESSLFVYPYKIIIKTCGTTKLLLSIPPILELADGLSLKVKSVKYTRGSFNFPEVQPYPHRNFSEEVAILDSYFGKLSTGSKAYVMGGAGKQQQWHVYSASAESAENTFPIYTLEMCMTGLDKKSASVFFKTQSSSAAVMTDASGIRKILPGSEICDFDFEPCGYSMNAVEGGAISPIHVTPEDGFSYASFEAMGYDFKDVNLDALIQRVLSCFQPAEFSVALHCDSIGEKLDSVFKLDVKGYACGERSYEGLNKGGSIMYCGFTSTGSCGSPRSTLLCCWSENEDEEGEKKHF

SEQ ID NO: 18664 - protein, 367 aa, Brassica juncea
MALSAIGFEGYEKRLEVSFFEPSFFQDSKGLGLRALTRSQLDEILTPAACEIVSSLSNDHLDSYVLSESSFFVYPYKVIIKTCGTTKLLLSIPPLLKLAGELSLSVKSVKYTRGSFLCPGGQPFPHRSFSEEVSVLDGHFTKLGLNSVAYLMGNDDENKKWHVYAASAQTSSDCNNNVYTLEMCMTGLDKEKASVFYKNETGGENGSMTDNSGIRKILPKSQICDFEFEPCGYSMNSVEGDAISTIHVTPEDGFSYASFEAVGYDFNTLDLSQLVTRVLSCFEPKQFSVAVHSSVGSNAYKPEISVDLEDYGCRERTFESLGEESGTVMYQTFEKLGKYCGSPRSTLKCEWSSNNSCSSEDEKDEGI

SEQ ID NO: 18665 - protein, 321 aa, Oryza sativa
MGETIAKDVTELIGNTPLVYLNRVTDGCVGRVAAKLESMEPCSSVKDRIGYSMITDAEEKGLITPGKSVLIEPTSGNTGIGLAFMAAAKGYRLVLTMPASMSMERRIILKAFGAELILTDPLLGMKGAVQKAEELAAKTNNSFILQQFENPANPKIHYETTGPEIWKGTGGKVDGLVSGIGTGGTITGAGRYLREQNPDIKIYGVEPVESAVLSGGKPGPHKIQGIGAGFVPGVLDVDLINETVQVSSDEAIEMAKALALKEGLLVGISSGAAAAAAVRLAQRPENEGKLFVVVFPSFGERYLSSVLFQSIKKEAENMVVE

SEQ ID NO: 18666 - protein, 337 aa, Pasteurella multocida
MNTTVATSPITVLGAGSYGTALAIAFSRNGFPTYLWGHDPVHMQRLSEERQNNAFLPNIAFPDALHIEFDLASALSQSRDLLIVVPSHVFGEVIDKIKPYLRPDHRIAWATKGLERNTGRLLQEVIEEKLGTQHPLAVLSGPTFAKELAAGLPTAIALASNNEQFALEFQARIHCSKHFRVYINQDMIGVQLGGAIKNVIAISAGMSDGMGFGANARTALITRGIAEISRLGASLGANPNTFMGMSGLGDLVLTCTDDQSRNRRFGIMLGQGFSAQTAMDNIGQVVEGFYNAKEAYLLAQRQGIEMPITEQVYQVLFCGKNAQDVAASLLGRERKGE

SEQ ID NO: 18667 - protein, 120 aa, Nicotiana benthamiana
IPVLIHNGKTICESIIAVEYIEEVWKDKAPNLLPSDPYDRAQARFWADYIDKKLYDVGRKLWATKGEEQEAAKKDFIECLKVLEGALGDKPYFGGESFGFVDIALIGYYSWFYAYETFGN

SEQ ID NO: 18668 - protein, 470 aa, Listeria innocua
MNNLKLSEEIKRAINELGYKEATPVQKAVIPVALTGEDIVAKSQTGSGKTAAFAIPIAEQVVWEENKPQALIIVPTRELAMQVKTECTNIGRFKRIKAAAIYGQSPFAKQKLELSQKNHIVVGTPGRLLDHIEKGSLNVDKVAHLVLDEVDEMLSMGFIDQVEDILSRLPKQRQNLFFSATLPEEMQDLIKRYQDNPMVIEMASEKTNPIFHVEMQTDNKEKTLKDVLITENPDSAIIFCNTKNQVDELTDLLDVKASKIHGGLRQEDRFRAMDDFKSGKSRFLIATDVAGRGIDVDNVSLVINYDLPIEKENYVHRIGRTGRAGKSGKAISFVKTNENPLLRDIEEMLNITIEKKRKPTIIEVKANEEAFRKKQQKRPTIKKARGEKLNKNIMKLYFNGGKKKKIRAVDFVGTISKLEGITAEDIGIITIEDHVSFVEILNGKGPAVLEMMRSRKVKGRRLKVNEARKR

SEQ ID NO: 18669 - protein, 122 aa, Nicotiana benthamiana
TKEPILIHNSKPICESLNILEYIDEVWHDKCPLLPSDPYEKSRARFWADYIDKKIYSTGRRVWSGKGEDQEEAKKEFLEIFKTLEGELGNKTYFGGDNLGFVDVALVPFTSWFYSYETFANF

SEQ ID NO: 18670 - protein, 250 aa, Ipomoea batatas
MGKCYPTVSEEYKKAIEKLRRKLRGFIADKNCAPLMLPLAWHSAGTYDVSSKTGGPFGTMRLKAEQAHGANNGLDIAVRLLEPFKEQFPIVSYADFYQLAGVVAVEITGGPDVPFHPGREDKTEPPVEGRLPDATQGNDHLRDVFVKQMGLSDKDIVALSGGHTLGRCHKERSGFEGPWTTNPLIFDNSYFTELLSGEKEGLLQLPTDKALLNDSVFRPLVEKYAADEDAFFADYPEAHLKLSELGYAEA

SEQ ID NO: 18671 - protein, 314 aa, Solanum peruvianum
KINFNKVPLYYRNVSGGSRLVSIRAQVTTEAPAKVEKISKKQEEGVIVNKFRPKEPYVGRCLLNTKITGDDAPGETWHMVFSTEGEVPYREGQSIGVIADGVDANGKPHKLRLYSIASSALGDFGDSKTVSLCVKRLVYTNDKGEEVKGVCSNFLCDLKPGAEVKITGPVGKEMLMPKDPNATVIMLATGTGIAPFRSFLWKMFFEKHEDYKFNGTAWLFLGVPTSSSLLYKEEFEKMKEKAPENFRLDFAVSREQTNEKGEKMYIQTRMAQYAEELWTLLQKDNTFIYMCGLKGMEQGIDEIMSSLAERDGIV

SEQ ID NO: 18672 - protein, 670 aa, Oryza sativa
MAHRAGCLSMLLTAAVVLLALAPRGAAYPWQVCGTTGNFTANSTYQANLDAVAAALPRNISSSPDLFATAMVGAVPEQVSALALCRGDANATECSGCLATAFQDVQNMCAYDKDAAIYYDPCILYYSNVPFLSSVDNAASTSRVNLQNVTSDPGRFNGMVAALVNATADYAAHNSTRRYASGEAVLDRESEFPKVYSWAQCTPDLTPAQCGDCLAAIIAKLPRLFTNRIGGRVLGVRCSYRYEVNPFLNGLVMVHLTAPPIPTASPPAAAAAAAGEGKDYNVPRLVLAILLPTIAALVLINILVWLCFWRRMERLRSGATQPYSSNSAESENISSVESMLIDISTLRAATGCFAERNKLGEGGFGAVYKGTLPDGDEIAVKRLSKSSAQGVGELKNELALVAKLQHKNLVRLVGVCLEQEERLLVYEFVPNRSLDQILFDADKRQQLDWGKRYKIINGIARGLQYLHEDSQLKVVHRDLKASNILLDMNMNPKISDFGLARLFGRDQTQGVTNLVIGTYGYMSPEYAMRGNYSLKSDVFSFGVMVLEIVTGKKNNDCYNSLQSEDLLTLVWEQWTARAVSEAVDPVMGGGFSWSDVMRCIHIGLLCVQENPADRPVMSSVVMMLGSDTVSLRAPSKPAFCARRNGGTGGAGASSGGTSSGTSTAASVQGK

SEQ ID NO: 18673 - protein, 338 aa, Mycoplasma penetrans
MINNRICILGTGAWATALGSRLSLNGNTVFLWGIDNNEVNDINSGYNKKYFGNTKFSSSLSATTDLKTAIGDSKYIIFAIPSTALDSVLDKVKEFLSDKKSQVILINVVKGIDAETSQILSNKIKSKLGSHYYSRLVTLCGPSFATEVFEEKPTVINGTGKNLKIVKQVCELFNSDVFKVIPINDIVGLQVFSSLKNLLAIAVGLSQAEYTSVNTMSAILTMGIEEIQKIACKMKAKKWTIMSFCGIGDIFLTCSSTQSRNYSFGQDLLKKGVEKTIKENKKTVEGFEVYKTAKNIITKYNINAPIFSSIIEVLEGKLDPKEFSKKCLELFWNQKINK

SEQ ID NO: 18674 - protein, 408 aa, Arabidopsis thaliana
MEVFRLGELRHLLVTVFLSGLAEYLIRPVMTDVTVAAVCSGLDDSCSLAVYLTGVQQVTVGMGTMVMMPVIGNLSDRYGIKAMLTLPMCLSVLPPAILGYRRDTNFFYAFYVIKTLFDMVCQGTIDCLANAYVAKNVHGTKRISMFGILAGVSSISGVCASLSARFLSIASTFQVAAISLFIGLVYMRVFLKERLQDADDDDEADSGGCRSHQEVHNGGDLKMLTEPILRDAPTKTHVFNSKYSSWKDMVSLINNSTILIQALVVTFFATFSESGRGSALMYFLKARFGFNKNDFAELFLLVTIIGSISQLFILPTLSSTIGERKVLSTGLLMEFFNATCLSVAWSPWVPYAMTMLVPGAMFVMPSVCGIASRQVGSSEQGKVQGCISGVRAFAQVVAPFVYSPLTGK

SEQ ID NO: 18675 - protein, 190 aa, Oryza sativa
MSNDTGADGGAANPDLGPDADAAAGEGLELAQFAAGCFWSVELTYQRLPGVARTEVGFSQGHHHEPTYDDVCGQGTGHAEVVRVHYDPKACPYGVLLDVFWAKHRPTTLIRQGDEAGTQYRSGIYYYTAEQERVARESLEAKQEEWKEKIVTEILPARRFYPAEEYHQRYLEKGGQSAQKGCTDPIRRYG

SEQ ID NO: 18676 - protein, 456 aa, Arabidopsis thaliana
MEDGIGGLRHMLATVFLSAFAGFMVVPVITDVTVAAVCSGPDDSCSLAVYLTGFQQVAIGMGTMIMMPVIGNLSDRYGIKTILTLPMCLSIVPPVILGYRRDIKFFYVFYISKILTSMVCEGTVDCLAYAYVAVNIHGSTRISAFGILAGIKTIAGLFGTLVARFLPIALTFQVSAISFFVGLVYMRVFLKEKLNDDEDDDLHHGTYHQEDHDSINTTMLAEPILNDRPIKTQVFHKKYSSLKDMISLMKTSTIFFQALVVTFFSSFSDSGMESAFLYFLKARFGFDKKQFADLLLLITIVGSISQLFVLPRFASAIGECKLLSTGLFMEFINMAIVSISWAPWVPYLTTVFVPGALFVMPSVCGIASRQVGPGEQGKVQGCISGVRSFGKVVAPFVFSPLTALFLSKNAPFYFPGFSLLCISLSSLIGFFQSLLIKDVPTPPLNKAINKTSGEEV

SEQ ID NO: 18677 - protein, 542 aa, Streptococcus pyogenes
MTIDKKKVVYQIYPKSYKDTTGNGVGDLRGIIAKLPYLQELGIDMIWLNPFYPSPQRDNGYDVSDYTAVNPDFGTMADFEDLVKAAKEHQIELMLDMVLNHCSTDHEWFQKALAGDPYYQDFFILRDQPTDWVSKFGGNAWAPFGDTGKYYLHLFDVTQADLNWRNPHVREELAKVVNFWRDKGVKGFRFDVINLIGKDEELVDCPVNDGKPAYTDRPITHTYLHDLNQASFGQDDSFMTVGEMSATTIDNCLLYTAPEREELSMAFNFHHLKVDYENGQKWTIMAFDFAALRDLFHAWGEGMSQGNGWNALFYNNHDQPRALNRFVDVTHFRNEGATMLAASIHLSRGTPYIYMGEEIGMLDPDFDSMDDYVDVESLNAYSSLLVSGKSAEEAFAIIKDKSRDNARTPMQWDASEHAGFTTGKPWLEVSKSYRDINVETEKEGRIFPFYQRLIALRKELPIIAEGDYRAAFKDSQSVYAFERHLGDQCLLVLNHFYADEVELELPPRYQHGQVLISNYEKVSICEKVILKPYQTLAILAEN

SEQ ID NO: 18678 - protein, 400 aa, Enterococcus hirae
MNTTINKHALVFGFTSVFLIGLGLTIVNPVIPFMVEQYTKNTQQQATTVTLLSAIYAFSMFLAAPMLGALSDRFGRKIILISSLFGSAIGYYLFGFGGALWILFLGRIIEGLTGGEISAILAYFADLTPIESRTKYFGWISATVGIGTAAGPLIGGFLAQYGPAIPLYVASFLSLSNAVYGYFFMPESLTKRERTRNLSLQQINPFKQLQLVFTFRSVKWLLITGFLIWLPNGSFQAIFAQFSIDTFHLSPIIIGFTFSLIGIMDIFAQLLIMPILLKFWRENQIITMGITSEMIGYSVIILSAFYGSIPCFIIGMVFFGLGDAIFSPSYNGLISTYASKEDQGKIQGASQSIQALARVIGPMIGGQLYANFHHTMPFIIGFILLGLATFIVKPKVKRSF

SEQ ID NO: 18679 - protein, 191 aa, Zea mays
  misc_feature (84)..(84): Xaa can be any naturally occurring amino acid
  misc_feature (97)..(97): Xaa can be any naturally occurring amino acid
  misc_feature (101)..(101): Xaa can be any naturally occurring amino acid
KKKPKKKKKKKIFKKKKKRPQGKAPRARRGPPPPAPSGKSGTGQSRSKGKPTPTRATPGEQQAPAAAKKAEPGERPAPDGGTKXGTPQRGEKPERAXGAPXTGEETKNKRERSQNQKAHPGGPAEKKRKGGTGETRRRAARITEKAKVFDSPKGKKTPKRSRNSRGSKGRQEKKEAPETEKAKDAKTGQHA

SEQ ID NO: 18680 - protein, 753 aa, Rhodopirellula baltica
MSISIKDNRNDAGKTFQLPTLLQRRTGPMTRELVLRPGDHGLGMTHDSMAADTTTTATCGFCATGCGLRLHLKDGEAIGLTPETAYPVNLGMACPKGWEALRVLDSPERATLPLLRDETGKLSPIEWDDAFSKFCDGMKQVQSEHGPESIAFLSTGQIACEEMAFLGALARFGMDIRHCDGNTRQCMATAVTAYKESFGFDSPPYTYDDFEQSDCLVFIGANPCVGHPIMWERVLRNPHNPEIIVIDPRRTETAAAATQHLQLRPKNDLALLYAITNELILRDFVEHDFVQNHTQGFEELRQHVSQYDLATVCEEAGLAVEDVSAAVEAIGRGRAVSLWWTMGVNQSYQGTRTAQAIINIALITGNIGRPGTGANSITGQCNAMGSRLWSNTTNLFGHHSFTEESDRRKVAEALNIPVEKIPSTTSWKYDRIIEGIRNGEIKGLWVVATNPAHSWIDQGDVRELFDQLDFLVVQDMYKTTETCSHADLILPSAGWGEKEGTFINSERRYGLLKKVRHAPGQALADFQIFRGIAHRWGVGEMFAEWTSPEAVFQIMQRASRGQPSDISGIEGYEQIDRCGGIQWPWSADHASGGFEPEQQRRLFADGRFFHEDRRARLIVDDVSPMPEPAGEDYPIVLLTGRGTVSQWHTQTRTRQSPLLRSLYPNQPYVEMHPRDAAELDVEHGDLVRVRSRRGHADATACLTHSVQPGQVFMPMHYECTNQLTLSHFDPHSGQPSYKDCAVRIEPVLTSDHD

SEQ ID NO: 18681 - protein, 486 aa, Burkholderia thailandensis
MSSFDSTAPAVVWFRDDLRVSDHPALARAAESGRPVIGVYVFDERAGGRALGGAARWWLHGSLRALDAALAGLGGRLVLLRGDEADTFVSFVAALGAGAVYWNRRYAFAQRALDNAVQTALDARRVAVETFNASLLFEPDDIVNGDGRPYQVFGAYWRAALRRGAPPPPLAAPRRLNGGALPEALARRRVELDALGLEPTRPDWAGGLRDAWRFGEDAAHSLLRAFVDSRLGGYATERDRPGIASTSRLSPYVRFGNLSVRQIWQAAVDAHAHRAATQADLDKFLSELGWREFCWAQLYRFPDLPRRNLRHTLDGMPWRDDPAGLAAWRRGATGYPFVDAGMRELWATGWMHNRARMVCASFLVKHLLIDWREGEAWFWDTLVDADAASNAANWQWVAGCGADAAPYFRIFNPVAQGKKFDPDGAYVRRWVPELAGLPPAAIHEPWAAPPAQLAAAGVRLGDTYPVPVVAHDAARRRALDAFATAG

SEQ ID NO: 18682 - protein, 614 aa, Bacillus subtilis
MCGITGWVDFKKQLVQEKQTMDRMTDTLSKRGPDDSNVWGEHHVLFGHKRLAVVDIEGGRQPMACTYKGDTYTIIYNGELYNTEDLRKELRARGHQFERTSDTEVLLHSYIEWQEDCVDHLNGIFAFAVWDEKRNLLFAARDRLGVKPFFYTKEGSSFLFGSEIKAILAHPDIKARVDRTGLSEIFGLGPSRTPGTGIFKGIKEIRPAHALTFSKDGLNIWRYWNVESEKHTDSFDDTVANVRSLFQDAVTRQLVSDVPVCTFLSGGLDSSAITAIAAGHFEKEGKAPLHTYSIDYEENDKYFQASAFQPNDDGPWIEKMTEAFGTTHHKCVISQKDLVDHLEEAVLVKDLPGMADVDSSLLWFCREIKKDFVVSLSGECADEIFGGYPWFHTADVESGFPWMRSTEERIKLLSDSWQKKLNLKEYVNAKYEETLAETPLLDGETGVDKARRQLFYLNMLWFMTNLLDRKDRMSMGASLEVRVPFADHRLVEYVWNIPWEMKMHDNREKGILRKALEGILPDDILYRKKSPYPKTHHPEYTKGVSEWLKTIRSQKDSVLHTLLDRKQLDQLLETEGSSFKVPWFGQLMKGPQLIAHLAQIHTWFEAYRIDIDER

SEQ ID NO: 18683 - protein, 875 aa, Oryza sativa
MARSSADDMELKRSCEAGILSKEKDRETVVMSMRVAKGRGVWGKAGKLASRQMAKPRVLAVTTKKKGQRTKAFVRVLKYSNGGVLEPAKVYKMKHLSKVEVVPNDPSGCTFLLGFDNLRSQSVSPPQWTMRNKDDRNRFLMCILNMCKEIYGAIPKVVGMDVVEMAMWAKDNTTVKVTQVSTKDGPIESLVGEADSQVAIQKDLVLQTEDEDTEALLDTYIMAIGEAEAFSERMKRELVALESANVYALMETETVIEEVLEGLEIASICVEDFDEWLGIFNVKLRHMREDIQSIEWRNNKLELQSDSNVALIDELDKMLVLLQIPPEYEASLTGGSFDEGNMVKNIEACEWLTSAIKNLEASNLDPIYVKLRAVREKRAEFVLLKCTFVRRASEFLRNYFPSLIDFMLNDKGNFSQRGQLQRPDHADMRYKCRTYARLLQFIKNLDKSCLMPLRKSYCHSLNLLIRREAREFSSELRAGSKASKSSTPLFEGPASANQSISITDTTADAYCKMITVFIPLLVDESSFFAHFMCFDVAALAPSDESDNNNPVAVSEPPGSSAKPINSSAELGVLNQFLQELLDGIQEDFYAIVDWAFKLDPLSCISMHGITDRYLSGQKAEVAGYVHVLLDDLETRISILFSRFVDDACYQIEKYERNVRQIGVVPYIPRFSQLAARMEQYINGSRDLVDQAYTKIVTIMFVTLEKIAQVEPKYVDIVLLENYAAFQHSLYDLANVVPTLAKYYHQASEAYEQACSRHINLVIYIHFEKLFQFARKIEELMYNMSPEEIPFQVGMSKVDFRKMLKSSLSGLDKTINAMYRKLQKNITAEELLPSLWDKCKKEFLDKYATFLKLISKIYPSETVISVNEMKDTLASL

SEQ ID NO: 18684 - protein, 562 aa, Moorella thermoacetica
MLKEILIQDDAEETAVALLEDGRLMEIYLERDSNQRLVGNIYKGRVANVLPGMQAAFVDIGLEKNAFLFVDDTSGIEALEGEIVSRSRRRISDVVREGQEILVQVAKEPQGTKGARVTTQITLPGRYLVLMPTVNYIGVSRRISHEEERERLKNLARAVKPRRMGLIVRTVAAGAGLEELQADCQNLTRTWKRIRQAARRSKAPRLVHHDVELSLRILRDLYADDVNRLVVNSPATYAKVLEVLAGRAPNLRQRVILRENADLFAVYGVQNQIEQALKRKVWLRCGGYLIIDQMEALTAIDVNTGKYVGRHNLAETVLTTNLEAAVEVARQLRLRNIGGIIVVDFIDMDNPLHREQVIKVLEGELTKDKTKTQILGFTRLGLLEMTRKKAQQRLESVLQQDCPYCHGTGKVLSAETVTLKARKEILQLAAVSKARAILAEANPAVAAPLIGVGGANLRTLERRAGKKLIIKGNENFHLEEVRLRELFDREEIANLSTPVKVGQVLQVTIEGVHTGNGGDGIARVAGFVLDIPGGAAYLGREVPVEITRVFRTYARARLLANA

SEQ ID NO: 18685 - protein, 366 aa, Sorghum bicolor
RPLEYAWNKAANILFAESPAGVGFSYSNTSSDLSMGDDKMAQDTYTFLVKWFERFPHYKYREFYIAGESGHFIPQLSQVVYRNRNNSPFINFQGLLVSSGLTNDHEDMIGMFESWWHHGLISDETRDSGLKVCPGTSFMHPTPECTEVWNKALAEQGNINPYTIYTPTCDREPSPYQRRFWAPHGRAAPPPLMLPPYDPCAVFNSINYLNLPEVQTALHANVSGIVEYPWTVCSNTIFDQWGQAADDLLPVYRELIQAGLRVWVYSGDTDSVVPVSSTRRSLAALELPVKTSWYPWYMAPTEREVGGWSVQYEGLTYVSPSGAGHLVPVHRPAQAFLLFKQFLKGEPMPAEEKNDILLPSQKAPFY

SEQ ID NO: 18686 - protein, 504 aa, Bordetella bronchiseptica
MKEHDAAQGGTRTETEVLLIGTGFSGLGMAVALKREGRRDFIVLERAGDVGGTWRDNHYPGAACDIQSHLYSYSFRPNPRWSRVYAPQPEILQYLRDTARDEGILDHVRFGANVVRAAWDAAQAAWLVDTTAGRFKAQVLISAAGHLSDPSFPDIEGLASFRGAVFHSANWDHSYDLAGKRIGVIGTGASAIQIVPELARNAGQLTVFQRSAPYVIPRRDHVYSEAEKGLFARFPEAAQELRDELFWGNESRFPQRRQVPAFIEQVTAMALSHLRKQVPDEALRAQLTPHYAIGCKRVLISNDYYPALQQPNVALETAGIARIDEQGVVLKSGGRVDLDLLVVATGFEAAELPIAERIHGRQGRRLSDQWRAGGQAFACTAVSGFPNFFLMLGPNTGLGAGSMIFMVETQINYIKGAVAFIFEHGAIVDPDPDAQRDYVESIYRRSAGTVWLDGGCSSWYLHPQSGKLTTLWPDFMTQFRKENGTFSRQGYQVALRAPHAAEQA

SEQ ID NO: 18687 - protein, 796 aa, Ehrlichia canis
MFNLIRKSTEWGGKTLILESGKIARQANGAVMVSYAGTTVLATVVTGKTKEPVDFLPLTVQFVAKSYAVGKIPGGFLKREGKPSDRETLISRLIDRSIRPLFPSGFYDEVSIVCNLLSYDTVTPPEVTALIGATAALSISGVSFNGLVAGVRIGYLPSEDKYLLNASADDMLYSSLDLFLSGNEDSVLMVESEASELSESQMLRAVTFGHQNCQEVINLIREFSEEKGVQPIEFIPHDINPIVNYIESSYKQDFSLAYSNTVKKERVLKLEELRDKVLSDFAEKCSVDNVECDNQDVISALKSFERSLVRSQIVETSSRIDGRAFDEIRNIEIEVDVLPKAHGSALFTRGNTQALVVTALGTPQDEQIVDDLDGDRRENFLLHYNFPPYAVGESAALRAPGRREIGHGKLAWRAIRYVLPEKSDFPYTIRVVSEITESDGSSSMATVCGASLALMDTGVPIKSPVAGIAMGLIKEGDKFIILSDILGDEDYLGDMDFKVAGTAEGVTALQMDMKISGISVDVIEKALLQAKDGRMHILSKMNAVIQESRNSIKNHAPRIESIFINKDKIRNVIGSGGKNIRDICEKTGAKIEIIQDGTVMIYAVNNEAVEYAKSMIMDIVTEPEIGKVFEGTVVEIVKFGAFVNFLGGKRGLIHISEIKNEHISAVGSVISVNDKVKVLVIGIDREHVQLSMRRVDQETGEPIDGELYNVRKSSFSDDSSSSGTSSSGSSFKESYSGNRHGSHEKRRSGGSRSSRRNSSGSNYYREDLHSSDFGNNNRSFSNSRNGHEVPRKPRFF

SEQ ID NO: 18688 - protein, 124 aa, Zea mays
AAAALTKGGADDATRKPLPPCCVKAKARVPETEANCHDTVVSGWFTEPRSRFGKTSKVQYFNNPMWPGEAHSLKVEKILFQGKSPYQEILVFESSTYGNVLVLDGIVQLTDKDECAYQEMVTHL

SEQ ID NO: 18689 - protein, 179 aa, Glycine max
MCLLEQEVVNFCKSYFVVNKEAFRDTRLEVVINDARVELEARDESYDVIIGDLADPIDGGPCYKLYTKSFYELIVKPRLKQGGIFVTQAGPAGIFSHTEVFSCIYNTLRQVFKCKCLPREKKRLFFPIKFFLVQYKVLLTSIASNSPSFLLFADVVPYSAHIPSYADIWGWVMVNITDN

SEQ ID NO: 18690 - protein, 378 aa, Moorella thermoacetica
MTERECRLALSQARRLVIKVGTSTLTHKTGKLNLGRMERLVRELVDQVNAGRQVVLVTSGAVGAGMGRLGLKEKPRTLPEKQAAAAVGQGLLMHMYEKFFSDYGLLVAQVLLTRADLADRSRYLNSRHTLAALLRLGVVPIVNENDTVAVEEIRVGDNDTLSALVAGLVDADILFLLTDTGGLFTANPVTSDDAVLLPCVTEITPEIEALAGGAGSTWSTGGMATKIQAARLATSFGIPVVIASGLQAGQIEAVLKGEEIGTIFLPREHRAHTRKRWLAYAPAVQGQIQVDAGAARAICKNGKSLLPGGVIAVDGDFDQGAIVSIVDPAGKEIARGMANYPAAAISRIKGRKTGEIGEILGYKDYDEIVHRDNLIVLG

SEQ ID NO: 18691 - protein, 553 aa, Unknown
  Synechococcus sp. WH 8102
MSQTMPWWTGTVIYQLIVRSFADGNGDGIGDFKGLASRLPYLRWLGVKTLWLTPTYPSPLRDGGYDITDFKDIHPDLGDLASFHRFLTAAHSQGMRVILDLVLNHTSDLHPWFQRARWAPKGSTERDVYVWSDDPSRYSDAPVLFRHFEASNWEWDPVAEQYYLHRFLSHQPDLNYANPWVQEAMLEVVDFWLERGVDGFRLDAVPFLFEEEGTRCEGLPETHAFLRRLRARVDAMGREVLLLGEAIQPVQEAAPYLAKDELHGAFNFVLTAHLFAAVASGSTRQLGDCLNEAEHAVDGPRWALPLRNHDELWLGDGHLIPDEVIQSIRVGLPQGQGHWLNWGINRRLAPLLNGDPRSNRLLHGLIYSLPGMPCLYYGDELGMGDWPGLRDRDPNRTPMAWTPARNGGFSSAPDPLLVLPPITAPGYDYRVVNVEVQKQLPGSLLNWHRRMLTCRRLLPALAHGSLQLLPCSHPGALVYVRATEAMTVLVAGNVTAAGASFSLDLTAWEGLRTREVMWGCEFPLASREWFVNLSPYGINWWLIGEVDTAVPVS

SEQ ID NO: 18692 - protein, 418 aa, Moorella thermoacetica
MNVALEVQTKGQRAREAARILAGLGTSKKNEALLAMARALEEEQEAILAANARDMVAGKEKGLSRALLDRLLLNEKRIRDMAAGLRELAALPDPVGEVTSMWTRPNGLQIGRVRVPLGVIGIIYEARPNVTVDAAGLCLKTGNAVILRGGSEAFYSNQALTRVISRAATAAGAPEGAIQLIETTDREAVNLLLRANDYLDVLIPRGGAGLIRTVVENATVPVIETGVGNCHVYVDAEADLDMAQRIVINAKTQRPGVCNAMETLLVHEKVADSFLPSLAAALKEKGVTIRGCERTRAIIPWAEVATETDWATEYLDLILAIRVVDSLESALEHIHRYGTKHSEAIVTTNYQTAREFLARVDAAAVYVNASTRFTDGYEFGFGAEIGISTQKLHARGPMGPEQLTTFKYIIFGSGQIRQ

SEQ ID NO: 18693 - protein, 651 aa, Unknown
  Malus x domestica
MAQNHERVPGNLRKQFAVAVRSIKWSYAIFWSLSTTQQGVLEWGEGYYNGDIKTRKKVEGVELKTDKMGLQRNVQLRELYKSLLEGETETEQQAKAPSAVLSPEDLTDAEWYYLLCMSFIFNPGEGLPGRALATGQTIWLCNAQHTDSKVFSRSLLAKSASVQTVVCFPYLGGVVELGVTELVSEDLNLIQHIKASLLDFSKPDCCEKSSSAPHKPDDDSEQIVAKVDHDVVDTLPLENLYSPSEEIKFDQRGINGLLGNHEEVNMDSSDECSNGCDHNHPTEDSMMLEGTNAVASQVQSWHFMDEDFSSGVQDSMNSSDSISEAFVNQGKAHSFAKHENANHIHLKELQNFNDTKLSSLYLGSVDEHVHYKRTLCTLLGSSMKLIENPCFCDGESKSSFVKWKKEVVGSCRPTVHQKTLKKILFTVPLMYGVHSPMATGKENTGKDLLPNLQGDDINREHDKMRENAKLLVLRSMVPSITEVDKASILDDTIKYLKELEARAEEMESCMDTVEAISRGKFLNRVEKTSDNYDKTKKNNVKKSLVKKRKACDIDETDPYPNMLVSGESLPLDVKVCVKEQEVLIEMRCPYREYILLDIMDAINNLYLDAHSVQSSILDGVLTLSLKSKFRGAAISPVGMIKQVLWKIAGKC

SEQ ID NO: 18694 - protein, 359 aa, Unknown
  Marinobacter sp. ELB17
MNKFYSLALKEVRPETRNAVSLSFDLPTDVAEKFKYKQGQHLVVRTKVDGEEVRRTYSICSSVNDQELRIAIKRVPGGVFSSFANDLLKPGSVLDVMPPQGHFSVELDPERKGNYLAVAAGSGITPILSIIKTTLETEPRSEFTLFYGNKGTSSTMFRDHLQDLKNEYMTRFNLVYIFTREEQDIDLYNGRIDSDKCDRLFDHWIDAKNLTAAFLCGPQMMTETVRDSLARHGMDKSKVHYELFTPAGGVPKARKDRAETKVDLQAVSVVTVKADGRSLTFDLVRDTKSILQAGNDEGADLPYSCQAGVCSTCRAKVIEGEVEMDQNFALEDYEVAAGYVLSCQCYPVSDKVVLDYDEM

SEQ ID NO: 18695 - protein, 542 aa, Thermobifida fusca [sequence omitted]

SEQ ID NO: 18696 - protein, 110 aa, Streptococcus pneumoniae
GVALGASPLTYSGLSGVGDLIVTGTSIHSRNWRAGDALGRGESLADIESNMGMVIEGISTTRSAYELAQELGVYMPITQAIYQVIYHGTNIKDAIYDIMNNEFKAENEWS

SEQ ID NO: 18697 - protein, 634 aa, Lactobacillus sakei
MCGIVGFAGGLFDLPKKKEVLNQQMDVIKHRGPSGAGDFIDDKVALGFRRLSIIDLTKGGQPIYNEDHTKLIFFNGEVYNYREIRKELEPLGHEFKTDSDTETILHAYEQWGKDVLKKIRGMFVFVIYDLQTKTLFGARDFFGIKPLYYTTLDDGTFMFSSEIKTFMRHPEFKRTLNKKALKSFMMNQYNDLQETFFEGVFRFPAGHYFTYKDGQLDIEKYWDMQFDPSNLSFEEEVKKIDASVEESIKMHNVADVPVGAFLSEGVDSSYVTSILQPQEVFSVGFDDQTYNEVTAAHALADELGLNFNETKVKADDAFAEFDKIQYYLDEPDGNPSCVPLWFLSRFAREKVTVALSGEGADELFAGYVNYGMHSHNTTIKAFTSSLKKLPKGARAKLAKTVKKMPAFPGRVHLYTNLANPKEFYAGQSVIYDIENPSIFGSDEANQYLKPAYQNDTTIQENYQADFDRVKDADPVSQMQYIDMHHFMLNDILQKADKLSMAHSLELRVPFLDPEVAKTAGQVPTEYLINSKDTKYAYRQASAKHLPAAWANRPKLGFPVPIKQWLETDKYYEQVKALFSEDFVSEFFDQGQLLALLDANKEQRINGRRKIWTIYTFLTWYKVYFINIEDYLVLG

SEQ ID NO: 18698 - protein, 423 aa, Thermus thermophilus
MRLLPHAAILPGYNRPMVSTLKRDEALFELIALEEKRQREGLELIASENFVSKQVREAVGSVLTNKYAEGYPGARYYGGCEAIDRVESLAIERAKALFGAAWANVQPHSGSQANMAVYMALMEPGDTLMGMDLAAGGHLTHGSRVNFSGKLYKVVSYGVRPDTELIDLEEVRRLALEHRPKVIVAGASAYPRFWDFKAFREIADEVGAYLVVDMAHFAGLVAAGLHPNPLPYAHVVTSTTHKTLRGPRGGLILSNDPELGKRIDKLIFPGIQGGPLEHVIAGKAVAFFEALQPEFKEYSRLVVENAKRLAEALARRGYRIVTGGTDNHLFLVDLRPKGLTGKEAEERLDAVGITVNKNAIPFDPKPPRVTSGIRIGTPAITTRGFTPEEMPLVAELIDRALLEGPSEALREEVRRLALAHPMP

SEQ ID NO: 18699 - protein, 189 aa, Solibacter usitatus
MSALPIPGLDRILFTEEQIKARIREVAAEITARYQGRTVKLIGVLKGSVFFMTALARHIDLPLKIDFLAISSFSNKSGSPGVVRIAKDLDESIEGDDVILVEDIVDTGFTLRYLLQTLAGRAPNSLSVCTFLDRNSRRIVQVPVDFRCFEIPDRFVVGFGLDSNQLYRNLPYVAVLIPANRDNQSRDRY

SEQ ID NO: 18700 - protein, 218 aa, Unknown
  Bradyrhizobium sp. BTAi1
MFFMRKSPVLPTAADALPGRTQPIPTAPTHFVNGRRLLPPYPAGLEQAVFGLGCFWGAERKFWQLGDGVHVTAVGYAGGHTPNPTYEEVCSGLTAHTEVVLVVFDPKVISYERLLKTFWESHDPTQGMRQGNDVGTQYRSAIYTFSDAQRETADASKAAYETALRAKGLGAITTEIAPAGPFYFAEDYHQQYLAKNPAGYCGLGGTGVACPIGVGVTA

SEQ ID NO: 18701 - protein, 415 aa, Listeria innocua [sequence omitted]

SEQ ID NO: 18702 - protein, 132 aa, Triticum aestivum
ASRSSSVSSRRRRSRRLPRAAVAMGRRPARCYRQIKNKPYPKSRYCRGVPDPKIRIYDVGMKKKGVDEFSHCVHLVSWEKENVSSEALEAARIACNKYMTKHAGKDAFHLRVRGSPVPCAPYQQDAFRAAGG

SEQ ID NO: 18703 - protein, 252 aa, Oryza sativa
MALASTSATASAAVLKTPFLGAKRALANAVGVAGAKPAPRRALVVSAKKSWIPAFKSDAEFINPPWLDGSLPGDFGFDPLGLGKDPAFLKWYREAELIHGRWAMAAVLGIFVGQAWSGVPWFEAGAQPEAIAPFSSGSLLGTQLLLMGWVESKRWVDFFNPDSQSVEWATPWSRTAENFSNATGEQGYPGGKFFDPLGLGGETRDGVYIPDTDKLDRLKLAEIKHARLAMLAMLIFYFEAGQGKTPLGALGL

SEQ ID NO: 18704 - protein, 276 aa, Listeria innocua
MRESLKNSKRLVIKVGTSTLMYGNGHINLRTIEKLAMVLSDLRNEGKEVILVSSGAIGVGCHKLQLPVRPTSIPEQQAVASVGQSELMHIYSKFFGEYGQVVGQVLLTRDVTDFPISRENVMNTLESLLERGIIPIVNENDTVAVEELEHVTKYGDNDLLSAIVAKLVQADLLIMLSDIDGFYGSNPSTDPDAVMFSEINQITPEIEALAGGKGSKFGTGGMLTKLSAASYCMNANQKMILTNGKNPTIIFDIMQGEQVGTLFASKKEEFSHDGTH

SEQ ID NO: 18705 - protein, 555 aa, Burkholderia vietnamiensis
MEIVFTVLILLLTVALSGALTRVLPLRLPLPLMQIAFGAMLAWPRLNLHVTFDPEIFMLLFIPPLLFADGWRIPKRELYMQRRAILMLAFGLVFMTVLAVGYFAHWLIPELPLPIAFALAAVLSPTDAVALSGIAGKGRIPPQLMHILEGEALMNDASGLVALKFAIAAALTGMFSLRDASITFVIVAAGGLATGAGVAWLFSALSTRFLNAEQEGDPAPGIVMTLLVPFAAYLFAEHLELSGVLAAVSAGMMMNYTSFSRKSTVASRVRAESTWAMIEFVFNGMVFIMLGLQLPHIIGSALVDAHHTSDALVGRMIFNVCAMMVALYAIRFLWVWLLRWIASRRAARQGLPGTMAGVRTIAVMTVGGVRGAVTLAGVLSIPVALSNGAPLPGRDAAIFIASAVILGSLIVAMIGLPLLLRGMRTARNPLAAEERAARAAAAQAAIRAIDASHDAIAAALDESGAARCADISARVMDLYRRRLASLADDGPTPRAQAHQSETMELQMRIAAVRAERTVLYRLRSESRISDETLTKLIREIDLSETALSTRKKGLV

SEQ ID NO: 18706 - protein, 434 aa, Sulfolobus solfataricus
MSWNNFLFLKYLIKAMEELLTSNLFVQQVKKLYKVGELLGLDIDTLEALSQPERVIQVKIQIRGSDGKLRTFVGWRSQHNSALGPYKGGVRYSPNVTQEEVIALSMIMTWKNSLLLLPYGGGKGGIRVDPKKLTLKELEDLSRKYIQLIHNYLGSNVDIPAPDINTNPQTMAWFLDEYIKITGEVDFAVFTGKPYELGGIGVRLYSTGLGVATIAREAANKFIGGIEGSRVIIQGFGNVGSFTAKFLSEMGAKIIGVSDIGGGVINENGIDVNKALEVVQRTGSVVNYPEGKKVTNEELLISDCDILIPAAVENVINKFNAPKVKAKLIVEGANGPLTADADDVIKQSGIVVIPDILANAGGVVGSYVEWANNKSGGIISDEEAKKLIIDRMTNAFNTLYDFHKRKFADQDLRTVAMALAVDRVVKAMKARGLL

SEQ ID NO: 18707 - protein, 322 aa, Arabidopsis thaliana
MWFFGSKGASGFSSRSTAEEVTHGVDGTGLTAIVTGASSGIGVETARVLSLRGVHVVMAVRNTDSGAKVKEDIVKQVPGAKLDVMELDLSSMQSVRKFASEYKSTGLPLNLLINNAGIMACPFMLSKDNIELQFATNHLGHFLLTKLLLDTMKSTSRESKREGRIVNLSSEAHRFSYPEGVRFDKINDKSSYSSMRAYGQSKLCNVLHANELTKQLKEDGVNITANSLHPGAIMTNLGRYFNPYLAVAVGAVAKYILKSVPQGAATTCYVALNPQVAGVSGEYFQDSNIAKPLPLVKDTELAKKVWDFSTKLTDSQSGESSS

SEQ ID NO: 18708 - protein, 385 aa, Pseudomonas oleovorans
MAIVVVGAGTAGVNAAFWLRQYGYKGEIRIFSRESVAPYQRPPLSKAFLTSEIAESAVPLKPEGFYTNNNITISLNTPIVSIDVGRKIVSSKDGKEYAYEKLILATPASARRLTCEGSELSGVCYLRSMEDAKNLRRKLVESASVVVLGGGVIGLEVASAAVGLGKRVTVIEATPRVMARVVTPAAANLVRARLEAEGIEFKLNAKLTSIKGRNGHVEQCVLESGEEIQADLIVVGIGAIPELELATEAALEVSNGVVVDDQMCTSDTSIYAIGDCAMARNPFWGTMVRLETIHNAVTHAQIVASSICGTSTPAPTPPRFWSDLKGMALQGLGALKDYDKLVVAINNETLELEVLAYKQERLIATETINLPKRQGALAGSIKLPD

SEQ ID NO: 18709 - protein, 431 aa, Parvularcula bermudensis
MSLTASTASQTSSFFADSLADHDPDVAAIVDREKDRQQQQIELIASENIVSRAVLDAQGSVLTNKYAEGYPGRRYYGGCVYVDEVEELAIERAKKLFGAAEAMVQPHSGSQANQAVFMALLQPGDKFLGLDLSAGGHLTHGAKVNQSGKWFEAHHYGVDPTTHLIDMDAVDALAQKVRPKLIVAGGSAYSRIIDFAAFRAIADKVGAYLLVDMAHFSGLVAAGLYPSPLPHAHAVTTTTHKTLRGPRGGMILTNERDLAKKFRSAIFPGLQGGPLMHVIAAKAVAFGEALQPSFKGYIQSVIDNAKAITATLVEGGYDVVSGGTDTHLSLIDLRPKGVKGNAAEDALERAGMTVNKNGVPNDPEKPQITSGIRIGSPAATTRGFGVVEFQETGRLMIRVLDALAEGTDLAQTEAAVREEVVALTRRFPIYG

SEQ ID NO: 18710 - protein, 180 aa, Spinacia oleracea
MASSVLSSARVATVSRTPAQASMVAPFTGLKSTVGFPATKKNDDITSLASNGGRVQCMKVWPTQNMKRYETLSYLPPLTTDQLARQVDYLLNNKWVPCLEFETDHGFVYREHHNSPGYYDGRYWTMWKLPMFGCTDPAQVLNELEECKKEYPNAFIRIIGFDSNRQVQCVSFIAYKPAGY

SEQ ID NO: 18711 - protein, 112 aa, Unknown
  Erythrobacter sp. NAP1
MKFIIAIIKPFKLDEVREALGSIGVAGMTVSEVKGFGRQKGQTEIYRGAEYSTNMLPKVKLEIAASDDIAPQVVETIQQTANTEAIGDGKIFVLDLASATRIRTGEAGETAL

SEQ ID NO: 18712 - protein, 432 aa, Zea mays
  misc_feature (224)..(224): Xaa can be any naturally occurring amino acid
MEYVCCELRLIKSCLSLTTPMPMLGRCVQDVGRYGGIKVYAVLREDGAEFARNNNLEALFQVDDPGPRAPVKKFLDVNEALEVVRFDIQYCDWRARQDLLTIMLLHSKVVEVLNPLAREFKSIGTLRKELAELQQELEKAHNQVHLSEARVSSALDKLAHMETLVSASSTAEPPTSSSLAATASSTARVRAKNKQPRRRLDVSGPVKPYNPSLKNFWYPVAFSXPPSGFTVHAEIVMELPVEHGLLLDNLLDLAHAPFTHTSTFAKGWSVPSLVKFLTPASGLQGYWDPYPIDMEFRPPCMVLSTIGISKPGKLQGKSTRQCSTHLHQLHVCLPSSRNKTRLLYRMSLDFAPWLKHVPLMHLLWSHFAEKVLNEDLRLVLGQQERMIDGANVWNWPVSYDKLGIRYRLWRDAVERGADDRLPFSSTQAESLS

SEQ ID NO: 18713 - protein, 435 aa, Ralstonia metallidurans
MSSAAPTQNVSNGHTLPSYLNADNLGPWGIYLQQVDRVTPYLGSLARWVETLKRPKRAMIVDVPIELDNGTIAHFEGYRVQHNLSRGPGKGGVRFHQDVTLSEVMALSAWMSVKNAAVNVPYGGAKGGIRVDPRTLSHGELERLTRRYTSEINIIIGPSKDIPAPDVNTNAQVMAWMMDTYSMNSGSTATGVVTGKPISLGGSLGRHEATGRGVFVVGSEAARNLGMDVKGARVAVQGFGNVGAVAAKLFHEAGATVVAVQDHRTTLFDPAGLDVPKMMEYASHSGTIEGYRAEVISTEQFWEVDCDILIPAALEGQLTASNAPKIKAKLVIEGANGPTTPEADDILRERNILVCPDVIANAGGVTVSYFEWVQDFSSFFWTEEEINERLVRIMQEAFRAIWQVAQDNKVTLRTAAFIVACTRILQAREMRGLYP

SEQ ID NO: 18714 - protein, 264 aa, Gibberella zeae
MAAMFSQNPLMNGPNYSFSEAPKTNHGEFREHRFNPYTDNGGSTLAIAGADFTIMAGDTRHTSGYSINSRMSPKVFRIGGTTASQEDATLVLSVVGFAADGEALRDHLDTICKIYRYRHGKPMSVNACAKRLSTVLYGKRFFPYYSHAMLGGLDEEGRGAVYSYDPVGSYEREQCRAGGAAGSLIMPFLDNQVNFKNQYIPGSGEGHELKERERRPLTRTEVETVVKDAFDGAVERHIEVGDNLQMLIITADGIEETFLPLKKD

SEQ ID NO: 18715 - protein, 517 aa, Rhodopirellula baltica
MRRGANLSHPAQRRAIQYHLARGHRGVIQFNPNIRNSSPFFCTEPIMSLLRFDASGSINDDYGITQAQIDSLKGQMETLRTEMVETDQKQYESGDIPADKQPLDARFFWLPEEMLEAYAKEREASELGRIFKVANGLHDQIDAAVVLGIGGSYMGARAMMEACCDPYHNEMSRAARGSKPRMYFEGNNVDNDASDSLLQRVRAGGYADSDAEKRHAIIVISKSGGTMETAVAFRQFLANLESELGSEAEDWLSRLVVPVTGESGKLHDLATEIGCDEIFTVPDGVGGRFSVLSPVGLVPAAFLGLDCMKLLEGAVAMNEHFKTADYADNVVMQYVAVNHLLSQHRDKSIRVMSVWSKALESVGLWYDQLLAESNGKDGKGVTPLTTLNTRDLHSRHQQHQQGRNDKVFNNVIVESQRTDSLAVGHSQRNQDTLNDIAEKTLPDIMAAAIKGTNDALHADGRPTTDIILPQIDTHVLGQLFQMLMIATVIEGRLLGINPYGQPGVEQYKTNMNKNLGR

SEQ ID NO: 18716 - protein, 126 aa, Campanula carpatica
ECAFWMPARSGSILQLSHSLHNLIPFGSTVPMNLPIVHEVFNSAEAIRIPHTCLLARIRPPVGRYNPPEVVAVRVPLLHLSNFQINDWPDLSAKDYAVMVLILPLNGVRNWRDHELELVEVVADQV

SEQ ID NO: 18717 - protein, 299 aa, Glycine max
MEKGRTVVVSALQFACTDDVSTNVATAERLVRAAHKQGANIILIQELFEGYYFCQAQREEFIQRAKPHKDHPTILRMQKLAKELGVVIPVSFFEEANNAHYNSTAIIDADGTDLGIYRKSHIPDGPGYEEKFYFNPGDTGFKVFQTKFAKIGVAICWDQWFPEAARAMVLQGAEILFYPTAIGSEPHDGSIDSRDHWKRVMQGHAGANLVPLVASNRIGKEIIETEHGKSEITFYGNSFIAGPTGEIVSIADDKEEAVLIAQFDLDKIKSMRHCWGVFRDRRPDLYKVLLTLDGNNPVQ

SEQ ID NO: 18718 - protein, 172 aa, Campanula carpatica
ECALWMPARSGSILQLSHSLHNLIPFGSTVPMNLPIVHEVFNSAEAIRIPHTCPLARIRPPVGRYNPPEVVAVRVPLLHLSNFQINDWPDLSAKDYAVMVLILPLNGVRNWRDHELELVEVVADQVAVALSHAAILEESMRARDQLMEQNIALDLARQEAELAIRARNDFLA

SEQ ID NO: 18719 - protein, 178 aa, Campanula carpatica
ECALWMPARSGSDLQLSHSLHNLIPFGSTVPINLPIVNEVFNSAEAIRIPHTCPLARIRPPVGRYNPPEVVAVRVPLLHLSNFQINDWPEMSAKDYAVMVLILPLKGVRNWRDHELELVEVVADQVAVALSHAAILEESMQARDQLMEQNIALDLARQEAEMAICARNDFLAVMNHEM

SEQ ID NO: 18720 - protein, 406 aa, Campylobacter coli
MLNNTLFFKESEIRTISSYANRINDEVESGDIGYYHLIDTSLTLIDESLNFIQDKEHVKNIVLVGMGGSSCGVKALRDMLFDEKNNQRELFILDNTSSHSFSRTLEKIKLEESLFLIISKTGSTIEVVSLFKLLIEHFKLDMQELKKYFIFITDKDSKLHKEGENLGIKCFFIPANVGGRFSILSAVGIVPLCFCGYNAKALLEGAKACFEDFFIHKKDEILQKAYHYCTHKSANINVLFSYSDAFKGFNEWYIQLIAESLGKKQGYKRIGLTPIALIGARDQHSFLQLIMDGPKNKTITFLKIKDSQKAPVIPDIHFKFLDDLSNKVNLHDLLNAQCDATMHALIAENLSVDMIELEKLDAWHAGYLMYYYELFTSACGVMLGINTYDQPGVEVGKLILKNILRS

SEQ ID NO: 18721 - protein, 865 aa, Lotus japonicus
MWSHHGFHLPQNCAAKEQIWGLVATVRHHRNHLFLLRSAVFHSIIFSFSYVVCNGNGSLTLEDSSWKSGNYRCSSKKYEQCTLSQGMTVHDGTFEAGFFHFENPQHHYFGVWYKSISPRTIVWVANRDAPLRNSTAPTLKVTHKGSILIRDGAKGVIWSTNTSRAKEQPFMQLLDSGNLVAKDGDKGENVIWESFNYPGDTFLAGMKIKSNLAIGPTSYLTSWRNSEDPASGEFSYHIDIRGFPQLVVTKGAAITLRAGPWTGNKFSGAFGQVLQKILTFFMQFTDQEISLEYETVNRSIITREVITPLGTIQRLLWSVRNQSWEIIATRPVDQCADYVFCGANSLCDTSKNPICDCLEGFMPQFQAKWNSLDWAGGCVSMEKLSCQNGDGFMKHTGVKLPDTSSSWFGKNMSLDECRTLCLQNCSCTAYAGLDNDVDRSVCLIWFGDILDMSKHPDPDQGQEIYIRVVASKLDRTRNKKSINTKKLAGSLVVIIAFVIFITILGLAISTCIQRKKNKRGDEGEIGIINHWKDKRGDEDIDLATIFDFSTISSATNHFSLSNKLGEGGFGPVYKGLLANGQEIAVKRLSNTSGQGMEEFKNEIKLIARLQHRNLVKLFGCSVHQDENSHANKKMKILLDSTRSKLVDWNKRLQIIDGIARGLLYLHQDSRLRIIHRDLKTSNILLDDEMNPKISDFGLARIFIGDQVEARTKRVMGTYGYMPPEYAVHGSFSIKSDVFSFGVIVLEIISGKKIGRFYDPHHHLNLLSHAWRLWIEERPLELVDELLDDPVIPTEILRYIHVALLCVQRRPENRPDMLSIVLMLNGEKELPKPRLPAFYTGKHDPIWLGSPSRCSTSITISLLEAR

SEQ ID NO: 18722 - protein, 796 aa, Aspergillus nidulans
MPFSHDEHNVLPKTPGLSPTGSSPYDIAQQWTTQVDAQLRSDAPDLSCLLHQDSWWRDMLAFDWDLHTVRGRDKIRDYIISHQPRAHVKRITLVILPGQEPMAEKPQEGTTWVRAMFDFETYCGSGSGVVYLTCHASEWKAFVVYTALQEISGFEARIGRKRPEGTVESMPGGIAQGTWVERRLKQVEFAKEEPTVLVLGAGQSGLNISARLQSMGISCLAIDQNKRVGDSWRNRYRTLVAHDHVNVTHLAYLPFPKTWPKYSSKDKLADWFEAYATIMELNIWLESTVQSAEYDEGQQCWTVTIRRKDQQRVVRPSHVIWCGGQFGVEKVPSLPTLSVFRGTVYHSKYHRDAGLLSPSGKKVIVVGTGNSGHDIAQDFHEHGAEVTLLQRGGTYVLGQAGLPLLPENAFVDDELLPLDVVDLLSESLPWPIAFELLRQNTREILTADRDLLDGLEKSGFQLDYGPNRQGIIGLYVERGGGYYIDFGCSQLIIDGKIRLQQCAKGIFGFDEHHLLLGDGSRLEADIVVLATGYHSSLEAVRKVLGPEVARRCNKQVWGLDAAGEFNTVWRPSGHPGLWFMGGNLAQSRVYSSKEDGSKVQYVAEGTPLEDIIGFMKRDGVVIVRQLVSPADIDQAYEEIRPCLEQRPRWNGSFFPKETQRTPNLIAISPTYTRTQMMNPLFHQLCNHFLTTRSWNWWGDEWSETVSRPYISATSALRVGPGAKAQPLHRDDYVSHNYIVESPMFNYRQQVSITMIVAGCKVTKENGGTQFIPGSHLWHVPTNYLGPEQFVDMLLVP

SEQ ID NO: 18723 - protein, 826 aa, Lotus japonicus
MAQKQSIQDDETLVSPEGTFEAGFFRFGNSLRRYFGIWYKSISPRTIVWVANRDAPVQNSTATLKLTDQGNLLILDGLKGIVWSSNASRTKDKPLMQLLDSGNFVVKDGDKEENLIWESFDYPGDTFLAGMKIKSNLATGPTSYLTSWRNAEDPASGEFSYHIDTHGYPQLVVTKGATVTLRAGPWIGNKFSGASGLRLQKILTFSMQFTDKEVSLEYETVNRSIITRTVITPSGTTQRLLWSDRSQSWEIISTHPMDQCAYYAFCGANSMCDTSNNPICDCLEGFTPKFQAQWNSLDWTGGCVPIKNLSCQNGDGFPKHTGVQFPDTSSSWYGNSKSLDECGTICLQNCSCTAYAYLDNVGGRSVCLNWFGDILDMSEHPDPDQGQEIYLRVVASELDHRRNKKSINIKKLAGSLAGSIAFIICITILGLATVTCIRRKKNEREDEGGIETSIINHWKDKRGDEDIDLATIFDFSTISSTTNHFSESNKLGEGGFGPVYKGVLANGQEIAVKRLSNTSGQGMEEFKNEVKLIARLQHRNLVKLLGCSIHHDEMLLIYEFMHNRSLDYFIFDSRLRIIHRDLKTSNILLDSEMNPKISDFGLARIFTGDQVEAKTKRVMGTYGYMSPEYAVHGSFSVKSDVFSFGVIVLEIISGKKIGRFCDPHHHRNLLSHSSNFAVFLIKALRICMFENVKNRKAWRLWIEERPLELVDELLDGLAIPTEILRYIHIALLCVQQRPEYRPDMLSVVLMLNGEKELPKPSLPAFYTGNDDLLWPESTSKNCERVIKHVILNGFMVPTANLHFCKFLGGRDRDDPMTFKPEGHEQP

SEQ ID NO: 18724 - protein, 75 aa, Glycine max
MLEFNCMQHILYRQREQLGEGIGYGWIDGLKTHAEKHATDLMLLIAAYMFPFNTPTSREAYYYRMKLERNFRQVH

SEQ ID NO: 18725 - protein, 230 aa, Saccharomyces cerevisiae
MEDKLDRYYTNVLSNAEKDKHTTVDSDDKSSGEENLDELLNELDRELDEDHEFLSAYRSERLQQISDHLKQVKKNVEDDGYGRLQCIDNEADAIQICTKTTMVVIHFELETFGKCQYMNEKLENLAKRYLTTRFIKVNVQTCPFLVNKLNIKVLPFVVGYKNGLEKVRYVGFSKLGNDPNGFDIRRLEQSLAHSGVIEDTFEIRKHSSVNTERFASTNHDRSESDSDLDI

SEQ ID NO: 18726 - protein, 256 aa, Thermus thermophilus
MPVEITVKELLEAGVHFGHERKRWNPKFARYIYAERNGIHIIDLQKTMEELERTFRFIEDLAMRGGTILFVGTKKQAQDIVRMEAERAGMPYVNQRWLGGMLTNFKTISQRVHRLEELEALFASPEIEERPKKEQVRLKHELERLQKYLSGFRLLKRLPDAIFVVDPTKEAIAVREARKLFIPVIALADTDSDPDLVDYIIPGNDDAIRSIQLILSRAVDLIIQARGGVVEPSPSYALVQEAEATETPEGESEVEA

SEQ ID NO: 18727 - protein, 160 aa, Methanothermobacter thermautotrophicus
MVRAYTRREYIKKIPGSKIVQYDMGNLSAEFPISLSVAVKAPTQITHNALEAARIASNRYMQRRAGRMGYHLKIRVYPHHIVRENPMATGAGADRVQDGMRKAFGKPVSTVALVKKNQKIITIETNKKNFKDAKEALRRAAMKFPVPCRIVIDRGEELVK

SEQ ID NO: 18728 - protein, 414 aa, Pyrococcus furiosus
MPKVWIEKLTEDMELYLIRVDDDQIKYFEAAWDIPEGITYNSYLLKLNDAVVLFDTVKKDYEDLFMDALKKLVDPKEITHIIVHHTEPDHSGALPRVLEENEYKAMVIGTQFARNLLEGFYGKKVVENFKVIKDGEEMKIGGKTFRFITVPWLHWPDTMITYLVEDKIIFSCDAGGGYSIPETIDDSSEEVVEKYLPYVTKYIVTVIGHYHKYIVENIRKLKELGIVKDVKMILPGHGLIWRRDPIRIFRHYEEVGAGRAEKGKVLVVYDSMYGFVEKRMDIVIDELKKHGMKPVIYKYTDKVAPAVSDILGEVPSAEAIVIGVSTYEADIHPRIRYLLYEIIDKANYEKPVLIVGAFGWGGGAGKKIESMITRSKFDHVMTVESKGAPSAEDEEKIRDAVRELIQRSLPTGNT

SEQ ID NO: 18729 - protein, 664 aa, Chlamydophila pneumoniae
MEKVSSYPSVPLPLGASKISPNRYRFALYASQATEVILALTDENSEVIEVPLYPDTHRTGAIWHIEIEGISDQSSYAFRVHGPKKHGMQYSFKEYLADPYAKNIHSPQSFGSRKKQGDYAFCYLKEEPFPWDGDQPLHLPKEEMIIYEMHVRSFTQSSSSRVHAPGTFLGIIEKIDHLHKLGINAVELLPIFEFDETAHPFRNSKFPYLCNYWGYAPLNFFSPCRRYAYASDPCAPSREFKTLVKTLHQEGIEVILDVVFNHTGLQGTTCSLPWIDTPSYYILDAQGHFTNYSGCGNTLNTNRAPTTQWILDILRYWVEEMHVDGFRFDLASVFSRGPSGSPLQFAPVLEAISFDPLLASTKIIAEPWDAGGLYQVGYFPTLSPRWSEWNGPYRDNVKAFLNGDQNLIGTFASRISGSQDIYPHGSPTNSINYVSCHDGFTLCDTVTYNHKHNEANGEDNRDGTDANYSYNFGTEGKTEDPGILEVRERQLRNFFLTLMVSQGIPMIQSGDEYAHTAEGNNNRWALDSNANYFLWDQLTAKPTLMHFLCDLIAFRKKYKTLFNRGFLSNKEISWVDAMGNPMTWRPGNFLAFKIKSPKAHVYVAFHVGAQDQLATLPKASSNFLPYQIVAESQQGFVPQNVATPTVSLQPHTTLIAISHAKEVT

SEQ ID NO: 18730 - protein, 581 aa, Zea mays
MNELCDLEVHINGHHTLHLHQSVMCAFSGRLRTLVKQEKKKKGGGRKEAVSINLAGGFPGGADGFELVARFCYNDGRVLLCPSNLPLLHCAAVSLEMTEEVCACNLLAQAEAFVNGLYYWTWGDVLAAVRSCEPFAAAADASGLLDRLISALFSKITGATPGPGPGTPNRSSSSCSSSPDTAGLRRSSSSANKTPESMRPCAGREWWFDDMTSLSPPTVEKVMRVLGCYGVENKNLILTRFLLHYLRAATRRPPALEREGAALAGLADTAVHGVALVGGTAFSCRGLFWVLRIVSAVGLSRECRHKLERLMGLMLDQATLDDLLVSGDDGGGVYDVNLVMRLVRVFVASEEEADAPSERMRKVGRLVDKYLGEISPDQGLKVSKFLAVAESLPDSARDCYDGVYRALDIYLESHPALSLEERTTLCRCLNYEKLTLEACKDLAKNRRIPPGVAVQALASQQCKLHISEPGPGGSATAAAGKERRPDPSSCSQSQTPRRRVARRATRSVDLGRRSGGDDDEKELLRLNLQRMQSRVVELERACKEMKGQMSRMAKGKSLSLSFGSGAASCHQTGGRGLPRLC

SEQ ID NO: 18731 - protein, 243 aa, Arabidopsis thaliana
MGTPETSREPCPDRILDDIGGAFGMGAVGGSAFHFIKGTYNSPKGSRFVGGTQSVSMNAPRTGGSFAVWGGLFSTFDCTMVYLRQKEDPWNSIIAGAATGGFLSMRQGAGAASRSAIFGGVLLALIEGAGIMLNKVLAQPQNMMMEDPGMQGMPGMQGMQGMPGMPGMQGMPGMQGMQMGQMQSQAQIRSESQNQNTASSSSSSSWFGGLFDKKKEEVQPGSESKTEVLESFDAPPVPSFEFK

SEQ ID NO: 18732 - protein, 227 aa, Zea mays
MVTGDVKLIGSWASVFVMRARIALNLKSIRYEFLQETYGTKSELLLKSNPVHKKIPVLIHDDKPVCESNIIVQYIDEAWSSYGPSILPSQPYDRAIARFWAAYVDDKWFIALRSILTARGEEEKKAAIAEVEGRTDHLEKAFIECSNGKPFFNGDHIGYLDIALGSFLGWWKVVELDANHILLDETKTPSLFKWAERFCNDPDVKPLMPETAKLAEFARKLFPKPQA

SEQ ID NO: 18733 - protein, 874 aa, Propionibacterium acnes
MLDETDNTTLKSGGNSTAGIPAPRRRRAASRPAGAPAPVETMGAPVAITAAGSGGSIVTSDVEASDLPRPPMGRRRKATSTPHDVKTDVPKVVSLEPTPEEPESADTRTQEKPRRTRRGASETAPSTEAERGTSQRRRATRRRSSRSAEKIEGTTEATTATNKGDGADDDPINVALTEAKARARNHKVEGALANPFGFKEGEERSASDILDSLAAEIGGGEAAIPKRRRRRATRPSEAGSHSAETSGSTDKVAPVEEDKGEIKDRHSSDKKSEKSDYDTTDVVEETVADTEEDGQNRRRRRRGGRRRRRSEDTEDSASEDESSDSDDSQTSSDNDSESSSSDATHRRRRRRRRRGEDISGSDDDPSDVVIKVREPRSRQSVADEVTGIEGSTRVEAKKQRRREGRAAGRRRSAVITDAEFLARRESVDRKMIVRQSDDYSQLAVLEDGVLVEHYVDRASATSSIGNIYLGKVQNVLPSMEAAFIDIGRGRNAVLYAGEVDWAKYGKEGEDKRIEHVLKSGDQVLVQVTKDPVGAKGARLTSHISVPGRFVVYSPGGHLSGISRKLADSERKRLKKIVENNIPSDASVIVRTAAEGATEEDLVRDINRLKVQWEVIERKVSNSKAPLMLYTEPDLTVRIIRDLFTADFSELVIAGNGGPDDAYDTIKAYVDHVAPEMASRLIHWEHTDKDPFAEYRIDEQVAKALERKVYLPSGGSLVIDRTEAMTVIDVNTGKFTGSAGNLEATVTANNLEAAEEIVRQLRLRDIGGIIVIDFIDMVLPTNRELLVRRLTECLGRDRTRHQVAEVTSLGLVQMTRKKIGTGLAEAFTEQCEACGGRGYRRFDKPVDSQAPADGGERSKGRGRGHKGSSGKSHSK

SEQ ID NO: 18734 - protein, 368 aa, Brassica napus
MALSAIGFEGYEKRLEVSFFEPSFFQDSKGLGLRALTRSQLDEILTPAACEIVSSLSNDHLDSYVLSESSFFVYPYKVIIKTCGTTKLLLSIPPLLKLAGELSLSVKSVKYTRGSFLCPGGQPFPHRSFSEEVSVLDGHFTKLGLNSVAYLMGNDDENKKWHVYAASSAQTSSDCNNNVYTLEMCMTGLDKEKASVFYKNETGGENGSMTDNSGIRKILPKSQICDFEFEPCGYSMNSIEGDAISTIHVTPEDGFSYASFEAVGYDFNTLDLSQLVTRVLSCFEPKQFSVAVHSSVGSNAYKPEISVDLEDYGCRERTFESLGEESGTVMYQTFEKLGKYCGSPRSTLKCEWSSNNSCSSEDEKDEGI

SEQ ID NO: 18735 - protein, 393 aa, Cryptococcus neoformans
MSAPSTAPSSPEVVQQFSDLDIGSTVTTPAVTRPSSPSPPSLPPSPLSSGKHKIAVIGSGSWGTALAKIAAENAWRRKDEFHSEVRMWVREKIVNGKPLTHIINKTHLNSRYLPDVVLPRNLVAVPHLKDVVKDATLIVFVVPHQFLHTVLNELARPGVLLRGAKAVSAIKGVEVNGTDIQTFASLIEAKVGLPCSALSGANIALEVAMGQFCETTIGCPTSDQSLLWHAVFNAPSFRVNAVEDVSGVSLAGALKNIVALAAGMVDGLGLGGNTKAAIMRIGLKEMTQFCLEFFEGSQPETFSNESAGVADLTVTCFSGRNRKCAEEFVKSGQPFDVIERKLLNGQKLQGTATAEEVNAFLVARKRAHAYPLFEKVYKIAFEGMPPKNLVVGL

SEQ ID NO: 18736 - protein, 483 aa, Streptococcus thermophilus
MIVSTYYPKIFYCDKLILLHLLEESMKNHNYENEGQFQRKMTSRHLFMLSLGGVIGTGLFLSSGYTIAQAGPLGAILSYLVGAVVVYLVMLSLGELAVAMPVTGSFHTYATKFISPGTGFTVAWLYWICWTVALGTEFLGAAMLMQRWFPSVPAWIFAAFFALVILGINALSVRSFAEAESVFSSIKVIAILVFIILGLGAMFGLVRFEGHHEAIMFKHLTANGLFPNGGLAIVSVMLAVNYAFSGTELIGIAAGETDNPKEAVPRAIKTTIGRLVIFFVLTIVVLASLLPMKEAGVSSAPFVDVFDKMGIPFAADIMNFVILTAILSAGNSGLYASSRMLWSLANEGMLNKKLVTINKHGVPMTALLISMAGAVLSLFSSIYAADTVYLALVSIAGFAVVVVWLSIPMAQINFRKQWKLEHSEDELDYKTPFNPILPYITIVLLAISVLGIAWDSSQRAGLYFGIPFMIFCYLYHYLCFNKW

SEQ ID NO: 18737 - protein, 130 aa, Pinus pinea
PLQLKWQTCGGAMGACTFEIELNHKANAGLVNALKLLQPIKDKYPNITYADLFQLASATAIEDAGGPEIPMQIWATGCTLNLKIVHQKESSQHAGPPSQLLICVISSYQNWRLDRYYGHCRIYQGRHTFR

SEQ ID NO: 18738 - protein, 373 aa, Staphylococcus epidermidis
MAKRDYYEVLGVNKSASKDEIKKAYRKLSKKYHPDINKEEGADEKFKEISEAYEVLSDENKRVNYDQFGHDGPQGGFGSQGFGGSDFGGFEDIFSSFFGGGSRQRDPNAPRKGDDLQYTMTITFEEAVFGTKKEISIKKDVTCHTCNGDGAKPGTSKKTCSYCNGAGRVSVEQNTILGRVRTEQVCPKCEGSGQEFEEPCPTCKGKGTENKTVKLEVTVPEGVDNEQQVRLAGEGSPGVNGGPHGDLYVVFRVKPSNTFERDGDDIYYNLDISFSQAALGDEIKIPTLKSNVVLTIPAGTQTGKQFRLKDKGVKNVHGYGYGDLFVNIKVVTPTKLNDRQKELLKEFAEINGENINEQSSNFKDRAKRFFKGE

SEQ ID NO: 18739 - protein, 182 aa, Mesembryanthemum crystallinum
MASSMVSSAAVATVNRTPAQASMVVPFNGLKSVAAFPVTKKNNDITSVATNGGRVQCMQVWPPLGKKKFETLSYLPPLSEESLMKEVQYLLNNGWVPCLEFEPTHGFVYREHGNTPGYYDGRYWTMWKLPMFGCTDPSQVVAELREAKKAYPEAFIRIIGFDNVRQVQCISFIAYKPASYDA

SEQ ID NO: 18740 - protein, 550 aa, Rhodopseudomonas palustris
MQAVAGRFTQNQRGDVEAKFQIFLTLLAVLAGTALLARRVNIAPAILLLIAGITLAFIPGMPAIELPPDLILLLVLPPLIYSASVAMSWREFCANLRAIGLLAIGCVIFTACAVAAASHYLIGLPWSVGFLLGAIVAPPDVVAPLAIARKLGLPRRIVVVLEGEGLANDATALILYRFAVAAIMTGAFSLTKASGTFVAIMAGELAFGVAVGWLSLRARHWVRDPQIEITLSLLTPYIAYWIPEHHGGSGVIATVACGLYISWNGPLLISAATRLQGIFFWDLVIYLIEGMLFLLTGFQLRALLERSKEFAFGDILSATLLVAAIVIAARFIWVYPAFYLPRFLSRRLRASDPYPSWRTVFVIGFTGVRGAVSLAAALALPYALPGGETFPYRDLILFVTFGVILITLVGLGLTLPAVVKLLGVTRVGHREQIAEHDDEITARREALAAAQASLKKITDNRELTDEVLKLLHARHQTRASLLPDPIGSPEHEASAVGIALVRELIAVERKFIHAQLRAGKITDEARRRIERDLDLEEASLANRESGPAPL

SEQ ID NO: 18741 - protein, 447 aa, Legionella pneumophila
MMEIKRVLKDRLSARVCVIGAGPSGIAAIKNLQEHGITNVTVFEKNNQIGGNWVYDEQNEHSSVYETTHIISSKRWSEFEDFPMPVDYPDYPSHSQLLKYFQSYVEHFHLDRYIRFNTVVQKVHRLDDNTWHVIYEDAQGIHEACYDYLLVANGHHWDPFMPVYPGVFDGEILHSHQYKKASIFKGKRVLVVGGGNSACDVAVEISRVAPGTCISMRRGYHIFPKFIFGKPTDVAVAKIQWMPSWLRQKFISLVIRGLQGRYAKYKLMKPDCGPLEIHPTINSELLYFIRHGKIHPRSGISRFEGNTVHFTDRTQGEFDTIIFATGYQISFPFFDKSCIDFSNSTTIPLYRKMMHPEFENLYFIGLCQPQGCIWPLADYQSKIVARIIAGTLKRPDQLHRKIAKEINKPHHRFKSHMRHALEVDYHIFRKELLEMLGQKHKRLKFYP

SEQ ID NO: 18742 - protein, 307 aa, Unknown
  Erythrobacter sp. NAP1
MTTSGITDWTPDELPDLTDKRFLITGGNSGIGFEAAKILASKNGDVVIACRSEEKGKQALAKLVNEGEGRCELLRMDLADMSSIRAAADEAKDRFGAIWGLVNNAGVMQTPKFKTKDGFELQLGTNHLGHFLWTALMMDQVDGRGGRVVTVASIAHKFGRIDFDNLMMERGYDRSRAYLRSKLANLLFAMELHRRLDAAGSKVKSVACHPGYSSTPLLSKTQNPLSRIVNGVSSAVFAQSPVRGSWPTALAAADDRAESGGYYGPTGFFDARGPVGDSDVEARALDETVAKRLWGVSEELVGETFSI

SEQ ID NO: 18743 - protein, 291 aa, Unknown
  Citrus x paradisi
MAEASPAAANAELLEWPKKDKRRFLHAVYRVGDLDRTIKFYTECFGMKLLRKRDVPEEKYSNAFLGFGPEQSHFVVELTYNYGVTSYDIGTGFGHFAIATEDVYKLVENIRAKGGNVTREPGPLKGGTTHIAFVKDPDGYIFELIQRGPTPEPLCQVMLRVGDLGRSIKFYEKALGMKLLRTVDKPEYKYTLAMLGYAEEDQTTVLELTYNYGVTEYTKGNAYAQVAISTDDVYKSAEVVNLVTQELGGKITRQPGSIPGLNTKITSFVDPDGWKTVLVDNEDFLKEIQSE

SEQ ID NO: 18744 - protein, 474 aa, Unknown
  Frankia sp. EAN1pec
MSIDRLPTAGHTGAQAPGPGRATPAFLRELLADPLRLFTRLRTSYGPIVRVPVGRGGFHLVCGPEAVEQVLVGEQRAYAKGLRRRTMPPGEGIQPLSLLLGSGLLTSGGDLHRTRRRLIQPMFHRERIAGYGAAISELSRATALGWADGSRREVHTDMSELTLAIVARTVFGVDVDSEVVRRVRRAVAANMRLSQLAVLPGAIRLQQHLPIGPLRAARDARDDLTAVVMEMIEQRRSLDAAGSDLLSTLLATRDADTGAPLDDTSIRDEALTILLAGHETTANAMAWAYHLLATNPQARDRMHTELDDVLNGRKPTTADLAELPYTRAVFSETLRLYPPAWILLRRTTRDVTLTGYHLPADTNVLLSQWVIHRDPTWWPAPEEFRPQRWLTPDPTRPKYAYFPFGGGTRQCIGNTFAEMEGALALAAISSIRTLTPTPGRPVTPIPRVTLRPQPLQMTAHPRTPHPTPATHKPH

SEQ ID NO: 18745 - protein, 198 aa, Photobacterium profundum
MSSLVLDSLQAADAVVLMENKMKHTIEVLISEQDVQARVKELGKQITECYKGSENLVMVGLLRGSFVFMADLARAIDLPHEVDFMTASSYGNTMESNRDVRILKDLDDDIKGKDVLLVEDIIDTGNTLNKVCEILSLREPNSIRICTLLDKPERREVNVNVDWYGFVIPDEFVVGVGIDYAQKYRHLPFIGKVVPLED

SEQ ID NO: 18746 - protein, 94 aa, Pisum sativum
KESYTVKIYIFKVLKQVHPDIGISSKAMGIMNSFINDIFEKLASEASRLARYNKKSTITPREIQTAVRLLLPGEVAKHKVSEATKAVTKFTSGA

SEQ ID NO: 18747 - protein, 335 aa, Zea mays
MAVLSAADASPVSAIGFEGYEKRLEITFSEAPVFVDPHGRGLRALSRAQIDSVLDLARCTIVSELSNKDFDSYVLSESSLFIYPLKIVIKTCGTTKLLLTIPRPGQKWHVFYATEYPEQPMVNLEMCMTGLDKKKASVFFKTNADGNTTCAKEMTKLSGISEIIPEMEICDFDFEPCGYSMNAIHGSAFSTIHVTPEDGFSYASYEVMGLDATALSYGDLVKRVLRCFGPSEFSVAVTIFGGRGHAGTWGKALGAEVYDCNNMVEQELPGGGLLVYQSFCAAEDAVATSPKSVFHCFDGENVESAPPPMKKDYKLANLLCWEEEADAMEEKGGSA

SEQ ID NO: 18748 - protein, 142 aa, Deinococcus radiodurans
MSDILTCTHCQAKNRVGAVPAGQVPSCARCGAALPWLHDGTDATFEQDLQTSVPVLVDFWAPWCGPCRVMGPVLEDLARDLPGKVRVVKVNVDENPRTAARFEVRSIPTLLMFKDGEEVDQMVGVTQKAALRARVEHLNQLS

SEQ ID NO: 18749 - protein, 484 aa, Bacillus licheniformis
MEQSNTNRQNFQRKMQTRHLIMLSLGGVIGTGLFLSSGYTISQAGPAGTILAYLAGALIVYLVMLCLGELSVAMPVTGSFHMYASRFIGPGTGFTVAWLYWLTWAVALGSEFTAAGLLMQRWFPDTSVWMWSAVFAALIFALNAVSVRFFAESEFWFSSIKVLAIILFIILGGAAIFGIIPIQNADAAPLLSNFAGEGGLFPNGFLPIFMAMLSVNFAFSGTELIGIAAGESAEPEKNIPKAIKTTLWRLVLFFIGTIFVLSCLIPVKEAGVIKSPFVDVFDRIGVPYAADIMNFVILTALLSAANSGLYACSRMLWSLSKEKTLHPVFQKLTSRGIPLNALIFSMLGGILSLLSSVFAPDSVYIVLVSISGFAVVAVWMSIAASQFMFRRRFLAEGNTADDLKYRTPLYPAVPIAAFLLCLASCIGIAFDPNQRIALFCGVPFMALCYTIYYATNRKNSWNPSEPVKNASLHVSFSEYEEKKN

SEQ ID NO: 18750 - protein, 169 aa, Unknown
  Synechocystis sp. PCC 6803
MTAQANNTIYGFSANALDGSPVALRDFEGKVLLIVNTASQCGFTPQYQGLQALYNRFGDRGFTVLGFPCNQFGQQEPGGSGEIKNFCETRYGVTFPLFEKVEVNGPNAHPLFKFLTAASPGMAIPFLGGAEDIKWNFTKFLVDRQGKVVKRYGSIAKPDEIAADIEKLL

SEQ ID NO: 18751 - protein, 549 aa, Pasteurella multocida
MTESFAQLFEESLKELETRQGSIVSGTVVAIQKGFVLVDAGLKSESAIPVEEFLNAQGELDVQVGDVVNVALDAVEDGFGETKLSREKAVRHESWIELEKAYEEQATVIGLINGKVKGGFTVELNGVRAFLPGSLVDTRPVRETLHLEGKELEFKVIKLDQKRNNVVVSRRAVIESENSQEREQILENLQEGSEVKGIVKNLTDYGAFVDLGGVDGLLHITDMAWKRVKHPSEIVNVGDEITVKVLKFDKDRTRVSLGLKQLGQDPWVAIAENHPVNSKLSGKVTNLTDYGCFVEILDGVEGLVHVSEMDWTNKNIHPSKVVSLGDVVEVMVLEIDEERRRISLGLKQCKPNPWLQFAETHNKGDKVEGKIKSITDFGIFIGLDGGIDGLVHLSDISWNVSGEEAVRQYKKGDEVAAVVLQVDAVKERISLGIKQLEEDPFNNFVAVNKKGAVLSAKVVEADAKGAKVELDGGVEGYIRAADLTNEVNAGDVVEAKYTGVDRKARIVHLSVRAKDQAEEAAAVANVNNKQEDVAIPNAMAEAFKAAKGE

SEQ ID NO: 18752 - protein, 263 aa, Unknown
  Synechocystis sp. PCC 6803
MVVRLQNGLMGKVYLVGAGPGDPGLITVKGKTLLENAEAVVYDALVSTAILAMVNPQAELIDAGKRRGRHTKLQSETTQLLAQLAEKHAVVVRLKGGDPFIFGRGGEEMEDLVKAGIEVEVVPGITAGIAAPAYAQIPLTHRAYSSSVTFVTGHESAGKYRPEVNWAAIAKGSETIVIYMGVYSLATILPQLMLAGLGEDTPIALIRWGTCPEQQKLVGTFATILAQIEVENFQAPAIVVIGAVVNYPANLRQQLAPILGGVN

SEQ ID NO: 18753 - protein, 472 aa, Symbiobacterium thermophilum
MRNDDRSKLIRGLICVAVGLIIWFLPAPGDLEPVAMHLLGIFVATILGLILQPLPQGAVVITAVAVTAITGTLSIGDALNGFKDSTVWLIVTAFLFARGLIKTGLGRRISFMLVKRFGKSTLGLGYALALSDTVLAPATPSNTARAGGILFPIVRALCSSMGSEPGPTAKRVGQYLMYNSFQICCITSALFFTGVAPNSLIATLAKENFGYEITWLGWLWAALLPGVICIAILPRIYYKIFNPELKYSPEAPALAEKELAKMGPMSTAEKGMLAVFLLTLVLWATSQWTNLNATAIALLGVAILLVIGVLDWQDVLAEKGGWDALIWFGGLVGLATGLSKVGIIGWLASILETSLGGISSWFLAFILVVIAYTYSHYFIASMTAHATAFFVPLALVAISAGAPLEITVLVLGFFNSLNAVMTHYGTGPAPIYFGAGYIDQGTWWKWGFVTSLINLVVWLGAGSLWWKVIGLW

SEQ ID NO: 18754 - protein, 153 aa, Oryza sativa
MAPKAEKKPAAKKPAEEEPAAEKAEKAPAGKKPKAEKRLPAGKAEKGSGEGRKAGRKKAKKSVETYKIYIFKVLKQVHPDIGISSKAMSIMNSFINDIFEKLAGESAKLARYNKKPTITSREIQTSVRLVLPGELAKHAVSEGTKAVTKFTSA

SEQ ID NO: 18755 - protein, 415 aa, Propionibacterium acnes
MAMSSRVIEQAIAARSAATVLRRLRRIDKDDLLAAMGIGLRKGVDEILAANGADVDRGRDAGMDEALLDRLTLTPERIEGMAVGLEGVAHLDDPVGEVVRGWHTPLGVKIEQVRVPIGVIGIIYEARPNVTSDAAGICLKSGNACLLRGSSSALESNRAVIAAMRSRLPEEIREAVQLVEGGHEVTDELMTARGYVDLLIPRGGAGLINAVVTGAKVPVIQTGTGNCHLVIDVSADVEMAVNIAVNAKTQRPSVCNAIETVLVHRGIADSAVRPLVDAMSERGVTVHGDEESIRLDPRIVPAAPDEYDNEYLSLDLALRIVDDLEEAVDHIAKHGSGHSETIVTKSMSSQEFFASSVDAAAVLVNCSSRFVDGGEFGFGAEIGISTQKLHARGPMGLREMTTTTYVLRGDGQTRP

SEQ ID NO: 18756 - protein, 314 aa, Stigeoclonium helveticum
MTLSTNNSKNDFLDKTGPVSILGTSKGKKALLRRRLLIIQNVRNILIKKIINFDNFSNPIETYKIMLRKSLHFGHPVIQCDSGMKKYIRGQSNGKHFINLFRTKRYIRKALWYLTKYAYKRKNILFVGTAIPSARYVATTALKTKSFFVNFRWLGGMLNNWKTLRKLLQKLKTLQKEQKNKIWKNLPKKEGIARLKEKQRLEKYLKGIQMIKGFPEVVIMTSQTKDLSAARECKKMGIWNLSILDTNCDPRLADLMVPANDDSASSVKFLLFNFAKAIQAGRALSVLKKKLKNKLTKKKQTKSRAKVFLKEKKL

SEQ ID NO: 18757 - protein, 366 aa, Candida albicans
MTTSPYPIETPFKVCIVGSGNWGTAVAKLVAENCAEKPNIFQRDVKMWVFEEEIEGRKLTEIINTEHENVKYLPEIKLPTNLVANPDIVDTVQDADLIVFNIPHQFLGRIVKQIEGKVKPTARAISCLKGLDVSPEGCKLLSTSITDTLKIYCGVLSGANIANEVAKGNWSETSIAYTVPEDFRGAGKDIDPFILKEAFHRPYFHVRVIEDVVGASIAGALKNVIACSVGFVEGAGWGDNAKAAIMRIGIKETIRFASYWELFKIKALSPPNPKTFTEESAGVADLITTCSGGRNVKVARYMIKNNVDAFEAEKIVLKGQSSQGILTAKEVHELLTNFNLQDEFPLLEATYKVIYENGSVDDFPNY

SEQ ID NO: 18758 - protein, 201 aa, Aspergillus awamori
MNPEYDYLFKLLLIGDSGVGKSCLLLRFADDTYTESYISTIGVDFKIRTIELDGKTMKLQIWDTAGQERFRTITSSYYRGAHGICVVYDVTDMDSFNNVKQWLQEIDRYATEGVNKLLVGNKSDMEDKKVVEYTVAKEFADSLGIPFLETSAKNASNVEQAFLTMARQIKERMGTATVNNKPTVQVGQGQGVQSGSAGGCC

SEQ ID NO: 18759 - protein, 202 aa, Salinibacter ruber
MSTPSFSPRTATVERTTAETDVSVALTLDGDGSYDVDTGVGFFDHMLSLFAKHGALDLEVRCDGDLEVDDHHTVEDVAIGLGRALDDALGDKAHIARYGHAYVPMDDALARAVVDLSGRSYCHLEASFERNQVGGLSTELVEHVWRSVADHARCNLHLTVLRGHNAHHKIEALFKAAARALRTAVRRRADHAEVASTKGTLA

SEQ ID NO: 18760 - protein, 366 aa, Mycobacterium avium
MPAVLFATAGNSHPYPGVYTDPETIARKVFMTADTVHDVIIIGSGPAGYTAALYTARAQLAPVVFEGTSFGGALMTTTEVENYPGFRDGITGPELMDQMREQALRFGADLRMEDVESVSLAGPVKSVTTAEGETVRARAVILAMGAAARYLGVPGEQDLLGRGVSSCATCDGFFFKDQDIAVIGGGDSAMEEATFLTRFARSVTLLHRREEFRASRIMLERARANDKITIVTNKAVEAVEGSETVTGLRLRDTVTGETSTLAVTGVFVAIGHDPRSELVRDVLDTDPDGYVLVQGRTTATSIPGVFAAGDLVDRTYRQAVTAAGSGCAAAIDAERWLAEHAESSAAAQGDATEFPGSTDTLIGAPQ

SEQ ID NO: 18761 - protein, 316 aa, Unknown
  Petunia x hybrida
MEQENHNNNNCTNDKESACISSVLPGWFSEISPLWPGEAHSLKVEKILFQGKSDYQNVMVFQSSTYGKVLVLDGVIQLTERDECAYQEMITHLPLCSIPNPKKVLVIGGGDGGVLREVSRHSSIEQIDICEIDKMVVEVSKQFFPDVAVGYEDPRVNLHIGDGVAFLKAVPAGTYDAVIVDSSDPIGPAQELFEKPFFETVARALRPGGVVSTQAESIWLHMDIIENIVTNCRQIFKGSVNYAWTTVPTYPSGMIGFMLCSTEGLEVDFKNPVNLIENDEIHSKTLPPLKFYNFEIHKASFALPSFAKRVIESKGN

SEQ ID NO: 18762 - protein, 180 aa, Mesembryanthemum crystallinum
MASMMSNAAVVGRTTPAQASMVAPFTGLKSVSAFPVTKKSNDITSIASNGGRVQCMQVWPPLGKKKFETLSYLPPLSEESLMKEVQYLLNNGWVPCLEFEPTHGFVYREHGNTPGYYDGRYWTMWKLPMFGCTDPSQVVAELEEAKKAYPEAFIRIIGFDNVRQVQCISFIAYKPASYDA

SEQ ID NO: 18763 - protein, 183 aa, Mesembryanthemum crystallinum
MASSLMSNAATTMAAATTTAQANMVAPFNGLKSVSAFPVTRKNNDITSVASNGGRVQCMQVWPPLGKKKFETLSYLPPLSEESLIKEVQYLLNNGWVPCLEFEPTHGFVYREHGNTPGYYDGRYWTMWKLPMFGCTDPSQVVAELEEAKKAYPEAFIRIIGFDNVRQVQCISFIAYKPASYDA

SEQ ID NO: 18764 - protein, 888 aa, Oryza sativa
MAKSSADDAELRRACAQAVAASGARGEEVSFSIRVAKGRGIFEKLGRLAKPRVLALTVKQSTKGEAAKAFLRVLKYSSGAVLEPAKLYKLKHLTKVEVISNDPSGCTFVLGFDNLRSQSVAPPQWTMRNIDDRNRLLFSILTMCKEILSYLPKVVGIDFVELALWAKENTVTLDNQSSTQDGQEKSVTTQTERKVTVTVENDLVSQAKDEEEDMEALLDTYVMGIGEADAFSERLKQELVALEAANVYQLLQSEPLIDEVLQGLDAASATVDDMDEWLRIFNMKLRHMREDIASIESRNNGLEMQSVNNKGLVEELEKLLDRLRIPQEFAASLTGGSFEESRMLKNVEACEWLTGAIRSLEVPNLDPCYVNMRAVREKRAELEKLKTTFVRRASEFLRNYFSSLVDFMISDKSYFSQRGQLKRPDHADLRYKCRTYARLLQHLKSLDKSCLGPLRKAYCHSLNLLLRREAREFANELRASTKAPKNPAVWLEGSNSGGQNGSSADTSTVSDAYSKMLTIFIPLLVDESSFFAHFMCFEVPALVPAGAPNAKSRSGGNDPDDDLNLMDPDGNDLKPDDTSAELGTLNDALQELLDGIQEDFYAVVDWAYKIDPLRCISMHGITERYLSGQKADAAGFVRRLLHDLESRISTQFSRFIDEACHQIERNERNVRQTGILAYIPRFAVLASRMEQYIQGQSRDLIDKAYTKLVSTMFTTLDKIAHSDPKTADIVLIENYAAFQNSLYDLANVVPTLAKFYHEASESYEQACTRHISSLIYLQFERLFQFSRKVDELTYTIAAEEIPFQLGLSKTDLRRVIKSSLSGIDKSIGAMYRRLQKTLTSDELFPSLWDKCKKEFLDKYESFVQMVTRIYGNEPIMSVADMKDVLANF

SEQ ID NO: 18765 - protein, 600 aa, Erwinia rhapontici
MSSQGLKTAVAIFLATTFSATSYQACSAGPDTAPSLTVQQSNALPTWWKQAVFYQVYPRSFKDTNGDGIGDLNGIIENLDYLKKLGIDAIWINPHYDSPNTDNGYDIRDYRKIMKEYGTMEDFDRLISEMKKRNMRLMIDIVINHTSDQHAWFVQSKSGKNNPYRDYYFWRDGKDGHAPNNYPSFFGGSAWEKDDKSGQYYLHYFAKQQPDLNWDNPKVRQDLYDMLRFWLDKGVSGLRFDTVATYSKIPNFPDLSQQQLKNFAEEYTKGPKIHDYVNEMNREVLSHYDIATAGEIFGVPLDKSIKFFDRRRNELNIAFTFDLIRLDRDADERWRRKDWTLSQFRKIVDKVDQTAGEYGWNAFFLDNHDNPRAVSHFGDDRPQWREHAAKALATLTLTQRATPFIYQGSELGMTNYPFKKIDDFDDVEVKGFWQDYVETGKVKAEEFLQNVRQTSRDNSRTPFQWDASKNAGFTSGTPWLKINPNYKEINSADQINNPNSVFNYYRKLINIRHDIPALTYGSYIDLDPDNNSVYAYTRTLGAEKYLVVINFKEEVMHYTLPGDLSINKVITENNSHTIVNKNDRQLRLEPWQSGIYKLNP

SEQ ID NO: 18766 - protein, 854 aa, Oryza sativa
MAKSSADDAELRRACAQAVAASGARGEEVSFSIRVAKGRGIFEKLGRLAKPRVLALTVKQSTKGEAAKAFLRVLKYSSGAVLEPAKLYKLKHLTKVEVISNDPSGCTFVLGFDNLRSQSVAPPQWTMRNIDDRNRLLFSILTMCKEILSYLPKVVGIDFVELALWAKENTVTLDNQSSTQDGQEKSVTTQTERKVTVTVENDLVSQAKDEEEDMEALLDTYVMGIGEADAFSERLKQELVALEAANVYQLLQSEPLIDEVLQGLDAASATVDDMDEWLRIFNMKLRHMREDIASIESRNNGLEMQSVNNKGLVEELEKLLDRLRIPQEFAASLTGGSFEESRMLKNVEACEWLTGAIRSLEVPNLDPCYVNMRAVREKRAELEKLKTTFVRRASEFLRNYFSSLVDFMISDKSYFSQRGQLKRPDHADLRYKCRTYARLLQHLKSLDKSCLGPLRKAYCHSLNLLLRREAREFANELRASTKAPKNPAVWLEGSNSGGQNGSSADTSTVSDAYSKMLTIFIPLLVDESSFFAHFMCFEVPALVPAGAPNAKSRSGGNDPDDDLNLMDPDGNDLKPDDTSAELGTLNDALQELLDGIQEDFYAVVDWAYKIDPLRCISMHGITERYLSGQKADAAGFVRRLLHDLESRISTQFSRFIDEACHQIERNERNVRQTGILAYIPRFAVLASRMEQYIQGQSRDLIDKAYTKLVSTMFTTLDKIAHSDPKTADIVLIENYAAFQNSLYDLANVVPTLAKFYHEASESYEQACTRHISSLIYLQFERLFQFSRKVDELTYTIAAEEIPFQLGLSKTDLRRVIKSSLSGIDKSIGAMYRRLQKTLTSDELFPSLWDKCKVS

SEQ ID NO: 18767 - protein, 458 aa, Bartonella quintana
MSALSSNRLPNRASLVTNRAFSALEGFLHVEAFSGIVLLLAAAAALIFANSQYASVYESLWHTPLGFNFGHFTLSWDLHFWVNDALMTVFFLVAGMEIRREIHEGALADFKQAILPIVSAIGGVCFPALIYLSFNFNSEHTHGWAVPTATDIAFALGILALLGKKIPANLHVILLSLAIIDDIIAVLIIAFFYSTNIDPSGLAIAIAGIALVLFFQWIGLASAWLYILPGAIIWWGLMITGVHPSLTGVILGMMTPVFPTRTLVAPLTILSNAMQILQEKNIKTDLHHISTALKKMRKGQRDMIAPVIRVQKTLHPWVAYGVMPIFAFANAGVSFANFDLSSHESFLVVLSVVIGLFIGKPLGIITASYLAVKSGLCRLPPHMTWTGILLIGFLAGIGFTMSIFVSMLAFKDIVLLDSAKIGVLCGSGLSALAGLGYGLIYIKRNKNKKVLHNLNGIK

SEQ ID NO: 18768 - protein, 175 aa, Parvularcula bermudensis
MTSDTATRTERALLAGGCFWGMQDLLRKVPGVLRTRVGYTGGAYDNPTYNDVKTGRTGHAEAIEIIFDPDVVSYEKMLHWFFKIHDPTTRNRQGNDIGPQYRSAIWFTSDAQKATAEAVMADVDRSGKWPGPLVTELAPAGVFTEAEAEHQDYLERYPHGYTCHFVRPDWHLDAA

SEQ ID NO: 18769 - protein, 502 aa, Staphylococcus epidermidis
MISKSSPLIFERSKKDRYAYSLPQNDIENISIASLLDDKYIRKHKAEFPEVSELDLVRHYTELSNKNFGVDTGFYPLGSCTMKYNPKINEKVARISGFSESHPLQEEEHVQGSLEIIYSLQEELKEITGMDEVTLQPAAGAHGEWTALMIFKAYHEKNGQSHRDEVIVPDSAHGTNPASASFAGFKSVTVKSNQRGEVDIEDLKRVVNDNTAAIMLTNPNTLGIFEQDIIEIGKIVHEAGGLLYYDGANLNAILDKVRPGDMGFDAVHLNLHKTFTGPHGGGGPGSGPVGVVEKLASYLPKPMVIKDNDRYKYDNDIPNSIGRVKPFYGNFGIYLRAYTYIRSMGANGLKEVSEAAVLNANYIKSRLKNHFEIPFNQYCKHEFVLSGTLQKQYGVRTLDMAKRLLDFGVHPPTIYFPLNVEEGMMIEPTETESKETLDYFIDAMIQIADETKNDPDKVLEAPHTTIIDRLDETTAARKPILKFEELKDEKYKEHTNIDSEDN

SEQ ID NO: 18770 - protein, 551 aa, Erwinia rhapontici
MRSTPHWKEAVVYQVYPRSFMDSNGDGTGDLNGIISKLDYLQQLGITLLWLSPVYRSPMDDNGYDISDYEEIADIFGSMSDMERLIAEAKARDIGILMDLVVNHTSDEHPWFIDALSSKNSAYRDFYIWRAPAADGGPPDDSRSNFGGSAWTLDEASGEYYLHQFSTRQPDLNWENPRVREAIHAMMNRWLDKGIGGFRMDVIDLIGKEVDPQIMANGRHPHLYLQQMNRATFGPRGSVTVGETWSATPEDALLYSAEERQERQELTMVFQFEHIKLFWDEQYGKWCNQPFDLLRFKAVIDKWQTALADHGWNSLFWSNHDLPRAVSKFGDDGEYRVVSAKMLATALHCLKGTPYIYQGEEIGMTNVNFADIDDYRDIESLNLYQERIAEGMSHEAMMRGIHANGPDNARTPMQWTAVHMPGLPPVSPGLRLILTSGQWNVAAALDDPDSVFYHYQKLVALRKQLPLLVHGDFRQIVVEHPQVFAWLRTLGEQTLVVINNFTRDAVMLAIPDNLQSQQGRCLINNYAPREQLEPIMELQPYESFALLIERL

SEQ ID NO: 18771 - protein, 152 aa, Solanum lycopersicum
MALSHPMTIFSLFLTFLALTAAQSPMMAPTMPPSTMSMPPTTSTTTPPPMSSMSPPPSAMSPTPSTMSPPPMSPMTPSMSPMGPMTPTMSPMDSPPAPAGPGMAPGMSTPGPAPGPMGGESMASPPPSSGFVHGISISMAMVAIIGSVALFF

SEQ ID NO: 18772 - protein, 505 aa, Ostreococcus tauri
MDFEFGRALNKTTTTTARASAESAIDARLEGDDDESEDDAFYSWRVGGANDLKITHLRDVYRGDVPLVAQPSPFCTTTACPLSGPRTSVEFNSNFVSNSDRVLLNSVAFGSSADPTQTCSLWAETFDPNGCDYVPQWVVRAGPRSEVYFDSDEVHAAIVTCGGLCPGINDVIRSLVNTLEVGYGVKKISGIRYGFKGFFSGVEFMKLNKKTVRNIHTLGGSMLGSGRGGGDVQKIVESIIHHGINMVFVIGGNGTHAGANAISDECAKRGVKVSVVGVPKTIDNDILLLDKTFGFDTAVEEAQKAILAAATEAQSAYRGVGVVKLMGRQSGFITMFATLANGQVDCCLIPETTWAAHGPNGVINYVRNLLDTQGHAVVVLAEGAGQEFVTSTGVDAGGNPKLGDIGQWFCKQLKSELKCDIKYIDPTYMVRGCQANAHDSIMCTVLGQNAVHGAFAGFTGISVGTVSAHTAYLPIPRMIEHERLVDPDGRMWHRTLESTGQPDFF

SEQ ID NO: 18773 - protein, 112 aa, Photobacterium profundum
MKLISAIIKPFKLDDVREALADVGVEGMTVSEVKGFGRQKGHTELYRGAEYQVDFLPKVKIEIATQADNFEAIVDAISKAAQTGKIGDGKIFVYDLDHAVRIRTGETDLEAL

SEQ ID NO: 18774 - protein, 689 aa, Haloarcula marismortui
MGTDQNRNPRAEQTVCPYCGVGCTIQYAGNGKATGTAGPVNTKGEICPKGGAAFDVVEHEDRLTEPLVRENGRFVTALWETALSRVTDQLGEIIDQHGPDAVEFFASSNCTNEENYVFQKIARMLGTNNVDNCARLCHSSTVAAMSERLGAGAMTNTLDDLAETDCLLVTGANPAEQHPVIFRSYFLPAIRNGATLIHIDPRETDTTEAADIHLDVRPGYDIQLLNSMAKVVLDEGLVDESFVEERTTGYADLTAHLDDVDVGSGADVAGVDPETVREAARAYAEADSAAIVTGMGMSQHTCGTDNVHALLNLALLTGNVGRPGTGVNPLRGQNNVQGAGDVGALPSVLPGYEPVTDADARQRLADEWGVEPPSEPGLTETTATHQFGDSVKAAVVFGENPAVTEPNASSVRAGFDDLDFCVVIDLFETATVDHADVVLPGSSWAEKAGTVTNTDRRVMRMRPNADLPGNARRDLDILTGLGQRLVGQSDAFDYDGPEAVFEELTRVNPLYAGMSYDGIGDSYQRWPFPADADSGTDVLHTETFASGQQTAPLRPVSPTPPADAVSGEQLVLTTGRALQHFNSGALTRRSETLMRMRGEDVLEIHPDDAAARGIEDGDTVIVENDRGSVTVSAAVTAAIRPGVVFCTFHYLDPLANALTGDALDPVAEIPEYKHSAVQVQKSSASTDDN

SEQ ID NO: 18775 - protein, 382 aa, Moorella thermoacetica
MAKRDYYEVLGVSRDASEAEIKKAYRQLARKYHPDMNPGDKEAEEKFKEVQEAYEVLSNAEKRARYDQFGHAGTEAGGGPGFGGFDFGGAGADFGFGDIFDMFFGGGFGGAARRQGPQRGDDLRLDLEISFEEAAFGVEKEVGIPRQEKCPECGGSGAAPGTHPKTCPTCHGTGQIRIAQRTPLGQFQTIRTCHQCHGQGTIIETPCPRCRGRGVVQRTRKIRVKIPPGVDTGARLRMAGEGESGLRGGPPGDLYIYINVRPHKLFRRDGYDVFCEVPVSMVQAALGDSIKVPTLDGKEELHIPPGTQSGTSFRLKGKGIPRLNGVGRGDQHVRIHVETPTNLNEKQKELLREFARLYGSEPRGAREQDKGFFRKVKDAFMG

SEQ ID NO: 18776 - protein, 326 aa, Bacteroides fragilis
MGTVKCVGILTSGGDAPGMNAAIRAVTRAAIYNGLQVKGIYRGYRGLVTGEIKEFKSQNVSNIIQLGGTILKTARCKEFTTPEGRKMAYDNMVKEGIDALVVIGGDGSLTGARIFAQEYDIPCIGLPGTIDNDLYGTDTTIGYDTALNTILDAVDKIRDTATSHERLFFVEVMGRDAGFLALNGAIASGAEAAIIPEFSTEVDQLEEFIKSGFRKSKNSSIVLVAESELTGGAMHYAERVKNEYPQYDVRVTILGHLQRGGSPTAHDRILASRLGAAAIDAIMEDQRNVMIGIEHDEIVYVPFSKAIKNDKPVKRDLVNVLRELSI

SEQ ID NO: 18777 - protein, 289 aa, Bacteroides fragilis
MERKLAVITGADGGMGTEITRAVACAGYDVIMACYSSSKAETKCRELVKETGNEKIEVWQIDLASLASVRAFADRMLRQKTPVALLMNNAGTMETGLHITEDGLERTVSVNYVGPYLLTRLLLPLMGEGTRIVNMVSCTYAIGKLDFPDFFLWGRKGSFWRIPIYSNTKLALLLFTIELAERLRARGITVNAADPGIVSTNIIRMDQWFDPLTDIFFRPFIRTPLQGAATAIGLLLDAEVEGRTATFNLNNHCRLLPEKYTRPDRRAQLWEETERILSEKGFLPINDKR

SEQ ID NO: 18778 - protein, 319 aa, Bradyrhizobium japonicum
MARFVTIAAGQLGPIARAETRTEVVARLMALMRQARANGCDLIVYPELALTTFFPRWYFEDQAEIDAFFEREMPGAQTQALFDLAREIGIGFYLGYAELTVEAGVARRYNTSILVDKSGAIVAKYRKVHLPGHAEHEPWREFQHLEKRYFEPGSGFGVTNAFGGVMGMAICNDRRWSETYRVMGLQGVEMVMIGYNTPVHNPPAPEHDDLSLFHNHLVMQAGAYQNGTFVVGVAKAGIEEGVDHIGGSCIIAPSGEIVAACTTKGDEIALARCDLDLCNSYKRTTFNFDVHRQPRAYGMIVERKGVTTMADGTQVPTKG

SEQ ID NO: 18779 - protein, 304 aa, Unknown
  Anabaena
MTQAKAKHADVPVNLYRPNAPFIGKVISNEPLVKEGGIGIVQHIKFDLTGGNLKYIEGQSIGIIPPGVDKNGKPERLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETY

SEQ ID NO: 18780 - protein, 413 aa, Campylobacter lari
MLENFDKEIFDLTQKELARQCDGLEMIASENFTIPEVMEVMGSILTNKYAEGYPGKRYYGGCEFVDEIETIAIERCKKLFNCNFANVQPNSGSQANQGVYMALLNPGDRILGMDLSHGGHLTHGSKVSSSGKVYESFFYGVELDGRINYDKVREIAKEIKPKLIVCGASAYPRVIDFAKFREIADEVGAYLFADIAHIAGLVVAGEHPSPFPYAHVVSSTTHKTLRGPRGGIIMCNDEEIAKKINSAIFPGIQGGPLMHVIAAKAVGFKYNLSDEWKIYAKQIIKNTATLAQVLIDRKYDLVSGGTDNHLILLSFLNKEFSGKDADLALERAGITANKNTVPGETRSPFVTSGLRLGTAALTARGFKEEQIAIVANYIADILDDIQNTKLQEEIKVKLKDLASNFIIYERALF

SEQ ID NO: 18781 - protein, 556 aa, Bacillus clausii
MEWWRTSTVYQIYPKSFNDTTGNGIGDLQGIIEKLDYLKELGIDVIWLTPIYASPQNDNGYDISDYYAIHEDYGTMADFEELLNETHKRGMKLIMDLVVNHTSTEHQWFKNAKLSKQAKYRDFYIWKEGKEGGAPTNWQSKFGGSAWEYNEATDDYYLHLFDVTQADLNWENEQLRKHVYEMMHFWFNKGIDGFRLDVINLISKDQRFPDDDGSVAPGDGRKFYTDGPRVHEYLQEMNREVLAKYDSLTVGEMSSTTIEDCIRYSNPKQRELSMTFNFHHLKVDYPNGEKWAVADFDFKALKQILSEWQVRMHEGGGWNALFWCNHDQPRVVSRYGDEDEYHNQSAKMLAATIHFMQGTPYVYQGEEFGMTNPNFTSIDDYRDVESLNVYARLKEEGVPEEHILAILKQKSRDNSRTPVQWDSSEQAGFTTGTPWIKVSSNYKEINAKKALSDPNSIFYFYQKLIALRKKLPIVTTGDYRLLVPEHDHVFAYVRTDGTEKLLVVSNFYPVNCDFECPEDLVSLKATQLISNYNQKRKLEKTFSLKPYETVAFQLKE

SEQ ID NO: 18782 - protein, 304 aa, Unknown
  Anabaena
MTQAKAKHADVPVNLYRPNAPFIGKVISNEPLVKEGGIGIVQHIKFDLTGGNLKYIEGQSIGIIPPGVDKNGKPESLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETY

SEQ ID NO: 18783 - protein, 304 aa, Unknown
  Anabaena
MTQAKAKHADVPVNLYRPNAPFIGKVISNEPLVKEGGIGIVQHIKFDLTGGNLKYIEGQSIGIIPPGVDKNGKPEQLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETY

SEQ ID NO: 18784 - protein, 161 aa, Bacillus clausii
MSVYDFSVKTSNGQDVSLSAYKGNVLLIVNTATKCGFASQFAGLEKLYNDYKEKGFYVLGFPSNQFLNQEPVADEDMEQVCKINFGVTFPLFAKTDVKGKHANPLFNYLKAAKKGMLSEEIKWNFTKFLVNRKGEVIKRYAPATKPETIEADVIEELKADA

SEQ ID NO: 18785 - protein, 195 aa, Leuconostoc mesenteroides
MSRTATIKRDTFETQIELTLDLDEQTPIKVDTGIGYIDHMLTLFAKHGRFGLQVDVKGDLQVDSHHTTEDIGIVLGEAFTQALGDKVGIERYGAQFVPMDETLTRAVIDLSGRSYLVLHAELTAPTLGTFETEVVEDFWQGFADQARANVHIEVLYGRNTHHKIESMFKAVGRAMRQAITINPEIKGVNSTKGRI

SEQ ID NO: 18786 - protein, 487 aa, Nocardia farcinica
MPTTVTSPQVAVNDIGSAEDFLAAIDATIKYFNDGDIVEGTIVKVDRDEVLLDIGYKTEGVIPSRELSIKHDVDPNEVVSVGDEVEALVLTKEDKEGRLILSKKRAQYERAWGTIEELKEKDEAVKGTVIEVVKGGLILDIGLRGFLPASLVEMRRVRDLQPYVGKEIEAKIIELDKNRNNVVLSRRAWLEQTQSEVRSEFLHQLQKGQVRKGVVSSIVNFGAFVDLGGVDGLVHVSELSWKHIDHPSEVVEVGNEVTVEVLDVDLDRERVSLSLKATQEDPWRQFARTHAIGQIVPGKVTKLVPFGAFVRVEEGIEGLVHISELAERHVEVPDQVVAVGDDAMVKVIDIDLERRRISLSLKQANEDYSPEFDPSKYGMADSYDEQGNYIFPEGFDPETNEWLEGYEKQRDEWESRYAEAERRHKMHTAQMEKMAADAAAEAANGGGGNYSSESGAQSSAGQSEPAGGSLASDAQLAALREKLSGNA

SEQ ID NO: 18787 - protein, 994 aa, Glycine max
IRLEGVVVAAAGGFLGVGSARSISVEALRPSDTFPRRHNSATPEEQSKMAESCGFGSLDSLVDATLPKSIRLKDMKFGKFDAGLTENQMIEHMKDLASKNKVFKSYIGMGYYNTHVPPVILRNIMENPAWYTQYTPYQAEISQGRLESLLNYQTMITDLTGLPMSNASLLDEGTAAAEAMSMCNNIQKGKKKTFIIASNCHPQTIDICKTRADGFDLKVVTADLKDIDYKSGDVCGVLVQYPGTEGEVLDYGEFVKKAHAHEVKVVMASDLLALTVLKPPGEFGADIVVGSAQRFGVPMGYGGPHAAFLATSQEYKRMMPGRIIGVSVDSSGKTALRMAMQTREQHIRRDKATSNICTAQALLANMAAMYAVYHGPEGLKNIAHRVHGLAGAFALGIKKLGTVEIQDLPFFDTVKVKTSNAHAIADAALKSGINLRVVDGNTITVAFDETTTLEDVDNLFKVFAGGKPVSFTAASLAPEVQSAIPSGLVRKSPYLTHPIFNTYQTEHELLRYLYRLQSKDLSLCHSMIPLGSCTMKLNATTEMMPVTWPSFSDIHPFAPVDQAQGYQEMFNNLGELLCTITGFDSFSLQPNAGAAGEYAGLMVIRAYHLARGDHHRNVCIIPVSAHGTNPASAAMCGMKIVSVGTDAKGNINIEELRKAAETHKDNLSALMVTYPSTHGVYEEGIDEICNIIHDNGGQVYMDGANMNAQVGLTSPGWIGADVCHLNLHKTFCIPHGGGGPGMGPIGVKKHLAPFLPSHPVIETGGIPAPDKPQPLGTIAAAPWGSALILPISYTYIAMMGSKGLTDASKIAILNANYMAKRLENYYPVLFRGVNGTVAHEFIIDLRGFKNTAGIEPEDVAKRLMDYGFHAPTMSWPVPGTLMIEPTESESKAELDRFCDALISIRQEIAEIEKGKVDINNNVLKGAPHPPSLLMADAWTKPYSREYAAFPAPWLRTAKFWPTTGRVDNVYGDRNLICTLLPASQAVEEQAAATA

SEQ ID NO: 18788 - protein, 129 aa, Alyssum lesbiacum
FDVHVRATGDTHIDDHHTNEDVALAIGTALLKALGERKGINRFGDFTAPLDEALIHVSLDLSGRPYLGYNLEIPTQRVGNYDTQLVEHFFQSLVNTSGMTLHIRQLAGKNSHHIMEATFKAFARALRQA

SEQ ID NO: 18789 - protein, 545 aa, Pseudomonas putida
MATCGEVLVKLLEGYGVDHVFGIPGVHTVELYRGLAGSSIRHITPRHEQGAGFMADGYARTRGKPGVCFIITGPGMTNITTAMGQAYADSIPMLVISSVQSRDQLGGGRGKLHELPNQAALVSGVAAFSHTLMSAADLPQVLARAFAVFDSARPRPVHIEIPLDVLVEPADFLLPGRPVRGSRAGAAPQAVAQMAERLASARRPLILAGGGALAAGAALARLAEHLQAPVALTINAKGLLPASHPLQIGSTQSLPATRALVAEADVVLAIGTELAETDYDVTFKGGFEIPGRLLRIDIDPDQTVRNYLPELALVADAELAAEALLGAVQAQPQPVHESTWGVARVADLRKVLAADWDQPTLSQTRLLSAILERLPDAILVGDSTQPVYTGNLTLDMQQPRRWFNASTGYGTLGYALPAAMGAWLGSAEQAVERAPAVCLIGDGGLQFTLPELASAVEAQVPLIVLLWNNQGYEEIKKYMVNRAIEPVGVDIHTPDFIGVARALGAAAENVADIAQLQAALGQAVERKGPTLIQVDQNQWQAAVLG

SEQ ID NO: 18790 - protein, 150 aa, Hordeum vulgare
MKKKGVDKFPSLVCWEKENVSSEALEAARIACNKYMTKNAGKDAFHLRVRVHPYHVLRINKMLSCAGADRLQTGTRGAFGKPLGTCARVDIGQVLLSVRSKEINGIHADEALRHAKFKFPGRRKTIPSRGFTKFNKADYIKYKSRGKDRV

SEQ ID NO: 18791 - protein, 120 aa, Glycine max
MAPTVMMASSATAVAPFQGLKSAASLPVARRSTRSLGNVSNGGRIRCMQVWPAYGNKKFETLSYLPPLSTDDLLKQVDYLLRNGWIPCLEFSKLGFVYRENSTSPCYYDGRYWTMWKLPM

SEQ ID NO: 18792 - protein, 219 aa, Glycine tabacina
NGNNLPTKQAVVDLYKSNRIDKIRLYHPDEAILQALRGSNIEVILTVPNDQLQSLTNAGAANDWVNKYVKGYSQNVKFKYIAVGNEVHPGDAAAGSVLPALKNIQNAISSANLQGQIKVSTAIDTTLLGNSYPPKDGVFSNSASSYIGPIVSFLARNGAPLLANVYPYFAYVGNQQTIGLDYALFTKQGKNEVGYQNLFDALLDSLYAALEKVGAPNVK

SEQ ID NO: 18793 - protein, 259 aa, Brassica napus
MELSSAIYSQSSAAQILRPKLCFTVSIPQRASIVSSSSSRPRYLRMETQSQPRQSISCASSPSNNVSPATSNESDRVGEVKRVTKETNVSVKINLDGTGLADSSTGIPFLDHMLDQLASHGLFDVHVRATGDVHIDDHHTNEDIALAIGTALLKALGERKGINRFGDFTAPLDEALIHVSLDLSGRPYLGYNLEIPTQRVGNYDTQLVEHFFQSLVNTSGMTLHIRQLAGRNSHHIIEATFKAFARALKTATENDPRRG

SEQ ID NO: 18794 - protein, 219 aa, Glycine falcata
NGNNLPTKQAVVDLYKSNRIGKIRLYYPDEGVLQALRGSNIEVILGVPNDQLQSLTNTGAATNWVNKYVKTYSQNVKFKYIAVGNEIHPGDSLAGSVLPALENIQKAISAANLQGQIKVSTAIDTTLLGNSYPPKDGVFSSSASSYIRPIVNFLARNGAPLLANVYPYFAYANNQQSIGLDYALFTKQGNNEVGYQNLFDALLDSLYAALEKVGAPNVK

SEQ ID NO: 18795 - protein, 328 aa, Prochlorococcus marinus
MAKIYEDNSFAIGNTPLVKLKSVTKNAKATVLAKIEGRNPAYSVKCRIGANMIWDAEKSGKLTKDKTIVEPTSGNTGIALAFTASARGYKLILTMPESMSIERRRVMAVLGAEIVLTEASKGMPGAIAKAKEIAESNPSQYFMPGQFDNPANPEIHFKTTGPEIWDDCDGEIDVLVAGVGTGGTITGVSRYIKQEKGKNITSVAVEPSHSPVITQTMNGEEVKSGPHKIQGIGAGFIPKNLDLSIVDKVEQVTNDESIEMALRLAKEEGLLVGISCGAAAAAAVRLAEQDEYAGKTIVVVLPDLAERYLSSIMFTEVPSGIIQEPVKA

SEQ ID NO: 18796 - protein, 497 aa, Staphylococcus aureus
MSKVQNESNNVVKRGLKDRHISMIAIGGCIGTGLFVTSGGAIHDAGALGALIGYAIIGIMVFFLMTSLGEMATYLPVSGSFSTYATRFVDPSLGFALGWNYWFNWVVTVAADITIAAQVIQYWTPLQGIPAWAWSALFLVIIFSLNSLSVRVYGESEYWLALIKVITVIVFIAIGLLTIVGIMGGHVVGFEIFNKGEGPILGGNLGGSLLSILGVFLIAGFSFQGTELIGITAGESENPERAVPKAIKQVFWRILLFYILAIFVIGMLIPYDSSALMGGSDNVATSPFTLVFKNAGFAFAASFMNAVILTSVLSAGNSGMYASTRMLYSMSKDKLAFEAFGKTNKNGVPYMSLLVTAIIVVIILVLQSLTKGAYEYIVAASGLTGFIAWVGIAVSHYRFRRAFDKQNYDKSKLKYTAKLFPFGPLFAGFLCIVVIIGQDVDFIKTGDFNFSRFLITYMGIPVFLAFFIYHKLRYKTKKIPLEQVDLRQDVSMDEIKG

SEQ ID NO: 18797 - protein, 320 aa, Mycobacterium smegmatis
MRAVLIVNPNATSTTAAGRDLLAHALESRVSLTVAHTDHRGHAIEIAREATRDGVDVLIVHGGDGTVNEVVNGVLSECGSRPDADSAPAVSVVPGGSANVFARALGISPDPIEATNQLVDLLSDYRNGNDWRRIGLMDCGERWAVFTAGMGVDGDVVAAVEAQRAKGRKVTAGRYIRVAVREVLASVRREPSLTLHLPGREPVSGVHFAFVSNSSPWTYANTRPVWTNPDTTFETGLGVFATTSMNVWSNLRLVRQMLSRKPRIEGKHLIRDDDVPTVTVTSDTPVACQIDGDYVGLRESMSFTAVPAALKVVAPPCSRP

SEQ ID NO: 18798 - protein, 552 aa, Erwinia rhapontici
MANWWKEAVAYQIYPRSFNDSNNDGIGDLNGITEKLDYLEDLGIDLIWICPMYQSPNDDNGYDISDYQKIMAEFGTMDDFDRLLEQVHARGMRLIIDLVVNHTSDEHPWFLASSASRDNPKRDWYIWRDGKAGAEPNNWESIFNGSAWKYSAATGQYFLHLFSEKQPDLNWENPEVRSAVYAMMRWWLDKGVDGFRIDAICHMKKEPTFSDMPNPLALPYVPSFERHLNYDGLLDYVDDMCEQVFSHYDIVTIGEMNGASAEQGEEWVGEQRGRLNMIFQFEHVKLWQDGQKDTLEASLDLPGLKEIFTRWQTLLENKGWNALYVENHDLPRVVSGWGDDKNYQRESATAIAAMFFLMKGTPFIYQGQELGMTNTHFASLEDFDDVAAKKLAVEMRRQGREEPEILAFLSRTGRENSRTPMQSDQSAHGGFSNATPWFPANSNYPVINVADQRADSGSVLNFYRALIRLRRQMPVLIEGAYQLLLPTHPQIYAYTRRLNEQQVLVIVNFSAHQQEIDPQQLLLDGWQPLLSNYQEQGKRQILRAYEAQIYQR

SEQ ID NO: 18799 - protein, 219 aa, Glycine latrobeana
NGNNLPTKQAVVDLYKSNRIGKIRLYYPDEGVLQALRGSNIEVILGVPNDQLQSLTNAGAATNWVNKYVKAYSQNVKFKYIAVGNEIHPGDSLAGSVLPALENIQNAISAANLQGQIKVSTAIDTTLLGNSYPPKDGVFSNSASSYIGPIVSFLAGNGAPLLANVYPYFAYVGNQQNIGLDYALFTKQGKNEVGYQNLFDALLDSLYAALEKVGAPNVK

SEQ ID NO: 18800 - protein, 129 aa, Crocosphaera watsonii
MEKATFGAGCFWGVEAAFRKLKGVISTSVGYMGGHWPNPCYLDVCARVTGHAEVVQIEYYPTIISYEYLLENFWNIHDPTSLNRQGYDRGEQYRSVIFYHNSTQEKIARHSKIKMPNSGQYKKDIVTET

SEQ ID NO: 18801 - protein, 271 aa, Oryza sativa
VIPDAIGGLDHLEELRLASNALISLPDSIGLLLNLRILNVGSNRLRSLPDSISKCRSLIELDASYNGLAYLPTNIGYELVNLRKLWVHMNKLRSLPSSICEMRSLYLLDAHFNELCGLPSAIGKLSSLEILNLSSNFSDLKDLPASFGDLLNLRELDLSNNQIHALPDNFGRLDKLEKLNLEQNPLSMPPMEIVNKGVDAVKEYMLQRWLDILLEEERKSIAAAESPQAPTTPSAWLARSVSWVSDVSGSLVGYLSGENKTEKDAYLDQQY

SEQ ID NO: 18802 - protein, 37 aa, Clostridium symbiosum
KFLGFEQAFKDSLTTLPMGGAKGGSDFDPNGKSDREV

SEQ ID NO: 18803 - protein, 219 aa, Glycine latrobeana
NGNNLPTKQAVVDLYKSNRIGKIRLYYPDEGVLQALRGSNIEVILGVPNDQLQSLTNAGAATNWVNKYVKAYSQNVKFKYIAVGNEIHPGDSLAGSVLPALENIQNAISAANLQGQIKVSTAIDTTLLGNSYPPKNGVFSSGASSYIRPIVNFLARNGAPLLANVYPYFAYVNNQQSIGLDYALFTKQGNNEVGYQNLFDALLDSLYAALEKVGAPNVK

SEQ ID NO: 18804 - protein, 655 aa, Unknown
  Burkholderia sp. 383
MCGIDGFLNSVAFDEETARGTLARMTASLAHRGPDGQGIWVDPEAGIALGHRRLAIVDLSVHGRQPMASACGRYVMVFNGEIYNHRELRAELERAGRAPAWRGHSDSEVLIAAIVAWGVDATLRRATGMFSIALWNRESRVLTLARDRIGEKPLYYGRIGDALVFASELKALRGYPGFDGAIDRDALCLYLRQSSVPAPHTIYRGIHKLPPGTYIQFEHARDTPRLRAYWTLEQAIEDGRAQPFEGNADEAVSQLDAVLRQAVARQMEADVPLGAFLSGGVDSSTIVALMQAQSSTPVDTFTIGFHEAGYDEAGYAKAVARHLGTRHTELYVTADHALGVVPKLPSIYDEPFSDASQIPTFLVSEMTRRHVKVSLSGDGGDELFGGYTRYFLTPRLWRKLHRVPGAVRARIAAALHALRPDHADQLAAVAQGAWGGVEARESATRIGDRLHKLGHVMTAESRIGLYRLLMSSVHHPERLALSGQEPATPLDTVSAWPAHLSFAEQAMAIDTLTYLPTDILAKVDRAAMAVSLETRMPFLDHHVVEFAWRMPADLRLPEGQSKALLRRLLDRYVPSALIDRPKQGFCAPVDHWLRGSLRDWAEALLRPSRLREEGFFDAAAVERLWRQHVTGRMNWQHQLWTVLMFQAWLEAQRAT

SEQ ID NO: 18805 - protein, 152 aa, Solanum tuberosum
MSSFSEEQEALVVKSWGSMKKDAGEWGLKFFLKIFEIAPSAKKMFSFLKDSNVPLDQNPKLKVHAKSILVMTCEAAVQLRKAGKVVVRDSTLKKIGATHFKYGVADEHFEVTKYALLETIKEASPEMWSVEMKNAWGEAYDQLVSAIKTEMK

SEQ ID NO: 18806 - protein, 219 aa, Glycine latrobeana
NGNNLPTKQAVVDLYKSNRIDKIRLYYPDEGALQALRGSNIEVILTVPNDQLQSLTNAGAANDWVNKYVKGYSQNVKFKYIAVGNEVHPSDAAAGSVLPALKNIQNAISSANLQGQIKVSTAIDTTLLGNSYPPKDGVFSNSASSYIGPIVSFLAGNGAPLLANVYPYFAYVGNQQNIGLDYALFTKQGKNEVGYQNLFDALLDSLYAALEKVGAPNVK

SEQ ID NO: 18807 - protein, 431 aa, Haloarcula marismortui
MGPELSSASSSDNSSTPSEPESALETARLQLHRAADHLDIDPNIVERLNHPQNVHEVTVPIERDDGTVEVFTGYRAQHDSVRGPYKGGLRYHPDVTRDECVGLGIWMTWKCAVMDLPFGGAKGGIAVNPKTLSRDEKERLTRRFAQELRAVIGPNRDIPAPDMGTDPQTMAWLMDAYSMQEGETIPGVVTGKPPIVGGSEGREDAPGRSVAIITQQVCEYYDQPLSETTVAVQGYGSVGANAARLLDEQGATVVAISDVNGAMYDPAGIDTATVPSHDEEPEAVTEYADTVISNDELLTLDVDVLIPAALGNVITEANADDIAAEYVVEGANGPTTSTADSILADRDVVVIPDILANAGGVTVSYFEWLQDINRRSWSLERVNDELDEEMRAAWDAVRTEFENRDITWRDAAYIVALSRIAEAHEARGLWP

SEQ ID NO: 18808 - protein, 162 aa, Triticum aestivum
MSAAERAVVFSEEKDALVLKSWAIMKKDSANLGLRFFLKIFEIAPSARQMFPFLRDSDVPLETNPKLKTHAVSVFVMTCEAAAQLRKAGKITVRETTLKRLGGTHLKYGVADGHFEVTRFALLETIKEALPADMWGPEMRNAWGEAYDQLVAAIKQEMKPSE

SEQ ID NO: 18809 - protein, 171 aa, Triticum aestivum
MQSLQDKASEWSGVAAADAFAIDEVNVFEALGGTPQPFVDLSTNFYTRVYEDEEEWFPEIFSGSRKEDAIQNQYEFLVQRMGGPPLFSQRRGHPALIGRHRPFPVTHQAAERWLHHMQQALETTESINPDTKTKMMIFFRHTAYFLVAGNEMTRQTQSVPPCKHATSKPAE

SEQ ID NO: 18810 - protein, 412 aa, Helicobacter hepaticus [sequence omitted]

SEQ ID NO: 18811 - protein, 92 aa, Brassica napus
  misc_feature (66)..(66): Xaa can be any naturally occurring amino acid
MSNRRSRQSSSALRISDDQMIDLVSKLRVLLPEIRERRRSDKVSASKVLQETCNYIRKLHRKVDNXSDRLSQLLDSVDEDSQEAAVIRSLLM

SEQ ID NO: 18812 - protein, 373 aa, Campylobacter lari
MELNYYEILEISQTSDKETIKKAYRKMALKYHPDRNQGDKEAEEKFKLVNEAYEVLSNDEKRSIYDRYGKEGLKGQAGGFGGFGDVDLGDIFSSFFGDGFGFGSSTRKKEKGNKYPQDLKITTKISFKEAVFGCKKKIDFSYKSFCKSCKGSGSENGKLDTCPHCGGKGQVGVRQGFMTFVQSCDHCKGSGQIIKDKCKTCHGNGYEEIKDHIELDIPEGIDSGMSLRVQNKANELPNSSQRGDLYIKIIVEDDDKFIRHDDDIYTIVPVFFTQAALGKTIKVSTIRGEADLKLPVGAKDKQKFELTNEGVKNIHNGKLGSHIVQIEIKFPKNLTDEQKNLLLQLEKSFGLADEEAFIEQESLFDKIKSWFSH

SEQ ID NO: 18813 - protein, 456 aa, Pseudomonas syringae
MCIIGSGPGGLCMARALKRQGLDYEQFERHGEVGGVWDINNPGTPMYQSAHFISSRDQSGFIDYPMPAHFPDYPSNRQIFEYVRSFAVAFDLYDRIRFNTAVKDVEKEQDGRWLVTLASGERRRYRAVVCATGCNWDPNMPEVKGQFEGTVRHSVTYKNPDEFKGKRVMVIGADNSGADIACDAAKHADKAFISMRRGYHLIPKHLFGMPVDEFGEKGPQLPMWLARPVFQTILRVINGDTRRFGLPRPDHKLFESHPLLNTQLLHYLQHGDIQVKPDVSHYEGQHVVFKDGTREPLDLVLYATGYKWSCPYAAKYFEWQGGRPRLYLSIFSREHHNLFGIGYVETNSSAYKLFDSEAHAVACYLRDQLHQKTQASHFDQLIATDDPDLSGGIKFVKSQRHEVYLEAHALKKYLRKLFHSQGWPAVEEGYYKSLRKGTGYIPAPLQQKVAIQETCL

SEQ ID NO: 18814 - protein, 248 aa, Schizosaccharomyces pombe
MTEYYDLNLLEKETSEENNFHTKNQQVREDLSILYSILVALEQLEKAFTKDAVSTSDFNSTCELLIQQWESCFSDERVTQAFGSFEDFCSKYRLQCPRAIKRIQEGISDERSQSNSTFSNAISTTAEPSIAMNDTTPQTVNPTKAPSNPSASIAKSIAGLVQNFITTLDAIRLNFIAKDQLHPLLSELIVSMDDLTESLKIQVSCRNKLVQWLIKINNMNITDQLNDVEKRELLYDLEQAYAECYSLL

SEQ ID NO: 18815 - protein, 475 aa, Unknown
  Erythrobacter sp. NAP1
MATLAKSPEDNTTQEAASEEAAPKHWSEGVPEDDALDHIPGEKGWPLVGNTFRTLADPHAFTSYMVENYGKVYKTHAFGGWNVALIGAEANELVLFNKDKIFSSEQGWGPVLDQLFPRGLMLLDFDHHRIDRRALSIAFKPGPMRHYAGSLNSGISREVAKWEGEMKFYPAIKSLTLDLAADSFLGIPWGPEADAINTAFVDMVQASVAPVRSPLPFTKMKKGVDGRKFMVEFLTAETIRRRKEGGGQDMFSQFATATREDGELLPVDEVVDHMSFLLMAAHDTITSSATSLIYYLAINPEWQEKLREEIVAVTGGPDGDGNPRPLDYDDLGKLELTDMAFKEALRMMPPVPSMPRRALKSFEFGGYRIPAGTHVGINIYWTHYSDEYWDDPQTFDPMRFTPEKVKARHKYAWVPFGGGAHMCLGLHFAYMQVKVLMAQLLQRYRIEAPEGYAPDWQPWPIPQPKDGLKVTFKPL

SEQ ID NO: 18816 - protein, 726 aa, Unknown
  Azoarcus sp. BH72
MTAALQMTLEAGQAYPLGATWTGDGVNFAVFSAHASRMELCLFDEAGRNEIARMDLPELTDEVWHGFLPGAGPGLVYGYRAHGPYVPEEGHRFNPHKLLLDPYATELVGRLRWGPPIFGYELRNKRPGHGFDKRDSAACTLKARVAAPWPSASRPARRGQRVPWECMVIYEAHVRGLTRQHPAVGAEHRGTIAGLGSAAVIDHLKALGVTSVELLPVHAYVDDAYLTDKGLRNYWGYNSIGFFALEPRYLAGEGAAEFRDTVARLHDAGLEVILDVVYNHTAEGNELGPTLSFKGLDNASYYRLNPDDRRYYINDTGTGNTVNLSHPRVLQLVMDSLRYWVTQMEVDGFRFDLATILGREAAGFDPGCGFFDAVRQDPVLNRVKLIAEPWDCGPGGYQPGNFPPGWAEWNDGFRDTVRAFWRGDEGQAPGLATRLAGSADRFNHHGRRPWASINFITAHDGFTLHDLVSYNDKHNEANGEDNRDGHDDNRSWNCGAEGPTDDPEVLALRERQKRNLLATLLLAQGTPMLLAGDEIGRSQQGNNNAYCQDNEISWVHWAGVDADGERLRAFVRSLLLIRRALPVLRPARFATGGDPGHVLRDVIWLAPNGVELTPEGWADAQMRCFAMLADGRAHLGTGPEPAADAVVLVVLNAAHEAVECTLPQAAGITRWVRLVDTAQAEVADFAESAPGEGYSAAGRSLQLFVAAPTPQAAECVARLTARLGEG

SEQ ID NO: 18817 - protein, 473 aa, Arabidopsis thaliana
MESDLGKLFIGGISWDTDEERLRDYFSNYGDVVEAVIMRDRATGRARGFGFIVFADPCVSERVIMDKHIIDGRTVEAKKAVPRDDQQVLKRHASPIHLMSPVHGGGGRTKKIFVGGLPSSITEEEFKNYFDQFGTIADVVVMYDHNTQRPRGFGFITFDSDDAVDRVLHKTFHELNGKLVEVKRAVPKEISPVSNIRSPLASGVNYGGGSNRMPANSYFNNFAPGPGFYNSLGPVGRRFSPVIGSGRNAVSAFGLGLNHDLSLNLNPSCDGTSSTFGYNRIPSNPYFNGASPNRYTSPIGHNRTESPYNSNNRDLWGNRTDTAGPGWNLNVSNGNNRGNWGLPSSSAVSNDNNGFGRNYGTSSGLSSSPFNGFEGSIGELYRGGSVYSDSTWQQQQLPSQSSHELDNLSRAYGYDIDNVGSDPSANDPETYNGSYNVGNRQTNRVAEFEQVLMTKKPTLLITVPKIMVCFLFC

SEQ ID NO: 18818 - protein, 108 aa, Triticum aestivum
  misc_feature (10)..(10): Xaa can be any naturally occurring amino acid
  misc_feature (18)..(18): Xaa can be any naturally occurring amino acid
  misc_feature (25)..(25): Xaa can be any naturally occurring amino acid
  misc_feature (28)..(28): Xaa can be any naturally occurring amino acid
  misc_feature (39)..(40): Xaa can be any naturally occurring amino acid
  misc_feature (47)..(47): Xaa can be any naturally occurring amino acid
  misc_feature (52)..(52): Xaa can be any naturally occurring amino acid
  misc_feature (56)..(56): Xaa can be any naturally occurring amino acid
  misc_feature (70)..(70): Xaa can be any naturally occurring amino acid
  misc_feature (73)..(73): Xaa can be any naturally occurring amino acid
  misc_feature (77)..(77): Xaa can be any naturally occurring amino acid
  misc_feature (82)..(83): Xaa can be any naturally occurring amino acid
  misc_feature (86)..(86): Xaa can be any naturally occurring amino acid
  misc_feature (95)..(95): Xaa can be any naturally occurring amino acid
DATAPVAGAXAVVAGAGXQAGISAXIPXWFSEISPMLPXXAHSLKVXNVLFXGKSXDYQNVMVFNPSTYXKVXSSHXLFQVXXKDXFAVTKEMIXHLPLLLPLKTPRW

SEQ ID NO: 18819 - protein, 404 aa, Unknown
  Azoarcus sp. BH72
MIAGKSVLAFVMAGGEGSRLHPLTAERSKPSVPFNGRHRIVDFVLSNLVNSEIYSIYLLVQYKSQSLIEHIRRSWVLTPLIPHHFITVVPPQMQCGPEWFQGTADSVYQNLHLIDLIKPDLVVVFGADHVYRMDIRQMVQYHVDTHADATVAAIPIPLEQVSSFGIIRTDSAGRIRDFQEKPQSAEPMPNRPGVALASMGNYVFSTDVLVDALTRAHSKGGHDFGKNLLPAMCESHRLMAYDFSSNRVPGIRDFEDASYWRDVGTIDAYYAAHFDTLGECPAFCMSNPRWPIYAAPDQTEAAQVHDGHIRSASLGAGVLVRRATIERSLIRREVVVEEGAEVADSIVMDRTVIGAGAKIRRAIIDQNNFIPPGMRIGYDREADRARFHVTDSGIVVVAKGQLKP

SEQ ID NO: 18820 - protein, 372 aa, Arabidopsis thaliana
MAATTSSGDEPPETKSPAQLIPLLSEDVALSCLARVPRCHYPILSLVSKTFRSLPTSPLLYATRALVGATENILYVAIRIPPESGACWFTLLHRTLSNSTNSKMLVPIPSCPSPSLVGSAYVVVDSEIYVIGGSIRDVPSSSVWVLDCRFHTWRRVSNMRVGREFAAAGVIDGKIYVIGGCVVDNWARSINWAEMFDIKTQTWEPVASPGMEVREKWMHASAVMEGKVYAMADRNGVVYEPKEKKWEMPEKRLDLGWRGRACVIENILYCYDYLGKIRGYDPKERIWRELKGVESLPKFLCGATMANRGGKLTVLWEGKAGSGGSRRMEIWCAEIDVGRRGEREIWGKIEWSGTVLTVPNESAIVNCLAATV

SEQ ID NO: 18821 - protein, 91 aa, Medicago truncatula
MGISMAAETQFHVLAVDDSIIDRMLIERLLKTSSFHVTTMDSASKALKFLGLVEDVASEVHGDVDVNLIIADYCMPGMTGYDLLRKIKVRI

SEQ ID NO: 18822 - protein, 77 aa, Bacillus subtilis
IIGGSERIHDMELLESRLKEHGLDSDAYKWYAELRKYGSVPHSGFGLGLERTVAWISGAPHVRETIPFPRLLNRLYP

SEQ ID NO: 18823 - protein, 218 aa, Salinibacter ruber
MPSTLLCASSGQQGFPACIGKPLSFSQVPTRPVSTLNHATLGGGCFWCLEAVYEEVDGVTEIVSGYAGGHVQAPSYRQVCSGTTGHAEVVQLTYDPSVIAYRDLLEIFFTIHNPTTKDQEGADVGPQYRSIILHHDDEQREIAEGLIERLEANGVFGDPIVTEVEPLDTFYEAEDKHQDYYERNPAQPYCQSVISPKVAKLRKKHADKLQGQSPRPTS

SEQ ID NO: 18824 - protein, 112 aa, Wolinella succinogenes
MKKIEAIIKPFKLDDVKNALTELGVTGMTVTEVKGYGRQQGHTELYRGAEYVVDFIPKIKIEIVVGDGEADKIVDTIVATAKTGKIGDGKIFVTDVSKVVRVRTGETDEEAI

SEQ ID NO: 18825 - protein, 153 aa, Cyanidium caldarium
MQIFVKTLTGKTITLEVEPSDTIENVKSKIQDKEGIPPDQQRLIFAGKQLEDGRTLSDYNIQKESTLHLVLRLRGGMQIFVKTLTGKTITLEVEPSDTIENVKSKIQDKEGIPPDQQRLIFAGKQLEDGRTLSDYNIQKESTLHLVLRLRGGC

SEQ ID NO: 18826 - protein, 219 aa, Glycine tabacina
NGNNLPTKQAVVDLYKSNRIDKIRLYYPDEGALQSLRGSNIEVILTVPNDQLQSLTNAGAANDWVNKYVKGYSQNVKFKYIAVGNEVHPGDAAAGSVLPALKNIQNAISSANLQGQIKVSTAIDTTLLGNSYPPKDGVFSNSASSYIGPIVSFLARNGAPLLANVYPYFAYVGNQQNIGLDYALFTKQGKNEVGYQNLFDALLDSLYAALEKVGAPNVK

SEQ ID NO: 18827 - protein, 219 aa, Glycine tabacina
NGNNLPTKQAVVDLYKSNRIDKIRLYYPDEGALQALRGSNIEVILTVPNDQLQSLTNAGAANDWVNKYVKGYSQNVKFKYIAVGNEVHPGDAAAGSVLPALKNIQNAISSANLQGQIKVSTAIDTTLLGNSYPPKDGVFSNSASSYIGPIVSFLARNGAPLLANVYPYFAYVGNQQTIGLDYALFTKQGKNEVGYQNLFDALLDSLYAALEKVGAPNVK

SEQ ID NO: 18828 - protein, 80 aa, Arabidopsis thaliana
  misc_feature (18)..(18): Xaa can be any naturally occurring amino acid
  misc_feature (23)..(23): Xaa can be any naturally occurring amino acid
  misc_feature (54)..(54): Xaa can be any naturally occurring amino acid
IIKTCGTTYFLLSIPPLXIVSVXLCLNIKFLKYTLGSLLYPGGQPFPHRSFSEXVSDLDGHYTNLFLNIVSYFIVFDILY

SEQ ID NO: 18829 - protein, 252 aa, Brassica napus
  misc_feature (206)..(207): Xaa can be any naturally occurring amino acid
  misc_feature (223)..(223): Xaa can be any naturally occurring amino acid
  misc_feature (230)..(230): Xaa can be any naturally occurring amino acid
  misc_feature (233)..(233): Xaa can be any naturally occurring amino acid
  misc_feature (242)..(242): Xaa can be any naturally occurring amino acid
TQPPHPLGFSPKKIKTPFQMEGRRITASPRPCSGRRVVAKKRTRPDGFVNSVKKLQRREISSRKDRAFSISTAQERFRNMRLVEQYDTHDPKGHSLVALPFLMKRTKVIEIVAARDIVFALAHSGVCAAFSRETNRRICFLNVSPDEVIRSLFYNKNNDSLITVSVYASDNFSSLKCRSTRIEYILRGQPDAGFALFESESLKWPXXVEFDDVNGKVLTYSAXDSVYRVXDLXNYTMLYSIXRQHVQEIKIS

SEQ ID NO: 18830 - protein, 219 aa, Glycine tabacina
NGNNLPTKQAVVDLYKSNRIGKIRLYHPDEAILQALRGSNIEVILGVPNDQLQSLTNAGAATNWVNKYVKTYSQNVKFKYIAVGNEIHPGDSLAGSVLPALENIQNAISSANLQGQIKVSTAIDTTLLGNSYPPKDGVFSNSASSYIGPIVSFLARNGAPLLANVYPYFAYVGNQQTIGLDYALFTKQGKNEVGYQNLFDALLDSLYAALEKVGAPNVK

SEQ ID NO: 18831 - protein, 219 aa, Glycine canescens
NGNNLPTKQAVVDLYKSNRIDKIRLYYPDEGALQALRGSNIEVILTVPNDQLQSLTKAGAATNWVNKYVKAYSQNVKFKYIAVGNEIHPGDSLAGSVLPALENIQNAISAANLQGQIKVSTAIDTTLLGNSYPPKDGVFSGGASSYIRPIVNFLARNGAPLLANVYPYFAYVNNQQSIGLDYALFTKKGNNEVGYQNLFDALLDSLYAALEKVGAPNVK

SEQ ID NO: 18832 - protein, 429 aa, Burkholderia pseudomallei
MTRRLMSNANPFFSQSLAERDASVRGAILKELERQQSQVELIASENIVSRAVLDAQGSVLTNKYAEGYPGKRYYGGCEFADEVEALAIERVKRLFNAGHANVQPHSGAQANGAVMLALAKPGDTVLGMSLDAGGHLTHGAKPALSGKWFNALQYGVSRDTMLIDYDQVEALAQQHKPSLIIAGFSAYPRKLDFARFRAIADSVGAKLMVDMAHIAGVIAAGRHANPVEHAHVVTSTTHKTLRGPRGGFVLTNDEEIAKKINSAVFPGLQGGPLMHVIAGKAVAFGEALTDDFKTYIDRVLANAQALGDVLKAGGVDLVTGGTDNHLLLVDLRPKGLKGAQVEQALERAGITCNKNGIPFDPEKPTITSGIRLGTPAGTTRGFGAAEFREVGRLILEVFEALRTNPEGDHATEQRVRREIFALCERFPIY

SEQ ID NO: 18833 - protein, 162 aa, Triticum aestivum
  misc_feature (18)..(18): Xaa can be any naturally occurring amino acid
SSPSIASLRERASESHGXGDHQEGGSDSQQQLQERRKRQRRHTPEQVQKLEESYKKYDHPNEIQCAQLGRELGLETKQVRSWFQNHRTQIRIEHERLENRFLRWENMSLRSEIMAVREALKNSATCPNCAPKDCIDQQELNRENARLKVGLLHCTTSFQDEP

SEQ ID NO: 18834 - protein, 135 aa, Ralstonia metallidurans
MRLLHTMLRVGDYQRSIDFYTRVLGMTLLRESDNPEYKYRLAFVGYGPETETAVIELTYNYGVDKYDLGTAYGHIALEVPSAAEACERIRSAGGKVTREAGPVKGGTTVIAFVEDPDGYKIELIERHSTRDAARP

SEQ ID NO: 18835 - protein, 469 aa, Bacillus subtilis
MSKQQIGVIGLAVMGKNLALNIESRGFSVSVYNRSSSKTEEFLQEAKGKNVVGTYSIEEFVQSLETPRKILLMVKAGTATDATIQSLLPHLEKDDILIDGGNTYYKDTQRRNKELAESGIHFIGTGVSGGEEGALKGPSIMPGGQKEAHELVKPILEAISAKVDGEPCTTYIGPDGAGHYVKMVHNGIEYGDMQLISESYFILKQVLGLSADELHEVFAEWNKGELDSYLIEITADIFTKKDEETGKPLVDVILDKAGQKGTGKWTSQSALDLGVPLPIITESVFARFISAMKEERVKASGLLSGPEVKPVTENKEELIEAVRKALFMSKICSYAQGFAQMKAASEEYNWDLKYGEIAMIFRGGCIIRAAFLQKIKEAYDREPELDNLLLDSYFKNIVESYQGALRQVISLAVAQGVPVPSFSSALAYYDSYRTAVLPANLIQAQRDYFGAHTYERTDKEGIFHTEWMK

SEQ ID NO: 18836 - protein, 93 aa, Unknown
  Synechococcus sp. WH 8102
MASYKISIEGGSTFECADDVYILDAAEEAGVDLPYSCRAGACSTCAGKVLSGSVDQTDQSFLDDDQIGQGFALLCVSYPTSDCSIKANAEDDL

SEQ ID NO: 18837 - protein, 307 aa, Unknown
  Flavobacterium sp. K3-15/DSM ID92-509
MKFQNALETIGNTPVVKINNLFNSDHEIWIKLEKSNPGGSIKDRIALAMIEDAEAKGLLNKDSTIIEPTSGNTGIGLALVAAVKGYKLILVMPESMSIERRKIMEAYGAEFVLTPREKGMKGAIEKANELAEETPNSWIPRQFDNPANVKIHVETTAQEILQDFPEGLDYVITGVGTGGHITGIAKALKEKYPNLKVIAVEPELSPVLSGGSPAPHPLQGLGAGFVPSILDITLLDGVITVGKDEAYEYAINAAKKEGLFCGSFHRSRLSRYRKTFTGNTAWSKNSLPLITTPEKGIFLLRDSSKIL

SEQ ID NO: 18838 - protein, 181 aa, Unknown
  Erythrobacter sp. NAP1
MEQAIIAGGCFWCTEAVFRDVVGVSEVESGYIGGTVDNPTYKQVCTGNTGHAEGIRVTFDPDVTSLAEIYDMFLGTHDPTQLNRQGGDIGTQYRSAIFPLSASQGEEAKAAIGRWNAENGKMAVTTIEGLEGDTQTAAWYPAEDYHQEYWEGEGQRNPYCLAVIPPKLMKLRKSFQNKVKA

SEQ ID NO: 18839 - protein, 247 aa, Pseudomonas fluorescens
MSAKVWLVGAGPGDPELLTLKAVRALHAADVVLIDDLVNPRVLEHCPDARVITVGKRGGCRSTPQDFIHRLMLAMRAKANAWCDLRAATPCIFGRGGEEALWLRERGVEVELVNGITAGLAGATNCDIPLTLRGVSRGVTLVTAHTQDDSSLNWRALAEGGTTLVVYMGVAKLEEIRQQLLEGAMAADTPVAMIENASLPQQRECRSTLAHMHTDAQVFALKSPAILVIGSVAGAGQAASITVSASA

SEQ ID NO: 18840 - protein, 669 aa, Oryza sativa
  misc_feature (496)..(496): Xaa can be any naturally occurring amino acid
RPAPHQYTTGRPVSASALQPSDTFPRRHNSATPAEQAAMASECGFNTLDALIDATVPAAIRAPTMHFSGKFDAGFTESQMIDHMQRLAAMNKAYKSFIGMGYYNTHVPAVILRNLMENPAWYTQYTPYQAEIAQGRLESLLNYQTMVADLTGLPMSNASLLDEATAAAEAMAMCNGILKSKKKTFLIASNCHPQTIDVCQTRAAGFDLNVIVADAKDFDYSSGDVCGVLVQYPGTEGEVLDYAEFVKDAHAHGVKVVMATDLLALTSLRPPGEIGADIAVGSAQRFGVPMGYGGPHAAFLATSQEYKRLMPGRIIGVSVDSSGKPALRMAMQTREQHIRRDKATSNICTAQALLANMAAMYAVYHGPEGLKAIADRVHGLAGTFAHGLKKLGTVTVQELPFFDTVKVKVADANAIAQEACKNEMNLRVVDATTITVAFDETTTLEDVDKLFKVFNGGKPVNFTAESLVSEVSSSIPSSLVRKSPYLTHPIFNMYHXTEHELLRYLHKLQSKDLSLCHSMIPLGSCTMKLNATVEMMPVTYPSFANMHPFAPTEQAAGYHEMFDDLGDLLCKITGFDSFSLQPNAGASGEYAGLMVIRAYHRARGDYHRDVCIIPVSAHGTNPAGAAMCGMKIVAVGTDSKGNINIEELRKAAEANKDNLAALMVTYPST

SEQ ID NO: 18841 - protein, 325 aa, Citrullus lanatus
MADAKSTIAKDVTELIGNTPLVYLNRVVDGCVARVAAKLEMMEPCSSVKDRIGYSMISDAENKGLITPGESVLIEPTSGNTGIGLAFIAAAKGYRLIICMPASMSLERRTILRAFGAELVLTDPARGMKGAVQKAEEIKAKTPNSYILQQFENPANPKIHYETTGPEIWRGSGGKIDALVSGIGTGGTVTGAGKYLKEQNPNIKLYGVEPVESAILSGGKPGPHKIQGIGAGFIPGVLDVNLLDEVIQVSSEESIETAKLLALKEGLLVGISSGAAAAAAIRIAKRPENAGKLIVAVFPSFGERYLSTVLFESVKRETENMVFEP

SEQ ID NO: 18842 - protein, 595 aa, Kluyveromyces lactis
MRVGNSNSIKKNVSECLSPNPVYYRNPITFKKANEFNNGKRERPLALLGDSIHADSKNSRQQLDDTVDNRLVIHWFRGDLRVRDNTGLAYALNQSKSGSVEALYVINEHDWIAHMESGWKLKFQLDALRSLSRELAKLGVRLHVKYFIPESPCLSNSREYAQWFSHIIEEIAASKNYDGNSKDDTKDDTDADEPALKKRKKDNDENQKGGSPNILVTANLQYEVDELYRDLKICRLQTQSSNSANFTLKLFHDMCIIEPGILKTGKGSQYTIFTPWYKKWVSFLEANQKDKHTICIEASIPQSSNREKVNPEEIKYQLPDKFMSEMPEQTLNIPKADEETALKKLTEFISKRASKYNNDKDLLDLTGTSLLSCYVTSGVISARTILNQSYQANNSRLMNKDIKKNNSLETFIKEVAWRDFYKHAISYWPFLSMDLPFKFETLNIKWENDVFLFEKWCYGETGIPIVDAIMLKMLKTGYINNRSRMITASFLAKNLLIDWRWGERWFRKHLIDYDTASNVGGWGFCASTGIDCQPYFRVFNMKLQSEKYDPEGKFIRHWLENDENDSDNVHEPKPNAIVDLRDSRERVLERFREVM

SEQ ID NO: 18843 - protein, 291 aa, Unknown
  Erythrobacter sp. NAP1
MSTLTVAALQLELQREDEADNIAAVAALVEEAAQRGAKLILPPELFSGPYFCREEDEALFALAKPTAEHPSVIAMRELAARLKVAIPTSFFERDGHHYYNTLAMIGPDGEVLGTYRKSHIPDGPGYEEKYYFRPGNDGFKVWDVRGDQGQSVRIGVGICWDQWYPECARVMALKGAEMLLYPTAIGSEPYDADLDTSRMWRRAMIGHAVSNCMPVIASNRIGAEGPAGEQSFYGHSFISDEWGDLVEEFGAAESGVLVTTLDLARAATHRAGMGFFRDRRPQLYGRIAEDI

SEQ ID NO: 18844 - protein, 698 aa, Leuconostoc mesenteroides
MAILELIVILIVAVTISNIVSHFIPEIPISLFQIAIGLFLALVCGIYVEVDSEWFMLLFIAPLLFNDAWRFPKHELWELRGPILGNSIILVILTTLVGGFLMHLLMPQLPKSVALALAAVISPTDPVAVQAIARRVKLPENVMHIVSGESLINDASGLVSFNTAIKATIAGTFLIGEAIGNFFWMTIVGLAVGLILGSFVSWLRDSFDRVGLNDVVFHTVVTLLMPFVIYWVAEDIFHSSGVIAVVAGGVLSKILSDQHMNARSPEINVVTVRTWEVFVYLLNGTIFILLGIELPAAMKDIVRSTQVHTGMAIFYGVAVWFIIFTIRTFWAYGTQITYHLKHKERAISFRMAIISGLTGVRGAVTMAAVLTVPSTIADGSAFPQRNLLVFVAAVVVIISLLVATIMLPIVTKQRTTHDFTQPEVGEVETSSTHESKVDLTEAQARIFSIRIGIQVLREQQNDHNRIIVYELIGRKQQIIDQIYRQLNKSNDHKVNIEDDRELRRVALEAQRNCLRQLLADEKISILTYSSQNRRLDRLENMIDSDKHYHLSTQWIIILWRRTLRSIRIWISDESTDQFREESSMATKEMAKEAIQSLSEYMEKYTGDTVSHRMERQAAYNLIIFYRNQIEKERHPDTPEQRELDDRYRMELEIKALNVERETIQQLYEQGRISRQAGVNIRQFINYAETAALAGRDEE

SEQ ID NO: 18845 - protein, 307 aa, Helianthus annuus
MANFPVINMENLNGSERGVTMEKINDACENWGFFELVNHGIPHDLLDKVEKMTKDHYKKCMEQRFKEMVAAKALEGVKAEVTDMDWESTFFLRHRPTSNISEIPDLVDEYRELMKDFAGKLEKLAEELLDLLCENLGLEKGYLKKAFYGSKGPNFGTKVSNYPPCPTPDLIKGLRAHTDAGGIILLFQDDKVSGLQLLKDGEWIDVPPMRHSIVINLGDQIEVITNGKYKSVMHRVIAQTDGTRMSIASFYNPGNDAVIYPAPTLLEKEPTEKEQSYPKFVFDDYMKLYAGLKFQAKEPRFEAHESS

SEQ ID NO: 18846 - protein, 232 aa, Oryza sativa
MAGGGDELKLLGMWASPFALRAKLALSFKGLSYDYVEEDFKNKSELLLSSNPVHKKVPVLIHNGKPICESQVIVQYIDEVFPDAGVTLLPADPHDRAVARFWASYIDEKLFGAWIPVFRGKTEEEKAEGVKQTFAVAEKLEGALSECCKGKPFFGGDTVGYVDVVLGGFVAWVHAIEEVFGLNQFDAAKTPLLAAWLERFDELDAAKEAMPDIGRLVELEKMRQAQAQAAVY

SEQ ID NO: 18847 - protein, 139 aa, Cucumis sativus
IGFNWGAAGVSTSVWRGVPLREVLKRCGIMSRKKGALNVCFEGAEDLPGGGGSKYGTSIKKELAMDPARDIILAYMQNGEQLAPDHGFPVRMIIPGFIGGRMVKWLKRIIVTTKESENYYHFKDNRVLPSHVDAELANA

SEQ ID NO: 18848 - protein, 218 aa, Oryza sativa
MSSTNSSGDPAAVRVVGGWASPFMNRVVVALKLKGVEHEMLQETVGKKSELLLRSNPVHKKIPVLLHHGKPIAESLIIYIDEVWPASNGAPSILPRDPYGRAVERFWAKYIDDKIPPGIRVLRGSVEEDKDKAAGEMSTALQHLEEAFVKCSQGKQYFGGDNIGYLDIALGSFLGWIRAVEKIAGVELLNETKVPNLAAWADRFCAHPAVVDVVPDAD

SEQ ID NO: 18849 - protein, 539 aa, Streptococcus pyogenes
MKFIEFNLSQDIQSAVVTAGFEKASPIQEMTIPLALEGKDVIGQAQTGTGKTAAFGLPTLNKIRTNENIIQALVIAPTRELAVQSQEELFRFGREKGVKVRSVYGGSSIEKQIKALKSGAHIVVGTPGRLLDLIKRKALILDHVETLILDEADEMLNMGFLEDIEAIISRVPADRQTLLFSATMPAPIKQIGVKFMKDPEHVQIKNKELTNVNVDQYYVRVKEQEKFDTMTRLMDVNQPELSIVFGRTKRRVDEITRGLKLRGFRAEGIHGDLDQNKRLRVIRDFKNDQIDILVATDVAARGLDISGVTHVYNYDITQDPESYVHRIGRTGRAGKSGESITFVSPNEMGYLSMIENLTKKQMKPLRPATAEEAFQAKKKVALKKIERDFADETIRSNFDKFKGDAVQLAAEFTPEELALYILSLTVQDPDSLPEVEIAREKPLPFKYVGGGHGNKNGKGGRGRDNRNRGDRRGGYRGDRNRDERDGDRRRQKRGKRDGHDGSGNRDFKRKSKRNSKDFFNKEKKSSAKNTGFVIRHKGE

SEQ ID NO: 18850 - protein, 470 aa, Dechloromonas aromatica
MKKEKALVWFRRDLRDHDHAALSAALAEAQQVYCAFVFDSEILDPLPTRHDRRVHFIRESLVELDAALRARGGGLIIRHGQAVDEIPALARRLGVSAVFTNRDYEPSAKRRDAQVARQLRNDDIAFHGVKDQAIFDGDEVLTQAGKAFSVFTPYKNAWLKRLTTADYAAWPCDGRLAGQELAGIPTLEEIGFTPTDLAELGIQPGMSGAKGLWDDFSRDRIERYGSLRDFPAVKGVSYLSVHLRFGTISIRQLVRQALAHQADTWLSELIWRDFYFMILDHFPHVAGHAFKPEYDAIQWASRPEAFAAWCEGCTGYPLVDAAMRQLNFSGWMHNRLRMVVASFLTKDLGIDWRLGEKYFAEQLNDFDLSANNGGWQWASSSGCDAQPYFRIFNPVTQSEKFDAEGKFIRRYVPELAKVHDKYIHAPWKMGRIEQEALGVVIGRDYPSPIVDHATARDETLARYAVVKKQA

SEQ ID NO: 18851 - protein, 539 aa, Dunaliella salina
MATSAKESLEVPLNAATAGFGAGMPGYDREKWGFDLDGENKAKALLMWKLQSPHVRAFHLSWMFFFSSFVAAFAMAALVPVVRQNLDLTKADLGASGITTVVGAIGARVVIGAVCDTVGPRMATSGVLLLIAPCVFCASLIVDRGGIIAVRFFIGVGLCIFVCNQFWAGTMFSPNCVGTVNATCGGWGNLGGGVTQLIMPLIYTGIKQSGVPGFTAWRWSFMVPGAMFLVLAFGCLCFSQDAPNGSYRDIRKARTVQVDGKKTFLAGIRNYRTWVLTLNYGYCFGVELTINNIIVAYMFDQFGLSIEIAGIVGAVFGLMNIFCRSMGGIASDVAGKYFGMRGRLWTYFCLQLLVGVFSIVLGTVDETLGGTIAVMIIFSAFVQSAEGACYGVVPFVSRRSYGVVAGLVGAGGNTGSAVTQALFFADNEGLKMTTQEGLQWMGVMVMAVTCTISVLHWPAWGGMFTPAKAGATEEDYYLAEWDAEEVAANLHIPSLRFAMESRSMRGKKLLETYLAKEEGLECSSQDAKKTIASIREDSN

SEQ ID NO: 18852 - protein, 274 aa, Pinus thunbergii
MASCGSGRCAFAGGQISSLKPHTNQLLGVGAGVHGEARVTMRKATTKKVSASASTSPWYGPDRVLYLGPFSGEPPSYLTGEFPGDYGWDTAGLSADPETFAKNRELEVIHCRWAMLGALGCVFPELLARNGVKFGEAVWFKAGAQIFSEGGLDYLGNPSLVHAQSILAIWACQVILMGAVEGYRIAGGPLGEVTDPIYPGGSFDPLGLADDPDAFAELKVKEIKNGRLAMFSMFGFFVQAIVTGKGPIENLTDHLADPVNNNAWAYATNFVPGK

SEQ ID NO: 18853 - protein, 831 aa, Rhodobacter sphaeroides
MTLTRRDLIKAQAAATAAAAAGLPVSALAQPVTGGAEALRIRWSKAPCRFCGTGCGVMVGTRDGQVVATHGDTQAEVNRGLNCVKGYFLSKIMYGEDRLTTPLLRMKDGVYHKEGEFAPVSWDEAFDVMAAQAKRVLKDKGPKAMGMFGSGQWTIWEGYAASKLMRAGFLSNNLDPNARHCMASAATAFMRTFGMDEPMGCYDDFEAADAFVLWGSNMAEMHPILWSRLTDRRLSHEHVRVAVLSTFTHRSMDLADTPIIFRPGTDLAILNYIAHHIISTGRVNRDFVDRHTNFALGATDIGYGLRPEHQLQLIAKGAADAGAMTPTDFETFAALVSEYTLERAAEISGVEPALLEELAELYADPDRKVMSLWTMGFNQHVRGVWANHMVYNLHLLTGKISEPGNSPFSLTGQPSACGTAREVGTFAHRLPADMVVTNPEHRAHAEEIWKLPAGLLPDWVGAHAVEQDRKLHDGEINFYWVQVNNNMQAAPNIDQETYPGYRNPENFIVVSDAYPTVTGRCADLVLPAAMWVEKEGAYGNAERRTHFWHQLVEAPGEARSDLWQLMEFSKRFTTDEVWPEEILAAAPAYRGKTLFEVLFANGSVDRFPVSDVDPDHANHEAALFGFYPQKGLFEEYAAFGRGHGHDLAPFDTYHEVRGLRWPVVEGEETRWRYREGYDPYVKPGEGLRFYGKPDGRAVILGVPYEPPAESPDEEFGFWLVTGRVLEHWHSGSMTLRVPELYKAFPGAVCFMHPEDARSRGLNRGSEVRVISRRGEIRTRLETRGRNRMPRGVVFVPWFDASQLINKVTLDANDPISRQTDFKKCAVKIEAV

SEQ ID NO: 18854 - protein, 362 aa, Bordetella parapertussis
MSHNPFHMLKVASVARNTRDAVVVTFDLPPELAGDFRFRPGQYLTLRTRLDGEEVRRSYSICSAPGDGVLRVAIKKVDEGVFSNWANHELQPGQSLEVMPPAGNFTVDFDPDNARHYVAFAVGSGITPVFSLVKSALSAEPRSRFTLFFGNRASSSVLFREEIEDLKNLYMERFSLVYIMSRESQDIELFNGRLDGDKVDQLLTAWMRPGDIDYAFVCGPQTMIESVVEHLQARGMPKSHIKFELFGAPKGPRALRTGRDAPAAPGKGQCEVTVVQDGHSRTFFIDKNKDSVLDSALAQGVELPYSCKGGVCSTCRCKVVEGEVDMDANFALEDYEVARGFVLSCQSYPVSDRLVIDFDQET

SEQ ID NO: 18855 - protein, 944 aa, Yarrowia lipolytica
MSEYLPPPPPLSPFSEWFEFGDTDLQIDKLQLAPDQSTATAPSTAGTTSASAPTQPPPPPPAPFISARESSMNVGPQHLPRDMGRPPQPTHSQSQPSHSQIHTQIPKHAPPPIPTLKKPPPPIRHYSSPSNGSSAANAIPGANHPPPQAQSQHSQAAQAAQQAHAALHAAQSASAPVSAVSPVSNTPLVTSWDKTKVAEWLRSLKCAEYIPMFEQNEICGEVLLEIDQKLLKDMGVVKVGDRVRINVAIKDLRSQHRKTTLQNQQPTPHQRSQHRTGKTLSYLDEQCVSPFASHGLGISSSSGTPVTPDRASSAGSDFSSHLRPQTARAPSSTTSTGDVKGILSMDQVRQGTVKFIYTMGQSKTVNISGCFNAESIIRTALKKFAIKDSPNNWCIHVSDNAFATSTRIVSDNELVTICHSPSRAERRRLMLCLNDMPPTQKQFAKSQSVLLESVDTNTNSSSSSGNYSANQPTISQLSGDYFSSDPQKMAPLPRSNLPHNSRRLQRFGHRPPSELISSNLAEYFPQAGSKVLEQTIRNSIRFSNRMSRMSTSTASNYHYNRMSIATISSFMNNEGGIGSENDSDNIPAVPEIPSDLSMPQTLTRESMQPSRTQSSSQVERGSSLRKSTASIPATLETLSQQEEAASAAASATASLVDPPHSATPSEDDMSDEQIIAMQSEAPKNWIKGTLIGQGSFGCVHLGMNSLTGELMAVKQVSLGDFSKTSHKQAMVDALQREMNLLRDFQHDNIVQYLGSSSDEEYLNIFLEYVPGGSVSSMLTKYGQFEEPLVKHFVRQILKGLDYLHSRNIIHRDIKGANVLVDNKGNVKISDFGISKKIEASSSNRQSLQGSVYWMAPEVVKQTSYTLKADIWSLGCLIVEMLTGSHPFPQFSQMQAIFKIGTSGRPDIPENCSEDTKDMLRQTFEQDYNKRPSAAELLAHEFLNT

SEQ ID NO: 18856 - protein, 180 aa, Rhizobium leguminosarum
MPVVRGKNIEPLFTAEQIAERNHSMAREIANGPTKDLLVIAVLKGSFIFAADLIRALHDSGLAPEVEFITLSSYGIGTVSQGVRIVKDIDSDVHGRDVLLIDDILESGRTLLFAKELLFERGARNVTIAVLLDKRVKRKEKLEADYVGFECPDYFVVGYGMDVAYAFRELPFVGVVTGDA

SEQ ID NO: 18857 - protein, 417 aa, Mesorhizobium loti
MKNGVVIVGAGHAGVQAAASLREDGYDGPVILIGDENELPYHKPPLSKTFIKDAEAKPQPLRGEAFYTGSVIDYRPGVRIERIDAGGHSLEISGGGVLAFDHLILATGSRPRLLPLPGSDLSGVLSLRSLADARLIRDLSARSEDVVILGGGFIGLEIAATLRAAGRTVTVVEAVDRLLGRAVAPVVASHVRQRLEATGVRILTGTSIARLEGENGHVVAAITSSGEKLPARMVIVGIGAVPNVELAQDAGLTIANGIRVDHQMRSSVQDILAIGDAASYRHWFTGGDVRLESVQNATDQARLAARTITGHADAYSAVPWFWSDIGDMKLQMVGLTAGGDSHVVLGDLPDNKFSIYHYAGDRLLGIESVNRPGDHMLGRKMLGAGFSPTPEMVAAGPDGLKAALAAFQQDEPARAAG

SEQ ID NO: 18858 - protein, 917 aa, Pseudomonas chlororaphis
MLKKLGIKGRVLLLTLLPTSLMALVLGGYFTWMQQSDLQTQLLQRGEMIAEQLAPLVAPALAHQNTALLERIATQSLEQQDVRAVSFLAPDRTPLAHAGPSMLNQAPTGNGSQMLQRTGSDATRYLLPVFGRHRNLAGDLIPDESDRLLGWVELELSHNSMLLRGYRSLFASLLLITAGLICTGLLALRMGRTINNPLSQIKQAVTQLKDGNLETRLPLLGSQELDELASGINRMAGTLQNAQEELQHSIDQATEDVRQNLETIEIQNIELDLARKEALEASRIKSEFLANMSHEIRTPLNGILGFTHLLQKSELTPRQLDYLGTIEKSADSLLGIINEILDFSKIEAGKLVLDSIPFNLRDLLQDTLTILAPAAHAKQLELVSLVYRDTPLSLVGDPLRLKQILTNLVSNAIKFTREGTIVARAMLEEEHEDSVQLRISIHDTGIGLSNQDVRALFQAFSQADNSLSRQPGGTGLGLVISKRLIEQMGGEIGVDSTPGEGSEFWISLRLPKTRDDAEDLPAPPLLGRRVAVLENHELARQALQHQLEDCGLEVTPFNTLEALTNGVTGVHQTEQAIDLAVLGITTNDMPPERLNQHIWDLEHLGCKVLVLCPTTEQTLFHLSVPNPHSQLQAKPACTRKLRRALADLVNPKAVRSEPSEPIASRPPRVLCVDDNPANLLLVQTLLEDMGAKVLAVDSGYAAVKAVQNESFDLVMMDVQMPGMDGRQSTEAIRQWESERNCTPLPVIALTGHAMANEKRALLQSGMDDYLTKPISERQLAQVVLKWTGLALRNQGPERTGEPSGNGHELQVLDHDEGLRLAAGKADLAADMLAMLLASLEADREAIRAARAANDHNALIERVHRLHGATRYCGVPQLRAACQRSETLLKQEDIKAFAALDELERAINRLATEARINA

SEQ ID NO: 18859 - protein, 564 aa, Schizosaccharomyces pombe
MDVDSIFKNTEETNKKRNPEEADSLEPASSRRRLAEENSDEENEEFDEEGGRFFGSGLKKSEKTVLDFLDEQEAQEEPASLTPTELKRMVVRLEKTINNNQELRIKYSTSPQRFIESEADLDLEIRSFNVLSEYPILIPIFLKLDCVSTFLELMNHENADITITVLELLIELTDEDVDPDALNSLFTSLIDSGLLPLLSNTIKRFDESNEEDRHGVYCVLSLMENLLSVDNSICSIIVENTTLVEWLLSRSSVDETSISTNLQYAVEILAIILANSKEAKLKVCNLNGIDLLLRRISPYRLRDPTQGSEEEMMENVFDCLCSLVQETKGKSLFLKEEGIELCILNMKHKGKSRYSTIKVLDYLLFGPLSTPYCIRFVEAGGLKYIFAAFMKISAADTLEHILAILASLFRSLPADTVERVRFLRKFIENDFEKMKRLFKIYDRLRIQLKGIDQSRKLDFSPDSEEKSTKWFLQQIDHGLFPFQSTVLILSWLCVENTVTLKKIKMLFSEASIPIDELTDALKNYHENLEEPTVESEEVEANDSYYRIDEKPMVTVLLGSMQASV

SEQ ID NO: 18860 - protein, 52 aa, Moorella thermoacetica
MGKWSCTACGYVYDPAKGDPEGGIAPGTAFEDLPDDWVCPNCGLGKENFEPL

SEQ ID NO: 18861 - protein, 750 aa, Ustilago maydis
MPSLVSSPGTSTMQTDNVHEPSSAFATPPTQSTSSFASGSNTPSHQIRLNGQSSGIGESPAPHSSRPYHSSSHASQSNGAGTGKDKKWKQMFKFGSIGRKASGNASNDRSWHTDSAESSMHKNGDYFEHVQYTGSQPGSTSFQPISGSTVVNDPASFSNDSYSSEDRNASGSIGDAMTTSASSKLQPPADISDTDSSHPRFTSRLMRRVSSAPDTNKLFKNGQNATQKPNEAASSTKNGYLSPDGAGGQHAQFVSEGGAPFTPSKELANAAFFSNSPVRMDSNATSFSYKDFEKGRSVSAKGSSTPKSGRIVFPGTGRSKSSNGKDKKSQLPPPSSSANLAALAGTASVNRGPGSFRRTYSSNSIKVKEVEVGPNSFSKVKMLGKGDVGKVYLVREKKTDKLYAMKVLSKKEMIKRNKIKRVMAEQEILAASNHPFIVTLYHSFQSEDYLYLCMEYCMGGEFFRALQTRPGKCLPEEDAKFYAAEVIAALEYLHLMGFIYRDLKPENILLHQSGHVMLSDFDLSARATQRGGAPAMIRQATPNSAPLVDTRSCIADLRTNSFVGTEEYIAPEVIKGCGHTSAVDWWTLGILIYEMIFATTPFKGSTRNETFSNVLRNEVQFPDSIPISSFGKSLIRKLLIKDELKRMGSQSGASEVKQHKWFSNISWGLLRNSTPPIVPAYSNGVDAVNFRNVRESRSLNLDDQGNDTRAKPAVIKAVAGQKNVGDEEGDAVVSNPFSGFSSVTLKHDDY

SEQ ID NO: 18862 - protein, 60 aa, Colletotrichum sp.
AIRRLARRGGVKRISAVIYEETRGVLKSFLEGVIRDAVTYTEHAKRKTVTSLDVVYALKR

SEQ ID NO: 18863 - protein, 464 aa, Leuconostoc mesenteroides
MAKANRVYKTKAPVAKNQEIEATVIDITYQGMGVVKVDNFPIFVVDAIPGEIVRVSVTKVLKSYAFGRVTRRIQESENRVQNANKIAITTGIAPLANLKYEAQLAFKQHQIEELFKKVNVDVDVAPTIGMENPTGYRNKAQVPVQMINGKLETGFYRRGSHRLVPIEDFYIQDPKVDEAVRITRDILRELGVSAYEEETKKGVIRHIMARRGYYSHELMVVIITNTKKLPNSDLIAEKLSAKLPELKSVIHNINNHDTNVIMGQWNETIWGEDDIHDQLMGKDFVIGPNSFYQVNPQTTSTLYALAAEKANLKPTDVVVDAYSGIGTITLSVADKVKKIYGVDVVEGAIEDAEKNAKNNQITNAEFVLADAPEQMAKWADEGLKPNVVFVDPPRKGLTQELIDAVKAMNPEKFVYISCNPATLARDAVQILAAGFEIEGAVQPLDQFPQTTHVESITVFKKAEN

SEQ ID NO: 18864 - protein, 513 aa, Matthiola incana
MTTLILTILLATFLSLFIFFLLRRNRNRNHRLPPGPNPWPIVGNLPHMGPKPHQTLAAMVTTYGPILHLRLGFVNVVVAASKSVAEQFLKIHDANFASRPPNSGAKHIAYNYQDLVFAPYGQRWRMLRKISSVHLFSAKALEDFKHVRQEEIGRLTREVARADTKPVNLGQLVNMCVVNALGREMIGRRLFGDGADHKAEEFRSMVTEMMALAGVFNVGDFVPALDWLDLQGVAGKMKRLHKRFDAFLSSILKEHEINNGGDQKHTDMLTTLISLKGTDFDGDGASITDTEIKALLLNMFTAGTDTSASTVDWAIAELIRHPHIMKRTQEELDAVVGRNRPINESDLSRLPYLQAVIKENFRLHPPTPLSLPHIAAESCEINGYHIPKGSTLLTNIWAIARDPEQWSDPLAFRPERFLPGGEKFGVDVKGSDFELIPFGAGRRICAGLSLGLRTIQLLTATLVHGFEWELAGGVTPEKLNMEETYGITVQRAVPLIVHPKPRLALNVYGVGSG

SEQ ID NO: 18865 - protein, 328 aa, Leuconostoc mesenteroides
MKRARIIYNPTSGREAIKREMLDILAVYEKAGYETSAFATTPEPLSAAKEARRAAEAGFDLIVAAGGDGTINEVVNGLSPLTKRPMMAVIPAGTTNDYARALKLPRDEPLEAAKVILQNETIKMDIGKIEKDNEIKYFMNIAALGTISEVTYAVPSLMKSLYGYLAYLVKGAELITRVKAVNAKVIFDDGEYSGKTSMIFLALTNSVGGFESIVPDAKLDDGRFTLLIIKEANLAQMLQMVAQMINGGKHIDNPKLIYKKTNKVEILPLDNDQMKVNLDGEYGGDAPMKFTDLQQHIEFVANRSGMSENSVSVAKRKFVEEAEKLDTK

SEQ ID NO: 18866 - protein, 654 aa, Arabidopsis thaliana
MSLLSLLTLLVGNSPSLSLLLISPPALRRISVVNLIMDLNGECKGGDGFIDRSRVRILLCDNDSTSLGEVFTLLSECSYQVTAVKSARQVIDALNAEGPDIDIILAEIDLPMAKGMKMLRYITRDKDLRRIPVIMMSRQDEVPVVVKCLKLGAADYLVKPLRTNELLNLWTHMWRRRRMLGLAEKNMLSYDFDLVGSDQSDPNTNSTNLFSDDTDDRSLRSTNPQRGNLSHQENEWSVATAPVHARDGGLGADGTATSSLAVTAIEPPLDHLAGSHHEPMKRNSNPAQFSSAPKKSRLKIGESSAFFTYVKSTVLRTNGQDPPLVDGNGSLHLHRGLAEKFQVVASEGINNTKQARRATPKSTVLRTNGQDPPLVNGNGSHHLHRGAAEKFQVVASEGINNTKQAHRSRGTEQYHSQGETLQNGASYPHSLERSRTLPTSMESHGRNYQEGNMNIPQVAMNRSKDSSQVDGSGFSAPNAYPYYMHGVMNQVMMQSAAMMPQYGHQIPHCQPNHPNGMTGYPYYHHPMNTSLQHSQMSLQNGQMSMVHHSWSPAGNPPSNEVRVNKLDRREEALLKFRRKRNQRCFDKKIRYVNRKRLAERRPRVKGQFVRKMNGVNVDLNGQPDSADYDDEEEEEEEEEEENRDSSPQDDALGT

SEQ ID NO: 18867 - protein, 113 aa, Haemophilus somnus
MMKKIEAIIKPFKLDDVRESLADIGITGMTVTEVRGFGRQKGHTELYRGAEYMVDFLPKVKMEIIVPDEIVEQCIEAIIETAQTGKIGDGKIFVYDVNRVIRIRTREENEEAL

SEQ ID NO: 18868 - protein, 720 aa, Unknown
  Bradyrhizobium sp. BTAi1
MFTKHSVEIDWGGRPLKLETGKIARQADGAVVATYGETVVLATVVAAKSPREGVDFLPLTVDYQEKAYAAGRIPGGYFKREGRPTEKETLVSRLIDRPIRPLFVDAWRNETQVIVTTLSHDMENDPDILAMVAASAALTLSGVPFKGPIGAARVGFANDEYILNPTLDEMTDTQLDLVVAGTSDAVLMVESEAKELNEDIMLGAVMFGHRHFQPVINAIIELAEKAAKEPRDVAIIDNSAIEKEMLGIAEQDLRKAYAIPVKQERYAAVAAVKEKVMAYFFPEGQEPKYEKLRVADVFKELEAKIVRWNILDTGRRIDGRDVKTVRNIVCEVGVLPRAHGSALFTRGETQALVVTTLGTGEDEQYIDALSGTYKETFLLHYNFPPYSVGETGRLGGTKRREIGHGKLAWRAIHPVLPPHHEFPYTTRVVSEVTESNGSSSMATVCGSSLALMDAGVPLKRPTAGIAMGLILEGSRYAVLSDILGDEDHLGDMDFKVAGTESGITSLQMDIKIEGITEEIMRVALGQAREGRIHILGEMSKALTAARAELGEYAPRIETFKIPTDKIREVIGTGGKVIREIVEKTGAKVNIEDDGTVKVASSDGEAMKAAIKWIKSIASDPEIGQIYDGTVVKVMEFGAFVNFFGTRDGLVHISQLADKRVQKTTDVVKEGDKVKVKLLGFDDRGKTRLSMKAVDQTTGEDLEAKQKAEGGAEAPREAAGE

SEQ ID NO: 18869 - protein, 239 aa, Oryza sativa
MAGGGEELKLLGMWASPFALRAKLALSFKGLSYDYVEEDFKNKSDVLLSSNPVHKKVPVLIHKGKPICESQVIVQYIDEVFPDAGVTLLPADPHDRAVARFWAAYIDEKLFSAWILVFRSKTEEEKAEAVKQTFAVVEKLEGALSECSKGKPFFGGDTVGYVDVVLGGFVAWVHAIEEVFGLNQFDAAKTPLLAAWLERFDELDAVKEVMPDIGRLVELAKMRQAQAAGAAAAAAGEAS

SEQ ID NO: 18870 - protein, 498 aa, Solanum lycopersicum
MKKVTVGVAVVGAAAVCAVAVLIVNHRMRKSSKWGRAMAILREFEEKCKTQDAKLKQVADAMTVEMHAGLASEGGSKLKMLITYVDNLPTGDEAGVFYALDLGGTNFRVLRVQLGGKDGGIIHQEFAEASIPPSLMVGTSDELFDYIAAELAKFVAAEEEKFHQPPGKQRELGFTFSFPVMQTSINSGNIMRWTKGFSIDDAVGQDVVGELTKAMKRKGVDMRVSALVNDTVGTLAGGKYTQKDVAVAVILGTGTNAAYVERVQAIPKWHGPVPKSGEMVINMEWGNFRSSHLPLTEYDHALDNESLNPGEQIFEKMTSGMYLGEILRRVLLRVAEEAGVFGDEVPPKLKEPFVLRTPDMSAMHHDTSSDLKVVGEKLKDILEISNTSLKTRKLVVELCNIVATRGARLAAAGVLGILKKMGRDTPKQGGSERTVIAMDGGLYEHYTEYRMCLENSLKDLLGEELATSIVFVHSNDGSGIGAALLAASHSMYLEDQDA

SEQ ID NO: 18871 - protein, 739 aa, Mycobacterium smegmatis
MPEDRPIEDSPPIGEAQTDAPAGGCPAGFGRIKPPVAGGSNRDWWPNQLNLKILQKNPDVINPLDEDFDYRSAVQNLDVDALRADIVEVMHTSQDWWPADFGHYGPLFIRMAWHAAGTYRVSDGRGGAGAGMQRFAPLNSWPDNASLDKARRLLWPVKKKYGKNLSWADLIVYAGNVALEDMGFRTAGFAFGREDRWEPEEDVYWGPEQEWLDDKRYTGERDLENPLAAVQMGLIYVNPEGPNGNPDPQASAIDIRETFGRMAMNDVETAALIVGGHTFGKTHGNGDASLVGPEPEAAPLEEVGLGWRNPQGTGVGKDAITSGLEVTWTHTPTKWDNSFLEILYGNEWELTKSPAGANQWKPKDNGWANSVPLAHEDGKTHPSMLTSDLALRVDPIYEQITRRWLDHPEELAEEFAKAWFKLLHRDMGPVTRYLGPEVPKDTWLWQDNIPAGNDLSDDEVAKLKELIADSGLTVSQLVSTAWKAASTFRSSDLRGGANGGRIRLQPQLGWEANEPDELAQVVRKYEEIQKASGINVSFADLVVLGGNVGVEKAAKAAGFDVTVPFTPGRGDATQEETDVDSFAYLEPKADGFRNYLGKGSDLPAEFKLIDRANLLGLSAPEMTTLVGGLRVLDVNHGGTKHGVLTDKPGALTTDFFVNLLDMSTAWKPSPADDGTYIGTDRATGSPKWTGTRVDLVFASNSQLRALAEVYAEDDSKEKFVKDFVAAWTKVMDADRFDVA

SEQ ID NO: 18872 - protein, 367 aa, Escherichia coli
MSDSQTLVVKLGTSVLTGGSRRLNRAHIVELVRQCAQLHAAGHRIVIVTSGAIAAGREHLGYPELPATIASKQLLAAVGQSRLIQLWEQLFSIYGIHVGQMLLTRADMEDRERFLNARDTLRALLDNNIVPVINENDAVATAAIKVGDNDNLSALAAILAGADKLLLLTDQKGLYTADPRSNPQAELIKDVYGIDDALRAIAGDSVSGLGTGGMSTKLQAADVACRAGIDTIIAAGSKPGVIGDVMEGISVGTLFHAQATPLENRKRWIFGAPPAGEITVDEGATAAILERGSSLLPKGIKSVTGNFSRGEVIRICNLEGRDIAHGVSRYNSDALRRIAGHHSQEIDAILGYEYGPVAVHRDDMITR

SEQ ID NO: 18873 - protein, 407 aa, Escherichia coli
MLEQMGIAAKQASYKLAQLSSREKNRVLEKIADELEAQSEIILNANAQDVADARANGLSEAMLDRLALTPARLKGIADDVRQVCNLADPVGQVIDGGVLDSGLRLERRRVPLGVIGVIYEARPNVTVDVASLCLKTGNAVILRGGKETCRTNAATVAVIQDALKSCGLPAGAVQAIDNPDRALVSEMLRMDKYIDMLIPRGGAGLHKLCREQSTIPVITGGIGVCHIYVDESVEIAEALKVIVNAKTQRPSTCNTVETLLVNKNIADSFLPALSKQMAESGVTLHADAAALAQLQAGPAKVVAVKAEEYDDEFLSLDLNVKIVSDLDDAIAHIREHGTQHSDAILTRDMRNAQRFVNASTRFTDGGQFGLGAEVAVSTQKLHARGPMGLEALTTYKWIGIGDYTIRA

SEQ ID NO: 18874 - protein, 277 aa, Lotus japonicus
MCEALKSQYQLCEEIGRGRFGTIFRCFHPISTDTFAVKLIDKSLLADSTDRHCLENEPKYMSLLSPHPNILQIFDVFEDDDVLSMVIELCQPLTLLDRIVAANGTSIPEVEAAGLMKQLLEAVAHCHRLGVAHRDVKPDNVLFGGGGDLKLADFGSAEWFGDGRRMSGVVGTPYYVAPEVLMGREYGEKVDVWSCGVILYIMLSGTPPFYGDSAAEIFEAVIRGNLRFPSRIFRNVSPAAKDLLRKMICRDPSNRISAEQALRHPWFLSAGDTVNVT

SEQ ID NO: 18875 - protein, 187 aa, Oryza sativa
  misc_feature (53)..(53): Xaa can be any naturally occurring amino acid
  misc_feature (94)..(94): Xaa can be any naturally occurring amino acid
  misc_feature (112)..(112): Xaa can be any naturally occurring amino acid
MEEEWGVPYPDCVLDNAGAGFVGGAAAGTLAHLFTGLRDFPCGRHLAGAAQAXRDGAPCLATRWAARLAVYSAACHALSSATDRHDDPLVSVAXGAATGAVARLRHGPLAVXRAALVGAATLAAVELMIRDSVEEHDDDKPRRNQRPLPAKTKEDDVILRITPAIDHFPVPDPFIAASRGSLLRFRG

SEQ ID NO: 18876 - protein, 152 aa, Haemophilus somnus
MQTTYRKLAKNKKIALVAHDHCKQDLIQWCQTNRTLLQPHILYATGTTGNLIHQETNLEIKNLLSGPMGGDQQLGGLIAEGKIDLLIFFWDPMNAVPHDPDVKALMRIATVWNIPVAMNIATADFLISSPAFQQETEIRIPDYQGYLKERLK

SEQ ID NO: 18877 - protein, 537 aa, Solanum lycopersicum
MVFDFGTLVASLNRLSTSDHQSVVSINLFVALICACIIIGHLLEENRWMNESITALVIGLCTGVVILLISGGKNSHILVFSEDLFFIYLLPPIIFNAGFQVKKKSFFRNFSTIMLFGAVGTLISFIIISFGATSIFKKWNIGYLEIGDYLAIGAIFSATDSVCTLQVLSQDETPLLYSLVFGEGVVNDATSVVLFNAVQNFDLSHINTSKALELVGNFLYLFASSTILGVVAGLLSAYIIKKLYFGRHSTDREVAIVILMAYLSYMLAELFYLSAILTVFFSGIVMSHYTWHNVTESSRVTTKHAFATLSFIAEIFIFLYVGMDALDIEKWRFVSDSPQLSVQVSPILLGLVLVGRAAFVFPLSFLSNLMKKSPEERISFNQQIIIWWAGLMRGAVSVGLAYNQFTRGGHTQLRANAIMITSTITVVLFSTGVFGLMTKPLIRLLQPSPKHLTRMISSEPTTPKSFIVPLLESTQDSEADLGPNVPRPHSLRMLLSTPSHTVHRYWRKFDNAFMRPVFGGRGFVPFVPGSPTEPSGH

SEQ ID NO: 18878 - protein, 328 aa, Coccidioides immitis
MSTVTETVTLPTHLANKTELVGHPPTVNSKEAGDRALLDEFAGKWDSFKFGPIRESQVSRAMTRRYFKDLDTYAESDIVIVGAGSCGLSTAYVLAKARPDLKIAIIEAAVSPGGGAWLGGQLFSAMVLRKPADKFLDEIGVPYEEEPSNPHVVVIKHASLFTSTLLSKVLAFPNIKLFNATCVEDLITRPEPAGGLRIAGVVTNWTLVAEHHDDHSCMDPNTINTPLVISTTGHDGPFGAFCAKRLVSMNAIEKLGGMRGLDMNSAEEAIVKNTREVTKGLIIGGMELSEIDGWHRMGPIFSAMMLSGVKAAEVALEVFEQRKKECAA

SEQ ID NO: 18879 - protein, 536 aa, Solanum lycopersicum
MASVLASLFPKLGSLGTSDHASVASINLFVALLCACIIIGHLLEENRRVNESITALIIGLGTGVVILLVSGGKSSHLLVFSGDPFFIYLLPPIIFNAGFQVKKKQFFVNFMTIMLFGAIGTLVSCAIISLGAIQTFKKLDIEFLDIGDYLAIGAIFAATDSVCTLQVLHQDETPLLYSLVFGEGVVNDATSVVLFNAIQNVDLTSLNPSIALSFLGNFFYLFLASTLLGAGTGLLSAYIIKKLYFGRHSTDREVALMMLMAYLSYMLAELFYLSGILTVFFCGIVMSHYTWHNVTESSRVTTRHTFATLSFLAETFLFLYVGMDALDIEKWKFVGDRPGLSISASSILMGLILLGRAAFVFPLSYLSNLMKKSSEEKITFRQQVIIWWAGLMRGAVSMALAYNKFTHGGHTRLQDNAIMITSTITIVLFSTMVFGLMTKPLISLLLPPQRQLSTVSSGANTPKSLTAPLLGSREDSEGDLNVPDLPHPPSLRMLLTAPSHKVHRYWRKFDDAFMRPMFGGRGFAPPAPRSPTEHGP

SEQ ID NO: 18880 - protein, 235 aa, Oryza sativa
MAGAGDELKLLGMWTSPFALRVKLALSFKGLSYEYAEEDLSNKSELLLSSNPVHKKVPVLIHNGKPICESQVIVQYIDEAFPGAGVPLLPSDPYERAVARFWAAYIDDKLLKSWLQASMGKTEEEKAEALKETFTAVANLEAAFEECSKGKPFFGGDAVGYLDVTLGALVSWVHAGEALYGMRLFDATRSPLLDAWVDRFAALDAAMAVLPDAGTLAEYAKKRQAERAAAAAANN

SEQ ID NO: 18881 - protein, 389 aa, Beta vulgaris
MAIDCMRNLSSTPKSYQNSKQEQNNPLIFDASFLNHQSHIPQQFIWPDGEKPDFIEPEELAVPLIDLQGFLSDDPEKTLKASKLIGEACLKHGFFLVVNHGVERDLIKDAHNLMDDFFEEPLSLKQKALRKLGEHCGYASSFTGRFSCNLPWKETLSFNYSPQESSSSKTHVQDYFNNKFGDSFNHLGTTYQQYCEAMSTLSLRIMELLGLSLGVGRRHFREFFEGHESVMRLNYYPPCQRPDLTLGTGPHCDPTSLTILHQDQVGGLQVFADGKWRSISPNFNAFVVNIGDTFMALSNGRYKSCLHRAVVNSEKPRKSLAFFLCPNKDKVVKPPRELVDEENNPRVYPDFTWPLLLEFTQKHYRADMNTLKVFSQWVQQQRSTQQVEK

SEQ ID NO: 18882 - protein, 456 aa, Shigella flexneri
MPAPAGLSELAWVLFGIYLAAIVGLVIKPFPEPVVLLIAVAASMVVVGNLSDGAFKTTAVLSGYSSGTTWLVFSAFTLSAAFVTTGLGKLIAYLLIGKIGNTMLGLGYVTVFLDLVLAPATPSNTARAGGIVLPIINSVAVALGSEPEKSPRRVGHYLMMSIYMVTKTTSYMFFTAMAGNILALKMINDILHLQISWGGWALAAGLPGIIMLLVTPLVIYTMYPPEIKKVDNKTIAKAGLAELGPMKIREKMLLGVFVLALLGWIFSKSLGVDESTVAIVVMATMLLLGIVTWEDVVKNKGGWNTLIWYGGIIGLSSLLSKVKFFEWLAEVFKNNLAFDGHGNVAFFVIIFLSIIVRYFFASGSAYIVAMLPVFAMLANVSGAPLMLTALALLFSNSYGGMVTHYGGAAGPVIFGVGYNDIKSWWLVGAVLTILTFLVHITLGVWWWNMLIGWNML

SEQ ID NO: 18883 - protein, 509 aa, Zea mays
GRVGGVGVGGGQQFVDRSKVRILLCDGDASSSREVLRLLCNCSYHVTCAKSPRQVINILNYEGGEIDIILAEVDLPVSKCFKMLKYIARNKDLRHIPIIMMSNRDEVSVVVKCLRLGAAEYLVKPLRTNELLNLWTHVWRRRRMLGLPEKNFFNDNFELVLSEPSDANTNSATLLSDETDDRPKENTNQETGTSNQLEYESNPSVAERDQRDKIGAPGSALDASQASTPGRMFSRPIKTNLKVAESSAFLAYVKSSTPATSSFDSGLQRGDSRLDSLDNHGNCSSATDRSDTGTDVNIWNKEAFEMPVQYPMVCFSSSSMHMERSNEGHNDTSGTPPAYHFPFYYPGMVEHNMALSSVQNFQANINSAQAHTPPAMLHQYNVFSQCHSLPMISSFQFNTSGMSMHSSHLPTQNVWSSASSTPTPDETCNRSERRAAALAKFRQKRKERCFDKKVRYVNRKKLAETRPRVRGQFVRHASNMDIISTGDDISEDEDDDPTSREVDMISSPE

SEQ ID NO: 18884 - protein, 224 aa, Zea mays
MVQCLDGVRQLLAVLLNWLTSPPPPPPRLQDPQVLARETVFSVSEVEALYELFKRISSAVIDDGLINKEFQLALFKTNKKESLFADRVFDLFDTKHSGILGFEEFARALSVFHPNAPLDEKIDFSFRLYDLKQQGYIERQEVKQMVVATLAESGMNLSDEIVESIIDKTFEEADTKHDGRIDKEEWRNLVIRHPSLLKNMTLQYLKDITTTFPSFVFHSQVDDN

SEQ ID NO: 18885 - protein, 83 aa, Capsicum annuum
MAILRMIKKSSTTRDVPKGHFAVYVGETQKRRFVVPISFLSEPLFQDLLSQAEEEFGFDHPMGGVTIPCSEDLFTDLTFRLRK

SEQ ID NO: 18886 - protein, 237 aa, Raphanus sativus
ETVGGKLIGLVTSREEIPDLLKLDDVIDLVIPRGSNQLVSQIKNTTKIPVLGHADGICHVYVDKACNVDMAKRIVSDAKLDYPAACNAMETLLVHKDLEQNAVLNELIFALQSNGVTLYGGPKASKILNLPEARSFNHEYCSKACTVEVVEDVYGAIDHIHRHGSAHTDCIVTEDPEVAELFLRQVDSAAVFHNASTRFSDGFRFGLGAEVGISTGRIHARGPVGVEGLLTTRWIMR

SEQ ID NO: 18887 - protein, 85 aa, Capsicum annuum
MAIRVPRIIKKSSTSLDVPKGHFAVYVGEKQKNRFVIPISYLSQPSFQDLLSRAEEEFGFDHPMGGVTIPCSEDIFIGITSKFRI

SEQ ID NO: 18888 - protein, 547 aa, Bacteroides fragilis
MTKSALQIARAAYQPKLPKALKGSVKAVEGAATQSVADQEAIQKLFPNTYGMPLIKFEEGEAIQLPAMNVGVILSGGQAPGGHNVISGLFDGIKTLNKDNKLYGFILGPGGLVDHNYMELTADIIDEYRNTGGFDIIGSGRTKLETPEQFEKGLEIINKLGIKALVIIGGDDSNTNACVLAEYYAAKNAGVQVIGCPKTIDGDLKNEMIETSFGFDTACKVYSEVIGNIQRDCNSARKYWHFIKLMGRSASHIALECALQVQPNVCIISEEVEAKDMSLDDVVTYIAKIVADRAAQGNNFGTVLIPEGLVEFIPAMKRLIAELNDFLAANAVEFANIKRSRQREYIISKLSKENAEIYASLPEGVARQLSLDRDPHGNVQVSLIETEKLLSEMVGTKLAQWKEEGKYVGKFAAQHHFFGYEGRCAAPSNYDADYCYSLGYTASMLIANGKTGYMSSVRNTTAPAAEWIAGGVPITMMMNMERRHGEMKPVIQKALVKLDGKPFLTFAAKRDQWALNTDYVYPGPIQYFGPTEVCDQPTKTLQLEQAK

SEQ ID NO: 18889 - protein, 415 aa, Bacillus cereus
MNEVLAKGKRAKEVARELVLKSTHQKNEALAAVANQLIHETAYILEENKRDIEEGKAKGFSDSLLDRLMLTENRIIDMTEGIKQLIELRDPVGECVREWERPNGLSIQEMRVPLGVVGMIYEARPNVTVDAATICLKTGNTVILRGSSSAIHSNKAIVAVIHRALKQTSLPEESVQLIEDTTRDSAKQLFTMNDYLDVLIPRGGKQLIDTVVREASVPVLETGAGNCHIFIDETADKQMAIDIIINAKTQRPSVCNAIETIVLHEKWAQQHGSELFSSLKERGVELRGDQRALALDSSIVLASEEDWGTEFLSLTLAVKVVSSIEEAIHHINTYGSMHSEAIISENEENVSKFFVSVDAAALYHNASTRFTDGSEFGFGAEIGISTQKLHVRGPMGLPALTSTKYVIRGNGQIRK

SEQ ID NO: 18890 - protein, 137 aa, Glycine max
  misc_feature (118)..(118): Xaa can be any naturally occurring amino acid
MADSKPGLRKPVFTKVDQLRPGTSGHTLTVKVVDAKMVMQKGRSDGPQSRQMRIAECLVGDETGMIIFTARNDQVDMMKEGATVTLRNAKIDMFKGSMRLAADKWGRVEVTEPASFTXKEDNNLSLIEYELVNVVVE

SEQ ID NO: 18891 - protein, 652 aa, Oryza sativa
MASGNSSSSSGSMAATAGGVGGWLGFSLSPHMATYCAGGVDDVGHHHHHHVHQHQQQHGGGLFYNPAAVASSFYYGGGHDAVVTSAAGGGSYYGAGFSSMPLKSDGSLCIMEALRGGDQEQQGVVVSASPKLEDFLGAGPAMALSLDNSAFYYGGHGHHQGHAQDGGAVGGDPHHGGGGFLQCAVIPGAGAGHDAALVHDQSAAAVAAGWAAMHGGGYDIANAAADDVCAAGPIIPTGGHLHPLTLSMSSAGSQSSCVTVQAAAAGEPYMAMDAVSKKRGGADRAGQKQPVHRKSIDTFGQRTSQYRGVTRHRWTGRYEAHLWDNSCKKEGQTRKGRQGGYDMEEKAARAYDLAALKYWGPSTHINFPLEDYQEELEEMKNMSRQEYVAHLRRKSSGFSRGASIYRGVTRHHQHGRWQARIGRVSGNKDLYLGTFSTQEEAAEAYDVAAIKFRGLNAVTNFDITRYDVDKILESSTLLPGELARRKGKVGDGGGAAAVADAAAALVQAGNVAEWKMATAAALPAAARTEQQQQHGHGGHQHHDLLPSDAFSVLQDIVSTVDAAGAPPRAPHMSMAATSLGNSREQSPDRGVGGGGGGGVLATLFAKPAAASKLYSPVPLNTWASPSPAVSSVPARAGVSIAHLPMFAAWTDA

SEQ ID NO: 18892 - protein, 204 aa, Brassica napus
MKKLKLMDHSSCRRRYHDPPSQATARTLNNNNNNPKKKRVVKEDLDDEKIVSKHPTYRGVRMRQWGKWVSEIREPKKKSRIWLGTFSTAEMAARAHDVAALAIKGGSAHLNFPELAYQLPRPASADPKDIQAAAAAAAAAVAVDMEVETSTPSPVSSEPSSPATTALADDAFSDLPDLLLDVNHNIDGFWDSFPYEEPFFSGTY

SEQ ID NO: 18893 - protein, 344 aa, Unknown
  Candidatus Kuenenia stuttgartiensis
MLRNKYKLSMNNPILVVDDSKHVQRQIEIFLIPEGFSRLFFVNSAQEAFHLLGLDDENSKNRKCEIDLILMDINMPGTNGVEACLKINATRHLKNIPIIVITAEDTDEGLKQAFGAGAIDYIKKPLNPVELIARVSSVLKLKKEMDERENREKELLTLAQVLEKTNQELQQANEKLHQLSRTDSLTGLANRRFFDEMLHNEWKQSVRLAKPLSLLMIDIDFFKNYNDTYGHQKGDECLKRVSMAILSALKRECDIIARYGGEEFVALLSDTDESGAVMVAKAMQSNIEAMNIPHKDSNASGRITVSIGISNEVPSAASSPEKLISKADKALYLAKYEGRNLIKW

SEQ ID NO: 18894 - protein, 297 aa, Prosthecochloris aestuarii
MQASRRRSEAPSSRSATIFSTQWYRSGSMKQGVACITGSTDGIGRAAAFELAAAGHTVVLHGRSFERLEHTRREIEEQTGNHSIHTVLADFTDLCQVRRMADQLEKLCSVIDILINNAGVYMPRCQITTAGIETTFAVNHLAHFCLTTLLEPLLIESRTRVVNVSSVDHHSAGFSANSITGGTRYTGYQAYAFSKLCNVAFTLEHADRLRRTGVTVNTLDPGILATKLLHAGWSLQGDDVSCGAPPLLYLACSSKVADITGTYFENNHPAICSPIAHDPEIRRELWEISEEIVERNS

SEQ ID NO: 18895 - protein, 857 aa, Oryza sativa
MAAAVAMRGSSSDGGGYDKVSGMDSGKYVRYTPEQVEALERVYADCPKPTSSRRQQLLRECPILANIEPKQIKVWFQNRRCRDKQRKESSRLQAVNRKLTAMNKLLMEENERLQKQVSQLVHENAHMRQQLQNTPLANDTSCESNVTTPQNPLRDASNPSGLLSIAEETLTEFLSKATGTAIDWVQMPGMKPGPDSVGIVAISHGCRGVAARACGLVNLEPTKVVEILKDRPSWFRDCRNLEVFTMIPAGNGGTVELVYTQLYAPTTLVPARDFWTLRYTTTMEDGSLVVCERSLSGSGGGPSAASAQQYVRAEMLPSGYLVRPCEGGGSIVHIVDHLDLEAWSVPEVLRPLYESSRVVAQKMTTAALRHIRQIAQETSGEVVYALGRQPAVLRTFSQRLSRGFNDAISGFNDDGWSIMGGDGVEDVVIACNSTKKIRSNSNAGIAFGAPGGIICAKASMLLQSVPPAVLVRFLREHRSEWADYNIDAYLASTLKTSACSLPGLRPMRFSGSQIIIPLAHTVENEEILEVVRLEGQPLTHDEALLSRDIHLLQLCTGIDEKSVGSSFQLVFAPIDDFPDETPLISSGFRVIPLDMKTLELIEAFGFKYSLGKIKQDGASSGRTLDLASSLEVGSATAQASGDASADDCNLRSVLTIAFQFPYELHLQDSVAAMARQYVRSIVSAVQRVSMAISPSQTGLNAGQRIISGFPEAATLARWVCQSYHYHLGVELLSQSDGDAEQLLKMLWHYQDAILCCSFKEKPVFTFANKAGLDMLETSLVALQDLTLDRIFDEPGKEALFSNIPKLMEQGHVYLPSGVCMSGMGRHVSFDQAVAWKVLAEDSNVHCLAFCFVNWSFV

SEQ ID NO: 18896 - protein, 356 aa, Deinococcus radiodurans
MLITRQHHPDNLETPAHALLETLTPAHYVRSHFAVPALDAAEFRLKVAGQVASPLSLSLAELRALPATTHVLTLECAGNGRVYLTPKASGVQWEVGAVGTAQWTGVPLRTLLERAGVADNAREVVLVGADEGQMDDPVKSPGHIYYSRSLPLSKALDNVLLAYEMNGEALTPAHGAPLRAIVPGWYGMAAVKWLTEIRVIDHAYQGYFQTVDYARWERQDGLPPVRVPLSEMRVKSQILTPAPHACVQAGEELELCGAAWTGGERTVQRVEVSTDGGQSWQDAEWQQDAAPGVWRHWHLSWTPQQPGEVKLLSRATDSAGQVQPAAHDPHRGSYEVHHIVAVPVTVKAKQEHKEKS

SEQ ID NO: 18897 - protein, 126 aa, Mesorhizobium septentrionale
SKKAADQMWMARYLMQRLTEKYGIDIEYHCKPLGDTDWNGSGMHANFSTAYMREVGGKAYFEALMAAFDKNLMDHIAVYGPDNDKRLTGKHETAPWNKFSYGIADRGASIRVPHSFVNNGYKGYLK

SEQ ID NO: 18898 - protein, 239 aa, Oryza sativa
MAGSGDELMLLGKWPSPFVTRVELALGLKGLSYEYVKQDLVNKSELLLASNPVHKKIPVLIHNGKPVCESSIIVQYIDEAFPDAGAGAALLPADPYERAVARFWVAYVDDKFVPAWVATFRGKTEEEKAEGMKQLLAAVETLEGALKDCSKGKPFFGGDTVGIVDVALGGLISWVKATEVLAGSKIFDEEKAPLLAAWAQRFGELDVAEKVLPDVDGVVEFAKMRLAEAAAAAAAASKN

SEQ ID NO: 18899 - protein, 207 aa, Unknown
  marine gamma proteobacterium HTCC2207
MFRLNLPTADQALPGRETAMQISNRNFINGQPLQPPFADGLSTLVFGMGCFWGAERRFWQQAGVVTTAVGYAGGATPNPTYEEACSGLTGHSEVVLVVFDPAQISFEQLLTVFWESHDPTQGMRQGNDQGSQYRSVIYCDTEAQLAQTMASAETVQGQLTALGFGEITTEIRMAPTFYYAEEYHQQYLAKNPGGYCGLRGTGISCAI

SEQ ID NO: 18900 - protein, 263 aa, Mesorhizobium temperatum
QAEGHSSDCVLKPVAIYPDPARTNGVLVMCEVMMPDGVTPHASNKRATILDDEGAWFGFEQEYFFYKDGRPLGFPESGYPAPQGPYYTGVGYSNVSSVARQIVEEHLDLCLAAGINHEGINAEVAKGQWEFQIFGKGSKKAADQMWMARYLMQRLTEKYGIDIEYHCKPLGDTDWNGSGMHANFSTAYMREVGGKDYFEALMAAFDKNLMDHIAVYGPDNDKRLTGKHETAPWNRFSYGIADRGASIRVPHSFISNGYKGYLE

SEQ ID NO: 18901 - protein, 37 aa, Triticum aestivum
VITDLSEKVKVLERRLARKKRPKVRVHKPSRHASCVH

SEQ ID NO: 18902 - protein, 437 aa, Pyrococcus furiosus
MIQMIEKVYCSEVKPELEGKKVKLAGWVYSNMKVGKKIFLWIRDSTGIVQTVIAKNVVGEEVFEKAKKLGRESSVIVEGIVKADERAPGGAEVRVEKLEVIQAVSEFPIPENPEQASPELLLDYRHLHIRTPKASAIMKVKETLIMAAREWLLKDGWHEVFPPILVTGAVEGGATLFKLKYFDKYAYLSQSAQLYLEAAIFGLEKVWSLTPSFRAEKSRTRRHLTEFWHLELEAAWMDLWDIMKVEEELVSYMVQRTLELRKKEIEMFRDDLTTLKNTEPPFPRISYDEAIDILQSKGINVQWGDDLGADEERVLTEEFDRPFFVYGYPKQIKAFYMKEDPNDPRKVLAADMLAPEGYGEIIGGSQREDDYEKLLNRILEEGMDPKDYEWYLDLRKYGSVPHSGFGLGVERLVAWVLKLDHIRWASLFPRTPARLYP

SEQ ID NO: 18903 - protein, 233 aa, Oryza sativa
MAGGGDELKLLGMWASPFALRAKLALSFKGLSYEYVEEDLKNKSELLLTSNPVHKKVPVLIHNGKPVCESQVIVQYIDEAFPDAGVPLLPSDPYDRAVARFWAAYIDDKLLKSWLQASMCKTEQEKAAAMKETFAAVANLEAAFKECSKGKPFFGGDAVGYVDVTLGAVIGFVRVGEAVHGMRLFDASRSPLLDAWLDRFAALDAAKAVLPDTGRLAEYAKMKQAEWAAAATN

SEQ ID NO: 18904 - protein, 718 aa, Glycine max
MENTDPCRHFLKDVKRIIIKVGTAVVTRQDGRLAVGKLGALCEQIKELNSLGYEIILVSSGAVGLGRQRLRYRKLINSSFADLQKPQVELDGKACAAVGQNSLMALYDVLFSQLDVTSAQLLVTDNDFRDKDFRMQLSETMKSLLALKVIPIFNENDAVSTRKAPYEDSSGIFWDNDSLSALLALELKADLLILLSDVEGLYSGPPSDPRSKLIHTYIKEKHQSEITFGDKSRVGRGGMTAKVKASIHAAEAGIPVIITSGYAAENIIKVLQGQRIGTLFHKDAHKWAPVKEVDAREMAVAARDCSRRLQALSSEERKQILLKIADALEAHQNEIRIENEADVADAKEAGYEKSLVARLLASLANNIRIIANMEDPIGRVLKRTELAEGLILEKTSSSLGVLLIVFESRPDALVQIASLAIRSGNGLLLKGGKEAKRSNAILHKVITEAIPDIVGSKLIGLVTSRAEIPELLKLDDVIDLVIPRGSNKLVTQIKSSTKIPVLGHADGICHVYVDKSADLEMARRIVLDAKIDYPAGCNAMETLLVHKDLVEKGWLNSIIIDLRTEGVTLYGGPKASPLLNIPMARMLHHEYNSLACTVEIVDDVYAAIDHINLYGRHATLYFLIIAHTDSVVAEDHEVANVFLRQVDSAAVFHNASTRFSDGARFGLGAEVGISTSRIHARGPVGVDGLLTTRWILKGSGQIVDGDKAVNYTHRDLSI

SEQ ID NO: 18905 - protein, 231 aa, Oryza sativa
MAGEGDDQLKLLGLWVSPYTHRVKLALSFKGLSYEYVEEDLSNKSELLLSTNPVHKKVPVLIHNGKPICESQVIVQYLDEEFPNSGVSLLPSDSYDRAIARFWAAYINDKLMPSWLQSSMGKTEEERAEALKQTLEAVANLETAFKECSKGKPFFGGDTVGYLDVSLGAMIGWMRAGEALHGRRTFDATRSPLLNAWMERFAALDAAKAAMPDNNKLVEFVRVRRAAAANN

SEQ ID NO: 18906 - protein, 167 aa, Zea mays
  misc_feature (25)..(25): Xaa can be any naturally occurring amino acid
  misc_feature (27)..(27): Xaa can be any naturally occurring amino acid
  misc_feature (31)..(31): Xaa can be any naturally occurring amino acid
  misc_feature (39)..(40): Xaa can be any naturally occurring amino acid
  misc_feature (43)..(43): Xaa can be any naturally occurring amino acid
  misc_feature (76)..(76): Xaa can be any naturally occurring amino acid
  misc_feature (121)..(121): Xaa can be any naturally occurring amino acid
MALAEADDGAVVFGEEQEALFSLSXAXMKKXGGHFFFSXXLKXFEIAPGAKQTPPLLRDSERAAGEEPPKLKTHAXSVFVMTCEAAAQLRMAGKVPGWETPLQRLGAPPLRYGVADGHFEXVTGFALLETIKEALPADMWSLEMKKAWAEAYSQLVAAIKREMKPDA

SEQ ID NO: 18907 - protein, 156 aa, Sisymbrium irio
MNILNRFGLGSGGQTTSMGPSPIAQGNDDDAPSPGNQFAQFGAGCFWGVELAFQRVPGVTQTEVGYTQGIIHNPSYEDICSGTTRHAEVVRVQYDPKDCTYQTLLDLFWSRHDPTTLNRQGNDVGTQYRSGIYFYTPEQEKLAQESLERHQQQMER

SEQ ID NO: 18908 - protein, 795 aa, Crocosphaera watsonii
MDKQELLKIIEKARGEEWEELDLAGNELTELPPEIGSLVKLKRLILGKWDSKKVELIGNNISFLPKEIGQLTALQQLYLSGNQLTEIPAEIGQLTSLQQLYLSGNQLTEMPAVIGQLTALQILNLSRNKLKEIPAEIGQLTSLQILNLGLNELREIPVVIRQLTSLQELNLIRNPLVNPPIEVANQGIQAIRNYFRQIEKGKDTLFEAKLIIVGEGGVGKTTLARRINNPKCPLPEEKESTQGIDIQQWNFVMEGQEKDFRVNIWDFGGQEIYHATHQFFLTKRSVYAVVADNRQESPNLPYWLEIVELLSNKSPVLLIKNEKKDQKVQINEKELRARFENIKESLPTNFAADNRGLTDIINNLKFQLQQLPHVGTTLPKTWINIRNELERLFKEERKNYISLNEYYKICEDMKVTDRTFQLEISQFLHDIGVILHFQDDPISTLYNTVILNPEWGTDAVYKVLDEPTVINQLGRFNNTDLGNIWNEAKYETMQPQLLELMLKFKLCYELPKEKNTYIAPQLLTKEPPEYEFNTTQNLQLKYEYEFLPKAIIIQFIVEMSRLIDESKVWQKGVVLKRESNGQITYAEIVESYNRREINIRLDGEDKREFLGIITNKLEEIHESYNQLQVKALISCNCEVCKDSQKPYLHSLPVLKNFLNKNKTEAQCQKSGILVPIWNLIGEIIGEDIYKRITSERERITNQTNNFFNDSPSTESPNPPESPQPTPLHPIERRNLQVGIIVSILTLIVTFCGLVFTNIWNPFKPSNNNNQNQQTKPSLTPSPTPSPSPSPSPSQP

SEQ ID NO: 18909 - protein, 1394 aa, Photobacterium profundum
MPRTIKRQSMINVTIDGQKFPVNAQQTLLEAAADCNIEIPSLCGLNKNGEKVPCELCVVDVAGQGIQRACEILPVENMIVTTVSEELSSLRQTALNRILSDHYADCEAPCQTACPAGVDIQSYLYHISQDDHVKAVEVIKRTLPMPLSIGRVCPAFCETECRRGLVDEPIAIRQLKRHAADIDLAAQENYVPPKKASKGMSIAVVGSGPGGLTCGYYLTNEGYDVTVFESMPEAGGWLRYGIPEYRLPKAILAKEIELMCRNGMQVLTSKKLGDDFTLTQLTEDYDAVCLAVGASQAVEMNYTGSDLNGCYLGVDYLKDYVTEGCYITGKKVAVIGGGNTAIDCARTAVRDGADTTLIYRRTRDEMPAEDYEIVEAEHEGVKFHFLTNPVENIADANGHVCEIKLEKMALGEADASGRRRPEPTGKYFTEAFDTVIAAVSQKPDLSFMDKEELDLPLTRWNTQDANPNTMHSGLGNVFSIGDFRRGPATAIEAVADGRIAAEAIDRFFDGDMENIPVKLFNSQKERKLKQVAPEQFVEIKKVMRSVMPELSTKERELSFSEVETGFNNDEAMREAARCLECGCQANTDCKLRDYATEYDVAETELTNESCQKFHVDDSSEFIVFDANRCISCGQCVEACNEKAVHGTLSFAKNADGSSASRPECRPGFDKGYSMGDSNCVQCGACVQVCPTGALVDKRDKSQGRIEMLKPVETICTYCGVGCKLTMYVDESLNQIRYVQGVKDSPVNQGMLCVKGRFGFDFVNSKERLTTPLIRKNGELQPASWEEAISLVADKFNAIKADRGGNALAGFSSAKTTNEDNFAFQKFIRRELETNNVDHCARLCHASTVTGLEASIGSGAMTNDIPSIKFSDVVFIIGSDTTAAHPIIASHIKQAIRTGKTRLIVADPKRIDIADHSDLYVAHRPGTDVMLMNGIMQQIIKNDWHDKTYINERTEGFEALKAEVMLDSYAPDKVELVTGVKAQDVIKIAQMIGTANRTAVYYSMGITQHTTGHDNVRSVANLQMLCGNIGIEGGGINPLRGQSNVQGACDMGALPNNFPGYQKVQVPEIHAKFAKAWNKPNLPKEDGLTLTEIIDAACHDQVKGLYVMGENPVLSDPNQAHVIEGLEKLDFLVVQDIFLTETAQYADVVLPSCSFAEKSGHFTNTERRVQRISPAVNPPGEAKEDWWIIQSIANAMGSDWAYQSVKDITEEITQLTPQYAGIHWDRVGRDGLQWPCNDNAPDGTRVMHTSQFTRGKGEMAAIPFRYAAELPDAEYPLILTTGRLLEQFHTGSMTRKTKGLDNLAGPRAMISVVDAERLGVRNGEMLKVSTRRGSIETPAFVTKRMQEGVVFVPFHFAEAPANRLTTTATDPHAKIPEFKVAAVKIEKVRVLVETC

SEQ ID NO: 18910 - protein, 316 aa, Vibrio angustum
MSNVKHCELLILGSGPAGYTAAVYAARANLNPVMITGMQQGGQLTTTTEVENWPGDADDLTGPALMDRMKAHAEKFNTEIITDYIVETDFSQRPFLLKGENSTYTCNALIISTGASAKYIGLESEEAFKGRGVSACATCDGFFYRNQKIAVVGGGNTAVEEALYLSNIASEVHLIHRRDSFRSEKILIDRLMDKVANGNIILHTDRTLDEVLGDDMGVTGLRLKDTHSNATEELDVMGVFIAIGHQPNTAIFEGQLDMENGYIKVQSGLNGNATQTSIEGIFAAGDVMDHNYRQAITSAGTGCMAALDAERYLDAQ

SEQ ID NO: 18911 - protein, 648 aa, Zea mays
MNSMDEINLLRQAQRQHQHHLMVRGIGEEIDLEIGPVDDPSFSGASLVAVTSTHDTVVHADDHKSLLIPCSQPGAADGLAPQQHLSQGEEHDGMLRSPSGHTKKKKKVVKKWREEWADTYKWAYVAVHDTTTRIFCSVCKEYGRKHRRNPYGNEGSRNMQMSALEEHNNSLLHKEALRLQMASKEKLQPPEIEGPVYVKALSKTAASILECVLRRDPHEAEYIQSIQEVVHSLEPVLVKNAQYIQILERLLEPERCFIFRVPWIDDRGEAHVNRGFRVQFSQALGPCRGGLRFHPSMSLSVAKFLAFEHTLKNALSLYKLGGAAGGSDFDPKGKSDNEIMRFCQSFMDELYRYLGPDQDFPAEDIGVGPREMGYLFGQYRRLSGHFQGNFTGPKIFWSGSSFRTEATGYGLVFFARLLLAEMNKELKGLRCVISGSGKIAMHVLEKLLPCGAIPITVSDSKGYLLDEDGFDYMKYSLLRDIKAQQKSLKEYLKTYPHAKYIDDAKPWSQQCDVAFPCASHNEIDQGEAVAISNSGCRVLVECSNMSCTVQAVDILRKAKVIVAPAKATAAGGVALGEIELNPEFNLMQLSVEDFENRIQDAIKQTYERSVKAAQDYGIMKESPDFLVHGANICAFLNIAQAMTDQGCV

SEQ ID NO: 18912 - protein, 390 aa, Glycine max
MQEATKVIIIGAGTSGIATAGCLTKQSIPYIMLEREDCFASLWQKYTYDRLHLHLRKQVCELPHLPFPKSYPHYVPRKQFIDYLGNYVNHFEIKPLYQRAVELVEYDGWKGIWRVKAQNRRSGELEEYAGKYLVVASGETAEPRLPQIQGLESFNGKVIHSTAYKNGNEFKNKHVLVVGSGNSGMEIALDLSNFGAKPSIIVRSPVHFLSRDMMYYASLMLNYLSLSTVEKVLVMVSKVVYGDLSEYGIPYPSEGPFTMKMKYAKFPIIDVGTVKKIKSREIQVLPAEIKSIRGNEVLFQDGKSYTFDSIVFCTGFKRSTQKWLKGGDDLLNEDGFPKNSFPNHWKGRNGLYCVGLSRRGFFGANMDAQLVANDIASLIPQEEREGICVM

SEQ ID NO: 18913 - protein, 170 aa, Zea mays
  misc_feature (122)..(122): Xaa can be any naturally occurring amino acid
  misc_feature (133)..(133): Xaa can be any naturally occurring amino acid
  misc_feature (145)..(145): Xaa can be any naturally occurring amino acid
  misc_feature (151)..(151): Xaa can be any naturally occurring amino acid
  misc_feature (158)..(158): Xaa can be any naturally occurring amino acid
  misc_feature (166)..(166): Xaa can be any naturally occurring amino acid
MTFSMLSSGTVNISPARASMSAPFTGLETSTAYPDSSKTDSDMTSMTRNGGRVNCMKAGAQVSKKKIETVSYLPDLTDGEASNEVDYHLLNKRIPCVKLEEEHEFVYREQINTPTYYDVHNXQMRKFPLDACXDSAHVISQLHEXKNEYPXSFIRIIXFDNNRLVXCINF

SEQ ID NO: 18914 - protein, 471 aa, Legionella pneumophila
MTIALVWFRQDLRLTDNPAFIEACSHHEIVIPLYIYDDKCSVLGQAQAWWLHYSLIALGKSLNQQGLSLVLRKGSPQEIILELVAQYGVESVYWNRCYEPQVIARDKKIKLALVEREIKVQSFNGNLLHEPWTIKNKNGDFFKVFTPYWKQCRQILNIPSPFILTKRPRGIEIASDDIGKWKLLPAINWAARFSEYWIPGEEGAQKKLDEFIVHHLSGYKRDRDFPAKNATSRLSPHLHFGEISPWVILRALELAKLEHTCDLASVEHFLSELGWREFSVYLLYHFPKLDCENFRKEFDAFPWQNDEQLLTCWQKGMTGYPIIDAGMRELWATGYMHNRVRMIVASFLTKDLLIDWRSGAQWFLDTLVDADLANNSASWQWVAGCGADAAPYFRIFNPILQSQKFDPDGVYIRQWIPELAQLNSQSIHQPWTDADASSIFLGKKYPKPIIDHQEARTKALSYYQQIKKGMD

SEQ ID NO: 18915 - protein, 356 aa, Avicennia marina
MSLLSDLLNLDLSETTEKIIAEYVWVGGSGMDLRSKARTISGPVSDPSKLPKWNYDGSSTGQAPGEDSEVILYPQAIFRDPFRRGKNILVMCDTYTPAGEPIPTNKRHAAAKIFSHPDVAAEEPWYGIEQEYTLLQKNVKWPMGWPTGGYPGPQGPYYCGVGADKAFGRDIVDAHYKSCLYAGINISGINGEVMPGQWEFQVGPAVGISAGDELWMARYILERITEIAGVVLSFDPKPIQGDWNGAGAHTNYSTKSMRKEGGFEVIKKAIEKLGHRHKEHIAAYGEGNERRLTGRHETADINSFKWGVANRGASVRVGRDTEREGKGYFEDRRPASNMDPYIVTSMIAETTILGKH

SEQ ID NO: 18916 - protein, 234 aa, Medicago sativa
VSMASFTTFFTPLHNFNQARTYSTPSISLPFVKSSIASSKSPFFQHGFSQPTSFDFPKAVLKSKSFSVNARAVTDKSIYDFTVKDIDKKDVPLSKFKGKVLLIVNVASRCGLTSSNYTELSHLYENFKDKGLEILAFPCNQFGMQEPGSNEEIKKFACTRFKAEFPIFDKVDVNGPFTAPVYQFLKSSSGGFFGDLVKWNFEKFLVDKNGKVVERYPPTTSPFQIEKDIQKLLG

SEQ ID NO: 18917 - protein, 513 aa, Bacillus cereus
MTFLFNYLKIITRFHITEYIPQYGKTSNFILSTTKVRKTMAQVNNTNNELKRTMKSRHLFMIALGGVIGTGLFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFTINALSARSYAETEFWFSSIKVSAIIAFIILGGAAMFGFIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNIGIPYAADIMNFVILTAVLSVANSGLYAATRMLWSLSKNEMAPAFLKKLSSRGIPLNALIMTIAISAFSLLTSVVAAETVYLWLISISGVITIIVWMSICVSQFFFRKHYLADGGKLEDLKFKTPLYPLVPILGFGLYGIILISLIFIPEQRLGIYCTVPFIIFCYTYYHLKVKKRISTNTNSETKISETM

SEQ ID NO: 18918 - protein, 97 aa, Zea mays
  misc_feature (22)..(22): Xaa can be any naturally occurring amino acid
LIPRLSNHPKREIPLELLRKQXCKTRANESHIKVRELHAQHARPLPPRPIDEEEADGVYYGFSARHRNDAHRRIGLASLEWRVRSGTKERLIREHLP

SEQ ID NO: 18919 - protein, 613 aa, Thermoanaerobacter tengcongensis
MCGIAGWVNFNMDLSLQNEVIEKMTDTLKKRGPDGSGVWLSKHCVLGHRRLIVIDPQGGIQPMIKKYGEKNFVIIHNGELYNMDELKNELISLGYTFNTRSDTEIILTSYIEWGPLCVKKFNGIFAFAIWDEVQNRLFIARDHLGIKPLFYTIKNGSLIFGSEIKAILAHPHVKPEIDSQGLAEIFVMGPSRTPGCGVFKDIKELKAGHYLIFTKNGVNISKYWSLQSLPHEDSLEKTAEKIRYLLKDSSVRQLVSDVPLCSLLSGGLDSTAVSFFANEELKQKGHKLITYSVDYVGNDKYFTPNEFQPNSDADWVKFVANKLDTDHNYVFIDNEELAHALKPALYARDLPGMADIDSSLYLFLKEVKKGATVALSGEGADEVFGGYPWFRNKESIRSHTFPWTRMVNERMKLLLPEVVNYIRPLEYLNDRYNEALNEVPKLNGEDPYNARMREMFYLNITRFMPMLLDRMDRMSMAVGLEARVPFLDYRLVEYVWNIPWEMKNLNNREKGILRYALKGYIPDEVIERKKSPYPKTHNPVFKNIVKKWLKQIINDSTSPLLQLVDKKAIAELIETDAKAYDPAWFSQLMGSPQLFAYLVQINMWLKDYKISIV

SEQ ID NO: 18920 - protein, 227 aa, Rickettsia conorii
MTNNLSGYRNKFVRVKTSKKRTVSSSNWLRRQLNDPYVAKARIDGFRSRAAYKLLEIHEKFKLFTPNMKIVDLGAAPGGWSQVASKLIKASDNNLNNKIISIDVLEIEHVAGVEFVQKDFFEADTEELIIQALDGRADIVMSDMASNTIGHKATDHIRTLLLCEQAFEFALKVLKPSGHFIAKIFRGGAENELLHKVKREFKTVKHFKPSSSRSESTEIYLVALNKK

SEQ ID NO: 18921 - protein, 764 aa, Methanosarcina acetivorans
MTEEDKSTIKLKVAEADQRDVGKGIVRIDERFREKLGLKPFDVVEIKGGKSTSALIGRPYPSDAGLDIIRMDGLIRTNAKTSIGEYVDIRKADWKEAKSVTFAPVAQGMQIYAPSETLKAVFMNRTVSKGDFISTTSLRRSRERETFGKGVMFEDFFQDFFGQGFGPSFGLGEIKLQVVSTAPAGIVKITDMTQVELLPEAMEIISEQNIPTVMYEDLGGLKDAISKVREMIELPLKHPELFDRLGIDAPKGVLLQGPPGTGKTMLAKAVANESDAYFISINGPEIMSKYYGESERAIREIFEDAEKNAPAIIFLDEIDSIAPKRAEVTGEVERRVVAQLLSLMDGLKARKNVIVIGATNRPEALDIALRRPGRFDREIELRVPDTEGRLEIFQIHTRGMPLADNVNLMDFAQITYGFVGADIAALCREAAMSALRRILPKINLNEPEISKEILDALQVTREDFENALKDVQPSAIREILIEVPNVSWEDVGGLERVKELLKEVVEWPLKNPESYRDIGVEAPKGVLLYGPPGTGKTLLAKAIAHESDANFITAKGSDLLSKWYGESEKRIAEVFTRARQVAPSIIFLDELDSLAPIRGTSVGEPQVTARILNQLLSEMDGLEELRAVVVIGATNRPDIIDPALLRPGRFDELILVPVPDEGARREIFRVHTKNMALAEDVDIEKLVSFTDQYTGADIAAVCKKAGRHALREDLHAKKVRQKHFLQAIEETGPSVTPDTMKYYEAIKGELRKRKSKEIENPYYV

SEQ ID NO: 18922 - protein, 322 aa, Prochlorococcus marinus
MPIANDITYLVGQTPLVKLNRLPNEFDCRAEIIAKLESFNPTASVKDRIAGAMVMSAEKEGTIKPGHTVLVEPTSGNTGIALAMVAAAKGYRLILTMPDTMSTERRSMLRAFGAELQLTPGQEGIQGAIQLAKELVASIPNAYLLQQFDNLSNPEIHEKTTAEEIWEDCEGKLDALIAGVGTGGTITGCARFLKQKNPKIKVFAVEPSSSPVLSGGNPGSHAIQGIGAGFIPNVLDMNQIDEVIRINDNEAMDIGRRLAKEEGLLSGVSSGAAVAAALKVGNQPEFANKRLIVILPSFGERYLSTTMFTSIPAKPVKGNEYL

SEQ ID NO: 18923 - protein, 328 aa, Ashbya gossypii
MMDKLDLDQLPYYDPRVERKVALVTGGNSGIGWYTVLHLYMHGFIVYVGGRNSSRVHKAIKEIKQEAENRLETARQDPHDELERCLGELRYLPIDLTDLRSVEKAAKKFRAQESTLDVLINNAGVMALPYELTHDGFEVQMQTNYVSHFLLTMRLLPYVKRSGGRVVTLSSIGHKIQFTYCPLDCHFDYRPNIFFTWLRYAMAKTAAIQFTKMLAIKHPDVMCIAVHPGLVMNTNLFSYWTRLPIVGIIFWIFFQIVGFCFGVSNEEGSIGTLKSALSPALTLERDNGKYFTTGGVESRPSSVANNLDNAASTWIWTVHQLRDRGYEI

SEQ ID NO: 18924 - protein, 300 aa, Helicobacter hepaticus
MIAQNITELIGNTPILQLQQFAPNLYGKCEFLNPSHSVKDRPAYAMIDEALKTGKITKDTTIVECTSGNMGISLAMICASLGLKIIITMPESMSIERRKMIALFGANLVLTPASEGMQGALNKAQEILDSTPNSFMPSQFDNLANKEMHKRTTALEIYKSFEGSLDYFVAGFGTGGTISGVGEVLKEKIPSIKIIGVEPAASPLLSKGQAGPHKIQGIGANFIPKILNRDVIDSIEVVENEVAIKMAQNLGKIGVMVGISSGANVAAALEIAKNNPNKKVLTMLNDTAERYLSTDLFNTL

SEQ ID NO: 18925 - protein, 468 aa, Prosthecochloris aestuarii
MQSIKPAETTPLKILLVSPQGKLDEDSNQKPLFHMALGVLTSLTPPQHEIELIDEHFHDEIDYEGDYDFIGITSRTIEATRAYEIADAFRAKGKPVILGGLHISFNPEEAKQHADCIVVGEADNLWTTLLDDVANKRLKPEYNSKDFPPVKEIAPLDYARIAKASKRVKVDGTKSIPIYLTRGCPFNCSFCVTPNFTGKQYRTQKPELLKHQIEEAKKYFFNPKGKTSKPWFMLTDENLGINKKKLWESLDLLKECDITFSVFLSINFLEDPKTVRKLVDAGCNFVLAGLESIKQSTLEAYNKGHVNSAEKYAKIIDDCRKAGLNIQCNFLFNPALDTFEDIDELVQFVKKNNIFMPIFQIITPYPGTQMYWDYKKEGLITNEDWEKYNALHLVIKSERYEPLIFQYKVLKSYVDVYSWRYIVSRTYHNPRKLINLVTSIAFRTHLKKQIATFEQENHMSPAQLQGIK

SEQ ID NO: 18926 - protein, 145 aa, Anabaena variabilis
MRLLHTMLRVGNLEESLKFYCDVLGMKLLRRKDYPGGEFTLAFIGYGDESDNTVIELTYNWGVDKYELGNAYGHIALGVDDIYATCESIKNQGGKVVREPGPMKHGSTVIAFVEDPDGYKIELIQLSNQSETVKQDSSEQLVKQG

SEQ ID NO: 18927 - protein, 242 aa, Methanocaldococcus jannaschii
MTGKVILVGAGPGDPELITIKGLKAIKEADVVVYDDLISKELLNYAKKDAELIYVGKRKGKHSFKQEEINKILVEKAKEGKLVVRLKGGDPFVFGRGGEEILELKKHNIPYEVIPGITSAIAVPEVAGIPVTHRKVATSFTVVTGHEAEDKKEKQVDLSKLNADTIVILMGITNLENLVKELLQNPKRSKETPVAIIMEGTTKNQRVIKGTLGDIVEKAKKENARPPGVIVVGEVVNVLDSQ

SEQ ID NO: 18928 - protein, 416 aa, Oryza sativa
MAVRLCCCCFLLFVTIAAAGGSLTRTNVATLPGFDGALPSRLETGYVTVDEENGAELFYYFIESEGDPSTDPVLLWITGGDRCSVLSALFFEIGPLKLVIEPYNGSLPRLHYHPYSWTKVASILFVDSPVGAGFSFSRDPKGYDVGDVSASMQLIKLLREWFTEHPHYLSNPFYVGGDSYAGKIVPFIVQKISEDIEAGVRATFNLKMIMEHCEGEDYDNPSNVICQQALARFDSLLHEGSRAQILNPNCIYVSPKPNHETIDRKILKEEHGGLKHPPPQPSIKCGVYANYLSYFWANNNFTRRTLGIKKGTINEWVRCHEHDLPYNIDIRSSIKYHRNVTLKGYRALVYSGDHDAVVPFLGTQAWVRSFNYPIVDDWRAWHIDGQSAGFTIAYGNNLTFATVKYGLKVETAKRKF

SEQ ID NO: 18929 - protein, 843 aa, Unknown
  Azoarcus sp. BH72
MKIVLVGHGMVGHKFLEELQQLQIPGAEVTVLCEEPRTAYDRVHLSEFFSGKTAEDLSLVAPGFFDDTGFALRLNSRAAAIDRRAKTVTTQDGVTLSYDKLVLATGSYPFVPPVKGNDREQCFVYRTIEDLEAMKAAGAISRKGVVVGGGLLGLECAKALRDLGLETHVVEFAPRLMAVQVDDDGGRILREKIEQLGVQVHTSRNTTEITDGMTARHRMVFADGSHLETDMIVFSAGIRPRDELARQNALAVGARGGIAVDDHCRTSDPDIYAIGECAAWRDQTFGLVAPGYDMARLVARHLAGETKAAFAGADMSTKLKLMGVDVASIGDAHGKTAGCRSFRYSDEVKQVYKKIVVSEDGKRLLGAVLVGNADEYGTLLQMALNGIAPPAEPEFLILPSSDGKAKPGLGPDALPDSAQICSCNNVSKGQICAAVGEGATSIGEIKSCTKAGATCGGCVPLVTQIMKAEMAKRGMAVNNHLCEHFPYSRQELFHLVRVGGIKSFEDLLARHGQGHGCDICKPTAASIFASCWNDFVLQGELASLQDSNDYFLGNIQKDGTYSVVPRMPGGEVTPDGLIAVGQVAKKYGLYTKVTGGQRVDLFGARVEQLPAIWEELIAAGFESGHAYGKALRTVKSCVGSTWCRYGVDDSVGLAVELENRYKGLRAPHKIKFGVSGCTRECAEAQGKDVGIIATERGWNLYVCGNGGMKPRHAELIASDLDRAALIRLIDRFLMFYVRTADRLQRTSTWRENLEGGLDYLKDVLIADSLGLAAELEAQMQHVVDTYQCEWKTAVTDPDVRKRFRTFVNDPQADKRIVFVKERGQIRPARAEERDAATADPLAV

SEQ ID NO: 18930 - protein, 253 aa, Prosthecochloris aestuarii
MQTQTMSRFSLEDMLRAGVHFGHLARRWCPKMKPFIFMEKNGVHIIDLKKTLYMAEDAMKAIDAIALTGKEIMFVGTKKQAKNIISAEAERAGMPFVSERWLGGMLTNFSTIRQSIRRMNAIDRMETDGTFDMITKKERLMLMREKDKLFRILGGISNMTRLPAALFIVDIKKEHIAIKEARSLGIPIFALVDTNCDPDEVDYVIPANDDAIRSIELMVKAVADSILNARQQVIEAEAMEEAEEKAVNEAAAE

SEQ ID NO: 18931 - protein, 298 aa, Candida glabrata
MAEQKYIKDGWFYEMSDEHFPGQALALKVKQVLYQSKSEFQDILVFESTNHGVCLVLDGIIQCSERDEFAYQEMIAHIPLYCHANPKKVLVIGGGDGGVVREVVKHDKVESVTMVEIDKTVIELAKKYLPGMSCAMDHPKLKLNLCDGFKFLKEASMLSNDDKYDVIITDSSDPDGPAEAFFQKEYFELLQNALKPDGIVIAQASENVWLDINYLASLRKTANEVFTNTMISYTTVPTYTSGQLGLIVCTNSNDYDLTTPQRQPSVSEQNQLRYYNSQIHSASFVLPNWADMLIYDKK

SEQ ID NO: 18932 - protein, 160 aa, Pseudomonas putida
MSAFHDLKLEALNGGELPLAPFKGQVVLVVNVASKCGLTPQYKALENLYQIYKDKGFNVLGLPCNQFAGQEPGSEKEIQDFCSLNYGVSFPLGSKLEVNGPQRHSLYRLLAGEGAEFPGDITWNFEKFLVGKDGRVLARFSPRTAPDDPAVVQAIEKALA

SEQ ID NO: 18933 - protein, 420 aa, Propionibacterium acnes
MTDSRKNKRPRKSILRPVTGPNALHLSDIFRNETTGGMLMLAATVAALLWANLGHHSYHFFRELALGPLTIEQWAADGLLTVFFFIAGLELKREFVEGSLSRPADALVPIVAAVCGMVFPAGIYTLFNVLASDGHPAGWAIPMATDIAFALAVLAIVGAGLPQAVRAFLLTLAIADDLGSIIVIAVFFSTGLDIWWLAGAIACIGLWGVMQHFHVDNGWWYVPIFIVGWWCMLRSGVHATIAGVAFGLLTRTEEDVLDDPVDRWQHKVEPWSAGVVVPFFALMSAGVHVSGKTFLALWTHPISLGIVCGLILGKVIGITLGSCLTARFTSAELGRGVVWRDIIAVAVLAGIGFTVSMLMTDLSFPKNHEFADEAKASVLMASFLAAILGGAMLHHRGKSHAMRQTKHSHEVPVAAGTCND

SEQ ID NO: 18934 - protein, 504 aa, Unknown
  Synechococcus sp. CC9311
MALQLVWFKRDLRVKDHKPLQQALLRGPVLPLYVVEPELWQQQDASERQWLFCRESLLDLRLALAALGQPLLVRSGDVVEVFERAHRQFGLEALWSHEETGNGWTYQRDQRVALWCRQHGIAWKEIPQFGVIRRLRSRTRWAKRWEAQMAEPITPSPLGLPSIEGIDAGVIPDCPHPTLASDPCPHRQSGGRSMALLELDDFLEHRAPGYARSISSPNTAFTGCSRLSAYLTWGCLSMREVIQTSRGFSGRGISSFESRLHWHCHFIQKLEAQPSIEFEDFHPFMRGLRCTNDQRLLAWAEGRTGVPFVDACMRALRAHGWINFRMRAMLMSFASYHLWLPWRDSGLHLARQFVDYEPGIHWSQCQMQSGSTAINTVRVYNPIKQGQDHDLNGEFIRTWVPELHLVSNVYVHEPWKLSTAAQRQAGLQLGVDYPLPMVEPALAAREAKQRIWAIRERSGFSAIADGIQQRHGSRRSGLAPTGKGRHRRRRNPRPDGSQQLTLDL

SEQ ID NO: 18935 - protein, 238 aa, Oryza sativa
MAGGGGAGELKLLGHWASAYVTRVKLALHLKGVSYEYVEEDLRNKSDLLLASNPVHKTVPVLIHNGNPIRESQIIVQYIDEAFSGAGDSLLPADPHERAVARFWTAYIEDKLVAPWEKVFRAKTEEERAAWMKQMFVAVEALEGGLKECSKGKGCFFGGDSVGYVDVVLGGGVSFVHANDVITGGKLFDAAKTPLLAEWLGRFGELDAAKAVLQDVDRAVEYTKVLYARNAATTAANN

SEQ ID NO: 18936 - protein, 299 aa, Campylobacter jejuni
MKVHEKVSELIGNTPIIHLKKFGINVFAKCEFLNPSHSIKDRAAFEMIKDALDSKKINQDTTIVEATSGNTGISLAMICADLGLKFVAVMPESMSLERKKMITLFGARLELTPANLGMKGAVDKANEILLNTPNSFMVSQFENISNKNAHRKNTALEILRDLDNELDIFVAGFGTGGTISGVGEILKEKLEKVHIVGVEPLNSPLLSKGEAGSHKIQGIGANFIPAILNKEVIDQVITVSNEDAINTAKELAKIGLMVGISSGANVFAASMLAKKFPDKRILTMLNDTAERYLSTDLFA

SEQ ID NO: 18937 - protein, 149 aa, Glycine max
QNCHQSRVASDRRQKEAETHLPELEARDGISITMEDIGTSRVWNMRYRYWPNNKSRMYLLENTGDFVRANGLQEGDFIVIYSDVKCGKYMIRGVKVRQQGVKPETKKVGKSQKNQHGTGTNASTTACTAANNGTPSSPKTKAEKSSKLI

SEQ ID NO: 18938 - protein, 976 aa, Ralstonia eutropha
MNAPLPMTATQGNRPTLAELEARDAFAARHIGPDTPEQQHMLKVLGYDSRAALIDAVIPEAIRRRDGMPMGEFTEPLPEEAALAKLRKLAGKNKVLKSFIGQGYYNTLTPAVVLRNIFENPAWYTAYTPYQPEISQGRLEAMLNFQQMVTDLTGLDIANASMLDEGTAAAEAMTLLQRVNKHASNTFYVADDVLPQTLEVVRTRAKPLGIEVKVGPAADAAAAHAFGVLLQYPGVNGDVTDYRAIADAVHAAGGLVVAAADLLALTLITAPGEWGADVAVGNSQRFGVPLGFGGPHAGYMAVKDAFKRSMPGRLVGVTVDAQGNKAYRLALQTREQHIRREKATSNICTAQVLLAVMASMYAVYHGPQGLKRIAQRVHRLTATLAAGLQTLGFTRTNATFFDTLTFETGFNTDAIHAAATARGINLRHAGATRIGVSLDETATRDDVVALWEIFSHGKPLPASLTFDAIEAAAEDAFPANLARTSAYLTHPVFNTHHAEHEMLRYLRMLADKDLALDRTMIPLGSCTMKLNATSEMIPVTWPEFSQIHPFAPLDQTVGYREMIDQLEAMLCAATGYAAVSLQPNAGSQGEYAGLLIIHAYHASRGESHRDICLIPSSAHGTNPASAQMAGMKVVVVACDENGNVDLEDLAKKAELHSKNLAAIMITYPSTHGVFEQGVQQICEIVHQHGGQVYVDGANMNAMVGTAAPGHFGGDVSHLNLHKTFCIPHGGGGPGVGPVAVGAHLADFLPNQDSVGYRRDDNGIGGVSAAPFGSASILPISWMYIAMMGSAGLTAATENAILTANYVAKRLSPHYPVLYTGQHGLVAHECILDLRPLQKETGISNEDVAKRLMDYGFHAPTMSFPVPGTLMIEPTESEALHELDRFIDAMIAIRKEIGRVEDGSFDRDDNPLKHAPHTAAVVTANEWTRKYTREEAAYPVASLRTQKYWPPVGRADNVYGDRNLFCSCVPMSEYAQD

SEQ ID NO: 18939 - protein, 237 aa, Oryza sativa
EGELKLLGTWASPYVSRVKLALHLKGLSYEYVVEEDHFNNKSELLLSSNPVHKKVPVMIHNGKPICESLIIMEYLDEAFPDTAAPLLPADLHDRAVARFWAAYIDDKLVPSWKQAFSGKTGEEKAEGMRHMLAAVDALEAAMEWSYKGKPFFGGDAVGFLDVALGGLLSWLHGTEELCGAKILDAAKTPLLSAWARRFGEMDAAKVALPDVCKLVEFAKMKRVQLEAAMAATTVSRN

SEQ ID NO: 18940 - protein, 106 aa, Wolinella succinogenes
MGKYIELNASNFDEVTKKGVSLVDFWAPWCGPCRMVAPVIEELAADFEGKANVCKVNTDEEQELAVKYGIRSIPTILFFKDGEIVDQMIGASSKQAFKEKLDSLIG

SEQ ID NO: 18941 - protein, 203 aa, Zea mays
MGRRPARCYRQIKGKPYPKSRYCRGVPDPKIRIYDVGMKKKGVDEFPFCVHLVSWEKENVSSEALEAARIACNKYMVKSAGKDAFHLRIRVHPFHVLRINKMLSCAGADRLQTGMRGAFGKALGTCARVAIGQVLLSVRCKDNHGAHAQEALRRAKFKFPGRQKIIVSRKWGFTKFNRADYPRVRKSQRIVPCWGQCLSRPGQ

SEQ ID NO: 18942 - protein, 218 aa, Sisymbrium irio
MAAFEESTDLDAIQGHLFEDFMVSDGFMGDFDFNASFVSGLWCIEPVMNQVPKQEPDSPVLDPDSFVKEFLQVEAESSTSTGTTELNSSSQETDQSISTRKKSKRFEEQEEEEPRHYRGVRRRPWGKFAAEIRDPAKKGSRIWLGTFESDVDAARAYDCAAFKLRGRKAVLNFPLDAGKYEAPANSGRKRKRSDVQGELQRSQSNSSSSSSDGETTCE

SEQ ID NO: 18943 - protein, 470 aa, Erwinia carotovora
MSANNSRLIKLLVILCIAGGLWLLPVPDGVKPDAWHLMAIFIATVVGLILSPYPLGAMAMFSLTTVAILGLLSIKDVLAGFSDPTIWMIACAFFISRGFIKTGFGRRIGLLFISKLGNSSLGLAYGLVFTDLMFAPAMPSTSARCGGIITPLFRSIAEAYDSTPEKGTQRRIGAFLVQSIFQCNAVTSAMFMTSMAGNPMVAKLASQFGIHISWTDWALATLLPGFLSLALIPYLIYRFYPPELKKTSEMRAIAVERLREMGKMTRNEWVVLGVFLGLVTFWVLGSTLNIDATLTALAGLSVLLLSRALTWDDVVSEKEAWHTVVWFAVLMTLAGQLNKMGLIAWLGGLAGNAVSGMHWLPMLGLLLLVYYYSHYLMASAIAHISAMYAIFVSIALAAGAPPMLTVLVFGIFSNLFMSTTHYSSGPAPILFGTGYVPLGTWWKIGFLVSLVIIPIWLGVGGMWWKLLGFW

SEQ ID NO: 18944 - protein, 993 aa, Xylella fastidiosa
MFSVSHFCSGSLMMSHTLSSLRDLEYQGAFVERHIGPNDVEIAQMLRVVGYDSLESLTDAIVPEKIRSTVALDLPKGITEEEALAKIRVIANKNRVFRSFIGQGYYGTHTPKVILRNVLENPAWYTAYTPYQAEISQGRMEALINFQTMCADLTGMEIANASLLDEATAAAEAMSLAKRSAKSRSDLFFVHDAVHPQTLELLRTRAEPLGIVLRVGTPEEALQADVFGILLQYPDTFGRIGDHRVLADAVHARGGLVAVASDLLALTLITPPGEWGADIVVGNSQRFGVPFGFGGPHAGFMACRDIYKRSIPGRLIGVSVDAAGHPAYRLALQTREQHIRREKATSNICTAQVLLAVMASMYAVYHGPQGLLRIAWRTHRMAAILAAALRGAGLTVGEYFFDTLHIVGIDAVAIHCAAAAAGMNLRMIDNAQLGISLDETVTRSDVVALGQVFGVQVDVEALDAITADALPAGLLRSSAFLTHPVFNTHHSEHELLRYLRMLADKDLAMDRTMIPLGSCTMKLNATAEMIPVTWQEFACIHPLAPAVQWSGYRQLIDELEAMLAECTGYDAISLQPNSGAQGEYAGLLAIRAYHRSRGEERRNVCLIPESAHGTNPASAQLCGMQVVIIKCDRSGNVDVDDLRMKAEKYSDSLAALMVTYPSTHGVFEEAITEICEIVHAHGGQVYTDGANMNALVGVAKPGRWGSDVSHLNLHKTFCIPHGGGGPGVGPCAVKAHLAPFLPKTLPLPGDAAGLPVQGTQEAKVGMVSAANFGSASILPVSWMYITMMGAAGLRKATQVALLNANYIAKRLAPHYKTLYTGRHGLVAHECILDVRPLEKVSGVSAEDIAKRLIDFGFHAPTLSFPVAGTLMVEPTESESQQELDRFVDAMIQIRGEIAAIEKGHLDPEDNPLKQAPHTAVQVMASQWGHAYSRELAAFPLGVLHHAKYWPPVARVDNVYGDKHVMCACIPVEAYKEKEDSEIQHLIEEDASRC

SEQ ID NO: 18945 - protein, 604 aa, Oryza sativa
MSALTTSQLATSATGFGIADRSAPSSLLRHGFQGLKPRSPAGGDATSLSVTTSARATPKQQRSVQRGSRRFPSVVVYATGAGMNVVFVGAEMAPWSKTGGLGDVLGGLPPAMAANGHRVMVISPRYDQYKDAWDTSVVAEIKVADRYERVRFFHCYKRGVDRVFIDHPSFLEKVWGKTGEKIYGPDTGVDYKDNQMRFSLLCQAPRILNLNNNPYFKGTYGEDVVFVCNDWHTGPLASYLKNNYQPNGIYRNAKVAFCIHNISYQGRFAFEDYPELNLSERFRSSFDFIDGYDTPVEGRKINWMKAGILEADRVLTVSPYYAEELISGIARGCELDNIMRLTGITGIVNGMDVSEWDPSKDKYITAKYDATTAIEAKALNKEALQAEAGLPVDRKIPLIAFIGRLEEQKGPDVMAAAIPELMQEDVQIVLLGTGKKKFEKLLKSMEEKYPGKVRAVVKFNAPLAHLIMAGADVLAVPSRFEPCGLIQLQGMRYGTPCACASTGGLVDTVIEGKTGFHMGRLSVDCKVVEPSDVKKVAATLKRAIKVVGTPAYEMVRNCMNQDLSWKGPAKNWENVLLGLGVAGSAPGIEGDEIAPLAKENVAAP

SEQ ID NO: 18946 - protein, 606 aa, Oryza sativa
MSALTTSQLATSATGFGIADRSAPSSLLRHGFQGLKPRSPAGGDATSLSVTTSARATPKQQRSVQRGSRRFPSVVVYATGAGMNVVFVGAEMAPWSKTGGLGDVLGGLPPAMAANGHRVMVISPRYDQYKDAWDTSVVAEIKVADRYERVRFFHCYKRGVDRVFIDHPSFLEKVWGKTGEKIYGPDTGVDYKDNQMRFSLLCQEAPRILNLNNNPYFKGTYGEDVVFVCNDWHTGPLASYLKNNYQPNGIYRNAKVAFCIHNISYQGRFAFEDYPELNLSERFRSSFDFIDGYDTPVEGRKINWMKAGILEADRVLTVSPYYAEELISGIARGCELDNIMRLTGITGIVNGMDVSEWDPSKDKYITAKYDATTAIEAKALNKEALQAEAGLPVDRKIPLIAFIGRLEEQKGPDVMAAAIPELMQEDVQIVLLGTGKKKFEKLLKSMEEKYPGKVRAVVKFNAPLAHLIMAGADVLAVPSRFEPCGLIQLQGMRYGTPCACASTGGLVDTVIEGKTGFHMGRLSVDCKVVEPSDVKKVAATLKRAIKVVGTPAYEEMVRNCMNQDLSWKGPAKNWENVLLGLGVAGSAPGIEGDEIAPLAKENVAAP

SEQ ID NO: 18947 - protein, 134 aa, Triticum aestivum
KDAFHFRCRVHPWHVLRINKMLSCAGADRLQSGMRGAFGKALGKAARVDIGSILFSVRVLEQHVKFAIDALTRAKAKFPGRQKVVTSQKWGFTKHTRAEYSRLRNEKKLLKDGSNVKVIGERGPLSRLELFRSR

SEQ ID NO: 18948 - protein, 136 aa, Rhizobium leguminosarum
MTEKVTTLYQAIGGDPVVRALTHRFYELMDRLPEASNVRAVHPPSLEGSEEKFYEYMTGYLGGPPLYTDKRGHPRLRSRHFVAEIGPVERNEWLLCFRRALDETISSQELRDLIWAPVERLAYHMQNKAPDDKEQP

SEQ ID NO: 18949 - protein, 355 aa, Salmonella typhimurium
MSQKYLFIDRDGTLISEPPSDFQVDRFDKLAFEPEVIPVLLKLQKAGFKLVMITNQDGLGTQSFPQADFDGPHNLMMQIFTSQGVCFDEVLICPHLPADDCDCRKPKVKLVERYLAEQAMDSANSYVIGDRATDIQLADNMGITGLRYHRETLNWTMIGEQLTKRDRYAHVVRNTKETQIDVSVWLDREGNSKINTGVGFFDHMLDQIATHGGFRMEITVKGDLYIDDHHTVEDTGLALGEALKLALGDKRGICRFGFVLPMDECLARCALDISGRPHLEYKAEFTYQRVGDLSTEMIEHFFRSLSYTMGVTLHLKTKGKNDHHRVESLFKAFGRTLRQAIRVEGDTLPSSKGVL

SEQ ID NO: 18950 - protein, 271 aa, Unknown
  Frankia sp. EAN1pec
MRTIVLVGATSGLGRHAAHILKEAGHRLVLVGRDPKRAAQLAHDLPTATVIAADISTAAGIDLVAEKVHAVVDRVDTLVNNAGVMLPTRRTTSEGIELNLAVHHLAPYSTTARLLPLLRHGDGRIINVNSEGHRAPMRGAGPVHLDLTDLNSERRYDPFLTYSRTKLANLLFTYELQRRHPELTVAAVHPGMVRTNLGRHFPRLRVALLLPFMMSPRQGARPVIHLASAPTISAGRYYDRLRPVSSSPASYDTNTARRLWEITSDIRGPFG

SEQ ID NO: 18951 - protein, 286 aa, Zea mays
MGGAAEEALRREYVVGEEIGRGRFGTVRRCYAAATGEPFALKTTPNAALRADPLDLALAEQEPKVHHLASAASRHVVALHAAFEDADAVHLVLDLCAGGDLFALVSARGALPEPEAAELMAQLADALAGCHRRGVAHRDVKPDNLLFDAAAGGALRLGDFGSAAWFGDGRPMTGLAGTPYYVAPEVVAGREYTEKVDVWSAGVVLYMMLSGTVPFSGATAGEIFQAVLRGNLRFPPRAFAAVSPEAKDLLRRMLCRDVWRRLSAEQVLRHPWIVTRGGSVPGGRLV

SEQ ID NO: 18952 - protein, 635 aa, Solanum tuberosum
MESCDCIEALLPTGDLLVKYQYLSDFFIAVAYFSIPLELIYFVHKSACFPYRWVLMQFGAFIVLCGATHFISLWTFFMHSKTVAVVMTISKMLTAAVSCITALMLVHIIPDLLSVKTRELFLKTRAEELDKEMGLIIRQEETGRHVRMLTHEIRSTLDRHTILKTTLVELGRTLDLAECALWMPCQGGLTLQLSHNLNNLIPLGSTVPINLPIINEIFSSPEAIQIPHTNPLARMRNTVGRYIPPEVVAVRVPLLHLSSFTNDWAELSTRSYAVMVLVLPMNGLRKWREHELELVQVVADQVAVALSHAAILEDSMRAHDQLMEQNNALDDARQEAEMAIRARNDFLAVMNHEMRTPMHAVIALCSLLLETDLTPEQRVMIETILKSSNLLATLINDVLDLSRLEDGILELENGTFNLHGILREAVNLIKPIASLKKLSITLALALDLPILAVGDAKRLIQILLNVAGNAVKFTKEGHISIEASVAKPEYARDCHPPEMFPMPSDGQFYLRVQVRDTGCGISPQDIPLVFTKFAEARPTSNRSTGGEGLGLAICRRFIQLMKGNIWIESEGSGKGTTVTFVVKLGICNHPNALPLLPMPPRGRLNKGSDDLFRYRQFRGDDGGISVNAQRYQRSL

SEQ ID NO: 18953 - protein, 136 aa, Cucumis sativus
VFGILSMLTGLVLYDRLLVPFAKKLTHNPSGITCLQRMGVGFAINILATLVSSIVEIKRKKVAASHGLLDNPTATIPFSVFWLVPQFWLHGIAEVFMSVGHLEFMYDQSPESLRSTATALYWLAISVGNYIGTLMV

SEQ ID NO: 18954 - protein, 423 aa, Streptomyces avermitilis
MSVTHVPEAVRPAVAGADFEALRRQDPELAEILIGELDRQSTTLQLIAAENFTSPAVLAALGSPLANKYAEGYPGARYHGGCEFVDVAERLAVDRATALFGAAHANVQSHSGSSAVLAAYAALLRPGDTVLAMGLPFGGHLTHGSPANFSGRWFDFVGYGVDAETGLIDYEQVRTLARSHRPKAIVCGSISYPRHIDYAAFREIADEVGAHLIADAAHPIGLVAGGAAPNPVPYADVVCATTHKVLRGPRGGMILCGGELAERIDRAVFPFTQGGAQMHTIAAKAVAFGEAATPAFAAYARQVVANARVLAERLAAEGLAITTGGTDTHLLTVDPAPLGVEGRTARGRLAAAGMVLDTCALPHGDARGLRLGTAALTTQGMGETEMARVAKLFAGVLRDETDSKTAREEVRELAGGFPPYPGR

SEQ ID NO: 18955 - protein, 715 aa, Mesorhizobium loti
MFNQHKVEIEWGGRPLILETGKIARQADGAVLATYGETKVLATVVSMKEPKPGLDFFPLTVNYQEKTYAAGKIPGGYFKREGRPSEKETLVSRLIDRPIRPLFADGYKNDTQIVVTVVQHDLENDPDILSIVATSAALTLSGVPFMGPVGGARVGYINGEYVLNPHIDEMQESKLDLVVAGTADAVLMVESEAKELGEELMLGAVMFGHKGFQPVIDAIIKLAEVAAKEPRDFTAPDYSALEGEMLKIVGDELSNAYKITDKQQRYAAVDAVKAKVKAAFAPAEGEEPKYTSEQIGSVFKELQAKVVRWNILDTGSRIDGRDLKTVRKIVSEVGVLPRTHGSALFTRGETQALVVATLGTGEDEQYVDSLTGMYKEKFLLHYNFPPYSVGETGRMGSPGRREIGHGKLAWRAIRPMLPSADQFPYTLRVVSEITESNGSSSMATVCGTSLALMDAGVPLAKPVAGIAMGLIKEGERFAVLSDILGDEDHLGDMDFKVAGTANGITSLQMDIKIEGITEEIMKIALDQAKDGRQHILGEMAHALTGARPELGEFAPRIEVMHIPTDKIRDVIGSGGKVIREIVEKTGAKINIEDDGTVKIASSNAKEIEAAKKWIHTIVAEPEVGEIYEGTVVKTADFGAFVNFFGPRDGLVHISQLANERVAKTSDVVKEGDKVWVKLMGFDERGKVRLSMKVVDQATGKEIVRDKRAEGEEDAA

SEQ ID NO: 18956 - protein, 429 aa, Unknown
  Azoarcus sp. BH72
MNTPGAVPPDKAVAVAPGVHWVGALDPDLRQFDIILRTANGTSYNAYAIRGTAGVAVVDTVKAEYADVFFQRLWSCCRPEEIKAIVLNHLEPDHSGALPELLRAAPQAPLYISRPAFAMLKGILKDGLDPSRIIATEPETRVELGGRSLRFLQTPYLHWPDTQCTWVEEDGFLFSGDVFGCHFCDPRLFNDKVGDFRFSFDYYYQHIMRPFREHVLTALKLVEPLTLRLIAPAHGPVLRDAPQTYVRRYRQLATPQLQNEAAERAKTLLVFYISAYGNTQQMAHAVREGAESVDGVRVSLYDLAGGETAPFVDLIEEADGLVFGSPTINGDAVKPVWDLLSSLTLVNVRGKFGAAFGSYGWSGEAVGLIEDRLRGLKLRVPRPGVKVKLIPTAEELAECATLGRELAEQLTGKAGPRHIDFSALHARSA

SEQ ID NO: 18957 - protein, 533 aa, Candida glabrata
MQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGY

SEQ ID NO: 18958 - protein, 708 aa, Aspergillus oryzae
MARRYMIPWLYDLGIWIFTLCLDIFFREVYSRGAWRIPRRGPVIIVAAPHANQFVDSILLMRILKHAANRRSSFLIAEKSMREPYIGTMAGCMGALPVVRAQDNVKPAEGKIYLPDPDNDPTLVRGKGTDFTNKLFMEGGTIILPRVGKTSPEQQAIAQIIGPEELRLRKPFKQFDQDHPLYDALRTGTTFKVAPHIDQREMFDAVYSELIAGGCIGIFPEGGSHDRPSLLPLKAGVAIIALGALAQDPNCGLSIIPCGMNYFHPNKFRSRAVVEFGNPVHVHPDQVEAFRAGGTSKRNAVGSLLETINEALTAVTQQAPDHETLMLVQATRRLYRPLRMKLPLPIVIEVNRRLLKGYTQFKDDPKVIQLKKAISDYNRRLRALGIRDHQVEWGDVKHRPWWIVFCTLLYRVGELLTLAVGTLPSVALFWPVFVTAKVISVKKQRAALAGSVVKLEGRDVVGTWKILVAMGLAPALYTWYTVVVTTWLHYCRHEGHYCAVSPWWTNPRTYVPDSIPLWLFSMFFFGLMISVSFAGLRIGEIGMDVLKSLPPLLVALNPISANSLAKLREERQALSTKVVDTIDTFAPEIFPDFEHEKLVPHGYPHDDTYQSRLKSMPPSEPESRNTSKTRGSRSRSRSAGFLQDTLLKPLTIGSKDDLGEVNRRIRDSMKERGRERVRAQYDSDADAVLVDGSGGSDSGDAVEEKKTR

SEQ ID NO: 18959 - protein, 619 aa, Oryza sativa
MSLRLRLAFRLLFCYCLLLAAAHPSSRRLLPLLVVSAAERTNVASLPGLDGALPSRFETGYVTVDEENGGELFYYFIESEGDPGADPVLLWINGGNRCSVLSALFFEIGENLNHHRSPAGAPPLTRLCAAGPVKLAIEPYDGGVPRLRYNPYTWTKVASVLFVDSPVGAGFSFSRDPRGYDVGDVSSTLQLTKFVNKWFSQHREFLSNPLYVGGESYAGKLVPFLVQKISEDVEAGVKPVLNLKGYLVGNPGTGESIDYESKVPYAHGVGIISDQLYETILEHCGREDYANPKNATCAQALNRFSELMGEVSEAHILYKKCIYVSPKPDDGTIGRKILEEIVVGNHRPPRPPMDCSTYPNYLSYFWANSNNTRENLGIKKGTVDEWVRCHDDGLPYSQDIESSIKYHQNLTSRGYRVLVYSGDHDSVVPFLGTQAWVRSLNYPIVDDWRAWHIDGQSAGFTITYANDLTFATVKFIGQGGSSGEGSAVGDRGSGSGGNNGKGGGGDGDGGDNDYEEAEFGPLLGFDEVLRLTAACGVSLPADMMGAAKDASIREVMLLHHFDLQVVIDSCCATFAEVFELYDPWTDMHATGFMDTAITPSFHSLILHSSLDDIFVIPKE

SEQ ID NO: 18960 - protein, 477 aa, Medicago truncatula
MLEEEIVRNRSHSIDGIPSQLDPEYFDDDGRPKRTGTIWTTSSHIITAVIGSGVLSLAWATAQLGWIGGPLAMILFSLITLYTSSMLAECYRCGDPVYGKRSYTFVDAVRSILGGRQYTVCGIVQYMYLYGSAIGYSIAAPISMMEIKKSRCLHLSGGKDPCHISSNPYMIGFGVIEIFVSQIPEFHNTWWLSVIAAIMSFGYSTIGVFLAISQTAENGTFKGTLTGGSTENVSTTTEVWGIFQALGDIAFAYSYSQILIEIQDTIKSPPSEIKTMKNAAALSVAVTTAFYLLCGCMGYAAFGEQAPGNLLTGFSMYNPAWLIDFANAAVVIHLVGAYQVYVQPVFAFVEKGAAKRWPQTKVEHKIPIPGFRPYNLNLFRLVWRTAFMILTTFVAMLIPFFNDVLGFLGAVGFWPLTVYYPVEMYILQRKIPKWSPKWILLQIISVICFIVSGAAALGSTASIIEDLKHYKPFSSEY

SEQ ID NO: 18961 - protein, 485 aa, Pseudomonas syringae
MSEEILINITPMESRVAVVENGVLQEVHVERTQRRGIVGNIYKGKVVRVLPGMQAAFIDIGLDRAAFIHASEISMREGPAVESIASLVHDGQSLVVQVTKDPIGSKGARLTTQLSIPSRYLVYMPRTAHVGISLKIEDEAERERLKKVVSDCVAQEGIKEAGGFILRTAAEGAGADEILMDIRYLRRLWDQIGEQIKTVSPPTVIYEDLGLALRTLRDLVSPRIEKIRIDSRETFQKTTQFVAELMPEIADRLEHYPGERPIFDLYGVEDEIQKALERKVPLKSGGYLVIDPAEAMSTIDVNTGAFVGHRNLEETIFKTNLEAATAIARQLRLRNLGGIIIIDFIDMEDGEHQRQVLRTLEKQLERDHAKTNIIGITELGLVQMTRKRTRESLEQVLCEPCHCCAGRGKLKTPETICYEIFREILREARAYQAVGYRVLANQRVVDRLLDEESGNVAELESFIGRTIRFQVETMYSQEQYDVVLL

SEQ ID NO: 18962 - protein, 320 aa, Pseudomonas putida
MSEVRHSRVIILGSGPAGYSAAVYAARANLKPLLITGMQAGGQLTTTTEVDNWPGDPHGLTGPALMQRMQEHAERFETEIVFDHINAVDLANKPFTLQGDSGKYTCDALIIATGASARYLGLPSEETFMGKGVSACATCDGFFYRNKPVAVVGGGNTAVEEALYLANIASKVTLVHRRETFRAEKILVDKLNARVAEGKIELKLNATLDEVLGDNMGVTGARLKNNDGSSDEIKVDGVFIAIGHTPNTSLFEGQLTLKDGYLVVNGGREGNATATNVEGVFAAGDVADHVYRQAITSAGAGCMAALDVERYLDGLANASF

SEQ ID NO: 18963 - protein, 98 aa, Anabaena sp.
ATFKVTLINEAEGTKHEIEVPDDEYILDAAEEQGYDLPFSCRAGACSTCAGKLVSGTVDQSDQSFLDKDQIEAGYVLTCVAYPTSDVVIQTHKEEDLY

SEQ ID NO: 18964 - protein, 456 aa, Chlorobium tepidum
MSLTNGVAPSLEKLAAEQKSRKKWLLVQPKSQTSMMVDSGAVSMPLNLIMVATLASKYFDVTFLDERTGDTIPQDFSGYDVVAITSRTLNAKNAYRIGDRAKAQGKIVLIGGVHPTMLTDEASLHCTSVIYGEIESVWEELAIDIFRGKMKSVYKASNLKPMTTMTPPDFSFALNSPHAKKYSQLIPILATKGCPVGCSFCTTPTVYGKSFRYREIDLVLDEMRAHQERLGKKKVRFSFMDDNISFRPKYFMELLEGMAKLGVRWNANISMNFLQKPEVAELAGRSGCELMSIGFESLNPDILKSMNKGSNRLQNYEAVVSNLHKHKIAIQGYFIFGFDDDSEKSFQATYDFIMQNRIEFPVFSLLTPFPGTPYFEEMKDRVRHFDWDKYDTYHYMFEPKKLGGEKLLENFIKLQREVYKGSAIMKRMQGKPLNWVWFVNFLMNRFTRKLTPEMYL

SEQ ID NO: 18965 - protein, 98 aa, Anabaena sp.
ATFKVTLINEAEGTKHEIEVPDDEYILDAAEEQGYDLPFSCRAGACSTCAGKLVSGTVDQSDQSFLDDDQIEAGYVLTCVAYPTSDVVIQTHKKEDLY

SEQ ID NO: 18966 - protein, 538 aa, Hordeum vulgare
MAFEVVAAQLARLSDALATSDHASVVSINLFVALLCACIVLGHLLEENRWLNESITALIIGLCTGVVILMTTKGKSSHVLVFSEDLFFIYLLPPIIFNAGFQVRKKQFFRNFMTITSFGAVGTMISFFTISLAAIAIFSKMNIGTLDVSDFLAIGAIFSATDSVCTLQVLNQDETPFLYSLVFGEGVVNDATSVVLFNALQNFDPNQIDAIVILKFLGNFCYLSVSSTFLGVFSGLLSAYIIKKLYIGRHSTDREVVLMMLMAYLSYMLAELLDLSGILTVFFCGIVMSHYTWHNVTESSRVTTKHAFATLSFIVETFLFLYVGMDALDIEKWKFASDSPGKSIGISSILLGLVLVGRAAFVFPLSFLSNLTKKTELEKISWRQQIVIWWAGLMRGAVSIALAYNKFTRSGHTQLHGNAIMITSTITVVLFSTMLFGILTKPLIRFLLPASSNGDPSEPSSPKSLHSPLLTSMLGSDMEAPLPIVRPSSLRMLITKPTHTIHYYWRKFDDALMRPMFGGRGFVPYSPGSPTDPNVIVA

SEQ ID NO: 18967 - protein, 316 aa, Wolinella succinogenes
MVLDVAIIGGGPAGLSAGLYATRGGAENVVLFEKGMVGGQITSSSEMENYPGVAHVMSGLDFMEPWREQCFRFGLQHEMAEVSRIARQSEGNFAIHLSDGRIFEARSVIVTTGGKPKKAGVKGELEFFGRGVSTCATCDGFFYRNRDVAVIGGGDTALEEALYLANICSHVYLIHRREEFRAAPLSVEKVKKNPKITLLTSRVIEEIVGDASGVNGVKIRHKESKEVETLSVMGVFVFVGYDVNHQVLKQEDGSFLCEVNEKGEVVVDLSMKTNIPGLFAAGDLRIEAPKQVVCAAGDGASAALSALAYLEHLKES

SEQ ID NO: 18968 - protein, 173 aa, Unknown
  delta proteobacterium MLMS-1
MEVLFDAATISRRVAELGRRISAAYQGRELALVGVLNGGFMLTADLARALSLPAVTIDFIRAASYGDAAASGGRVRLGALDFDPARRHVLLVEDIVDSGHTMARLREHLLAHQAASVAICALIDKKERREVEVVVEYPGFAVNHGFLVGYGLDYAQQHRHYPAIYRLDEETLS

SEQ ID NO: 18969 - protein, 98 aa, Anabaena sp.
ATFKVTLINEAEGTKHEIEVPDDEYILDAAEEQGYDLPFSCRAGACSTCAGKLVSGTVDQSDQSFLDDDQIEAGYVLTCVAYPTSDVVIQTHKEKDLY

SEQ ID NO: 18970 - protein, 609 aa, Schizosaccharomyces pombe
MIQTASTISSNGGTNQGMESSSANSPEMNGTQNSMSVGMSGSGSSQNRKITQFSNKLYNMVNDSSTDSLIRWSDRGDSFLVIGHEDFAKLVLPRYFKHNNFSSFVRQLNMYGFHKVPHIQQGVLQSDSPNELLEFANPNFQRDQPELLCLVTRKKAGSQPVEESNTSLDMSTISSELQNIRIQQMNLSNELSRIQVDNAALWQENMENRERQRRHQETIDKILRFLASVYLDGKQKPPSKVMPKSRRLLLEAKYPTVSPTNEPSAHSRPSPQGTTANSSSASISSLHNTTPDGEGKYRSVQNGRALNYVSSFNSDSHSPKDYISQSYTNEPGLKKESADSFNNSIDSYISPNQSPNTDVPSLNRDDTTDPKVVNTGDIINMLDDANSIEGSNMNSLSPLLFDYPNSLYPVNNTSSEQHHNSYRGSVSNSQPSGNLSESTNLQPVQPVDYMSNSNPSYGSYNAEDQLTNFHPGYAMDQKRISKLSDGITKQDQNIQALADILGIPLGDGKIDDAGFSANSPTNLNLPVSSDLDSVLNIPPNEDVFPDSNPVFDEFTNISNLTSPIEASNGNTFGSNPVSLPNQQKSVNPSLMTVSSPRQVRKKRKSSIGA

SEQ ID NO: 18971 - protein, 466 aa, Medicago truncatula
MEVEHSIEAVPSHKDSKLYDDDDRLKRTGTVWTTSSHIITAVVGSGVLSLAWAIAQLGWVIGPSVMIFFSLITWYTSSLLAECYRIGDPHYGKRNYTFMEAVHTILGGFNDTLCGIVQYTNLYGTAIGYTIAGAISMMAIKRSDCLHSSGGKDSCHISSNPYMIAFGVIQIFFSQIPDFDKMWWLSIVAAIMSFTYSFIGLGLAIAKVAENGSFKGSLTGVSIGTVTKAQKVWGTFQALGNIAFAYSYSQILIEIQDTIKNPPSEVKTMKQATKISIGVTTAFYMLCGCMGYAAFGDTAPGNLLTGIFNPYWLIDIANAAIVIHLVGAYQVYAQPFFAFVEKIVIKRWPKINKEYRIPIPGFHPYNLNLFRLIWRTIFVITTTVIAMLIPFFNDVLGLLGAVGFWPLTVYFPVEMYIKQKKIPKWSYKWISMQILSVVCLVVSVVAVVGSVASIQLDLKKYKPFTM

SEQ ID NO: 18972 - protein, 234 aa, Oryza sativa
MAGGGDELKLLATWFSPFASRVKFVFHLKGLSYENIEEDLKNKSELLLKSNPVIKKVPVLLHNGKPLCESMVIVEYLDETFAAVGPSVVPADPYERAVARFWVSYIDNKLVAPWFQVFRGKTKEEKAEGLKQMFEATAVMEVAFRECSKGRPFFGGDAVGIVDVALGSQLGWLRASETLSGIKLFDPAKTPLLLAWAERFLALDAAKASMPESGRLLAYAKMRQAETDAANASK

SEQ ID NO: 18973 - protein, 258 aa, Lactobacillus plantarum
MHVALAQLNIQFGDPDANYEQIEMAIQRAAEQTVDVIVLPEMWNTGYALTRLNVLADDDGQRTLQLLSKLAQQFCVNIVGGSVAVARDGHYYNEMLVVDRQGQLLSRYDKVHRFGLMAEDRYITAGETENVFELDGTVAMGAICYDIRFPEWLRKQAARGPQVIFFSAEWPTVRQMQWRLLLQARAIENQAFVVAVNRVGSDPDNQFGGQSLVIDPLGQIVAIGGAHAQLITAELDLTQVDQVRGQIPVFEDRRPELY

SEQ ID NO: 18974 - protein, 448 aa, Streptococcus pyogenes
MSKKLISIVNVKDYVGQEVTIGAWVANKSGKGKIAFVQLRDGSAFFQGVAFKPNFIEKYGEESGLEKFDVIKRLNQETSVYVTGIVKEDERSKFGYELDITDLEIIGESHEYPVTPKEHGTDFLMDNRHLWLRSRKQMAVMQIRNAIIYATYEFFDQNGFIKFDSPILSENAAEDSTELFETDYFGKPAFLSQSGQLYLEAGAMALGRVFDFGPVFRAEKSKTRRHLTEFWMMDAEYSFLSHEESLDLQEAYVKALIQGVLDRAPQALDILERDVEALKRYITEPFKRVSYDDAITLLQEHEADEDTDYEHLEHGDDFGSPHETWISNYFGVPTFVVNYPASFKAFYMKPVPGNPERVLCADLLAPEGYGEIIGGSMREDNYDALVAKMDELGMDKSEYDFYLDLRKYGSVPHGGFGIGIERMVTFVAGTKHIREAIPFPRMLHRIRP

SEQ ID NO: 18975 - protein, 308 aa, Geobacillus stearothermophilus [sequence omitted]

SEQ ID NO: 18976 - protein, 651 aa, Coprinopsis cinerea
MTFPPIPNNTLPALSLVKSTLPANLDPASVDAKAIAQGWLAAFRQVVSEQPSPDAVVSLFVPASSGAQVWWRDMLALTWDFRTFVGADAIRQFATDRLSGSAAQELNLHDIQLVETASDITLPPVYTPASPDLVWIQFFITFKTAVGHGSGIIRIVPVGVSDLPSFQDSKNWKAHIIYTNLEGLLDHPERIGALRDPRPNHGLWAGARQKEVECEGEKGKPTVLIVGGGQSGLEIAARLKVLGVKSLIIEQNERVGDNWRNRYDALCLHDPVWYDHMPYLPFPPNWPVYSPSVKLANWLEHYAEIMELNIWLSSTVQSVKQDPETGKWDFTILRKVKGPDGTVKEQVREFKAIHHLVMASGLGSGVPEIPSIPGQDKFRNNGGIILHSTEHKRAADHQGKKVVVVGACTSAHDICADYYHNGVDVTMFQRSSTYIMSVENGWKVMFEGVYDENSPPVDVADRLTASFPHWASIPLNQGKVKQVAALDKPILDALHKVGFRTNLGYQDSGFALLAWGRAGGYYLDTGASGLIAEGKIKLKNDSQIKEFTERGLRFEDGSELQADVVLFATGLGDPLKRVGRLLGEDLAKQCTGLWGFNQEGEILGAWRDMGIKRFWYMIGNLALCRFHSKHVALQIKAQEEGLLGKRYSASA

SEQ ID NO: 18977 - protein, 241 aa, Oryza sativa
MAGKDDDVKVLGLVMSPFAIRVCIALKLKGVSYEYIEEDLANKSELLLSSNPVHKKIPVLIHGGKPVSESLVIVQYVDEAWAPSPTSPSILPADPYDRAVARFWAAYVDDKMVPGMVGVLRAATEEERAAKADETLAAMAQLEKAFAEVAAKNGKPFFGGDTVGYVDLALGCNLHFLEAIRRLHGVALVDAGKTPLLAAWAERFVEVEAAKGVVPDADDAVEFARKVQARVAAAAASTAAK

SEQ ID NO: 18978 - protein, 651 aa, Coprinopsis cinerea
MSFPPIPNNTLPALSLVKSTLPANLDPASVDAKAIAQGWLAAFRQVVSEQPSPDAVISLFVPASSGAQVWWRDMLALTWDFRTFVGADAIRQFATDRLSGSAAQELKLHDIQLVETPSDITLPPVYTPASPDLVWIQFFITFKTAVGHGSGIIRIVPVGVSDLPSFQDSKNWKAHIIYTNLEGLLDHPERIGALRDPRPNHGLWAGARQKEVECEGEKGKPTVLIVGGGQSGLEIAARLKVLGVKSLIIEQNERVGDNWRNRYDALCLHDPVWYDHMPYLPFPPNWPIYSPSVKLANWLEHYAEIMELNVWLSSTIQSIKQDPETGKWDVTVLRKVKGPDSAVKEEAREFEAIHHLVMATGQGSGVPEIPSIPGEDRFKRNDGTVLHSTEHKRAADHRGKKVIVVGACTSAHDICADYYHNGVDVTMFQRSSTYIMSVDAGWKGLFEGVYDENSPPVDVADRLTASFPHWASIPLNQDKVKYVAELDKPILDALHKVGFRTNLGYQDSGVALLAWGRGGGYYLDTGASGLIAEGKIKLKNDSQIKEFTERGLRFEDGSELQADVVLFATGYGDPMKRISRLLGEDLAKECTGLWGFNQEGEILGAWRDLGIKRFWYMIGNLALCRFHSKHLALQIKAQEEGLFGKRYSATS

SEQ ID NO: 18979 - protein, 596 aa, Haemophilus somnus
MLYPTLTKTRSLYDLSGLWQFKLGEHNPEKDLSPEEVMVVPTSFNDVVVDKDKRNYIGDFWYERWVDIPKLAENDELVLRFGSVTHNAKIYVNGRELASHKGGFTPFEVIIPEDLYQENQIKISVCANNILDYTTLPVGNYIEETQEDGSIKKVVKENFDFFNYAGIHRPVKLMVRPKIHISDVTIVSELSDDLKTAKLSIAVETSKAVDTIQVTILDEDRQVVAQSSNGHITLEQVRLWEVLDAYLYTAHIELLVDGKVVDTYDEPFGVRSVHVADGQFFVNQKPVYFKGFGKHEDTFINGRGLNEAANLMDMNLLKEIGANSFRTSHYPYSEEMMRLADRMGVLVIDEIPAVGLFQNFTASLDLNPKDNGTWSAMKTREAHEQAIQELVKRDKNHPSVVMWVVANEPASHEAGAHDYFKPLVALYKELDPQKRPVTLVNILLATPERDEVMDLVDVISLNRYYAWYVDHGDLAKGEAGLRQELLKWQSKFPDKPILMTEYGADTLPGLHSMWDIPYTEEFQCDFYAMSHSVFDSIPNLVGEQVWNFADFETNLMIYRIQGNHKGLFSRNRQPKQVVKEFKKRWTAIPNYNYKKK

SEQ ID NO: 18980 - protein, 298 aa, Zea mays
MSAELKRDYEIGEEIGRGRFGVVHRCTSRATGEAFAVKSVDRSRLGDDLDRELAQLEPKLAQLAGAGNPGVVQVHAAYEDEAWTHVVINLCPGPDLLEWVGRRRGAPVPEPVAAAIVAQVAQALALCHRRGVAHRDVKPENILIDAAAGSDDDEEDEAEAAPRARLADFGSAAWVGAGGLGRAEGLVGTPHYVAPEVVAGGEYGAKADVWSAGVVMYALLSGGAFPFGGDSAAEVLAAVLRGSARFPPRLFGGVSPAAKDLMRRMICRDEWRRFTAEQVLAHPWIVSGGGARAMERPT

SEQ ID NO: 18981 - protein, 289 aa, Desulfitobacterium hafniense
MLQDIRIGLAQFEAKVGDTERNLQEIIRTAEVASSQGVSLLCYPECALHGYSPKDASEIADPLDSMAVARLRECARDLGLILLVGMVEKSPEGKKPYISQLIVFPDREPEVYRKVHLGRIEQHYFTAGDSFPIFAAGGVKFSIGICWDWHFPELSAICSLKGAEIQFAPHASPVVSGDRKEIWKRYLGARAYDNSVYLCACNLVGTNNRDKEFSGGILVFGPKGEVLAENQDTQEQLFVVDLPAKPINTLRSPKRQSMRDTFFLADRRKELYKELLELEIEKMPQMSHD

SEQ ID NO: 18982 - protein, 103 aa, Debaryomyces hansenii
MSGRGKGGKGLGKGGAKRHRKILRDNIQGITKPAIRRLARRGGVKRISGLIYEEVRGVLKTFLENVIRDAVTYTEHAKRKTVTSLDVVYALKRQGRTLYGFGG

SEQ ID NO: 18983 - protein, 975 aa, Burkholderia pseudomallei
MKLEHPDRLMNRTPLSLAALETHDAFAERHIGPDAASQQAMLDTLGFATRAALIDAVIPASIRRAETLPLGPFAQPKSEAEALAALRALADKNQVFRSYIGQGYYDTHTPAVILRNVLENPAWYTAYTPYQPEISQGRLEALLNFQQMVADLTGLEISNASLLDEATAAAEAMTLLQRVGKPQSNVFYVADDVLPQTLEVIKTRAKPIGIEVKSGPAADAAAANAFGVLLQYPGANGDVRDYRALADAIHAAGGHVVVAADILALTVLMPPGEWGADVAVGNTQRFGVPMGFGGPHAAYMAVRDEFKRQMPGRLVGVTVDAQGKPALRLALQTREQHIRREKATSNVCTAQALLAIMASMYAVYHGPRGLKTIALRVNRIAALLAAGIRHLGYATVNDTFFDTLTIDTGARTAQLHAFAQAKRINLRRAGDTRVGVSVDETTTRADLADLLTIFAQAAGATAPDIDALDAGLLPAPALPPSLERTSAYLTHHVFNRHHSETEMLRYLRSLSDKDLALDRSMIPLGSCTMKLNATSEMLPVTWPEFGRIHPFAPAEQTVGYREMIDQLEQMLVAATGYAAVSLQPNAGSQGEYAGLLIIHAYHESRGESHRDVCLIPASAHGTNPASAHMAGMKVVVVACDAQGNVDIADLKAKADAHSHDLAAIMITYPSTHGVFEQNVREICEIVHAHGGQVYVDGANMNAMVGLTAPGQFGGDVSHLNLHKTFCIPHGGGGPGVGPVAVGPHLAKFLPNQRSTGYARGEDGIGAVSAAPYGSASILPISWMYIAMMGAKNLTAATETAILNANYIAKRLAPHYPVLYSGPGGLVAHECILDLRPIKDSSGITVDDVAKRLMDYGFHAPTMSFPVPGTLMVEPTESESQEELDRFIAAMIAIRDEIRAVEEGRADREDNPLRHAPHTAAVVTANEWPHAYSREQAAFPVASLVANKYWPPVGRADNAYGDRNLFCSCVPVSDYA

SEQ ID NO: 18984 - protein, 132 aa, Unknown
  Synechococcus sp. CC9605
MRMLHTMLRVADLERSLGFYTEVLGMQLLRRKDYPSGRFTLAFVGYGSEKDHTVLELTHNWDTDSYTLGDAYGHIALGVEDIHSTCAGIADKGGRVVREPGPMKHGTTVIAFVEDPDGYKVELIEMSSKAHA

SEQ ID NO: 18985 - protein, 311 aa, Zea mays
MSAELKRDYEIGAEIGRGRFGVVHRCTSRATGEAFAVKSVDRSRLGDDLDRELAELEPKLAQVAGAGNPGVVQVHAVYEDEAWTHVVMDLCAGPDLLEWVRIRRGAPVPEPVAAAIVAQVAQALALCHRRGVAHRDVKPDNILIDAAAAAAGTDGDGDGEDEEEEGGDGEAEAAPRARLADFGSAAWVGAGGLGRAEGLVGTPHYVAPEVVGGGEYGAKADVWSAGVVMYALLSGGALPFGGESAAEVLAAVLRGSARFPPRLFGGVSPAAKDLMRRMICRDEWRRFTAEQVLAHPWIVSGGGARGMERPT

SEQ ID NO: 18986 - protein, 185 aa, Oryza sativa
GGLEARVPFLDKAFLDVAMNTDAADKMFSKGSLQEVDADGRPRMEKYILRKAFDVIPDDIEAGGDGTGSMLSASAPKKPYLPEDILWRQKEQFSDGVGYSWIDGIKDHAEQSISDEKFQERAKRYPTDTPDTKEAYMIREIFESWFPSDAAASTSVRWIPRADWGCASDPSGRAVKIHESAYADE

SEQ ID NO: 18987 - protein, 468 aa, Salmonella typhimurium
MSKQQIGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENADIANLLLAPYFKKIADEYQQALRDVVAYAVQNGIPVPTFSAAVAYYDSYRAAVLPANLIQAQRDYFGAHTYKRTDKEGIFHTEWLE

SEQ ID NO: 18988 - protein, 1037 aa, Flaveria pringlei
MDRARRLANKAILGRLVSQTKHNPSISSPALCSPSRYVSSLSPYVCSGTNVRSDRNLNGFGSQVRTISVEALKPSDTFPRRHNSATPEEQTKMAEFVGFPNLDSLIDATVPKSIRLDSMKYSKFDEGLTESQMIAHMQDLASKNKIFKSFIGMGYYNTSVPTVILRNIMENPGWYTQYTPYQAEIAQGRLESLLNFQTMVTDLTGLPMSNASLLDEGTAAAEAMAMCNNIQKGKKKTFIIASNCHPQTIDICKTRADGFDLKVVTSDLKDFDYSSGDVCGVLVQYPGTEGELLDYSEFIKNAHANGVKVVMASDLLALTILKPPGELGADIVVGSAQRFGVPMGYGGPHAAFLATSQEYKRMMPGRIIGVSVDSSGKPALRMAMQTREQHIRRDKATSNICTAQALLANMAAMFGVYHGPEGLKTIAKRVHGLAGTFAAGLKKLGTVQVQDLPFFDTVKVTCVDSKAIAEEAYKHKMNLRIVDKNTITVAFDETITIEDVDTLFKVFALGKPVTFTAASIAPEVQDAIPSGLVRETPYLTHPIFNMYHTEHELLRYISKLQSKDLSLCHSMIPLGSCTMKLNATTEMMPVTWPAFADIHPFAPTEQAQGYQEMFKNLGDLLCTITGFDSFSLQPNAGAAGEYAGLMVIRAYHMARGDHHRNVCIIPVSAHGTNPASAAMCGMKIITVGTDSKGNINIEELRKAAEANKENLSALMVTYPSTHGVYEEGIDEICKIIHDNGGQVYMDGANMNAQVGLTSPGWIGADVCHLNLHKTFCIPHGGGGPGMGPIGVKKHLAPYLPSHPVVATGGIPAPEQSQPLGTIAAAPWGSALILPISYTYIAMMGSQGITNASKIAILNANYMAKRLENHYPILFRGVNGTVAHEFIVDLRPLKTTAGIEPEDVAKRLIDYGFHGPTMSWPVPGTLMIEPTESESKAELDRFCDALISIRQEIAEIEKGNVDLNNNVIKGAPHPPQLLMADKWTKPYSREYAAYPAPWLRAAKFWPTTCRVDNVYGDRNLICTLQPPQEYEEKAEATA

SEQ ID NO: 18989 - protein, 293 aa, Zea mays
MTEQLNREYDIGDEIGRGRFGVVRRCVSRATGDAFAVKSVDRSLLGDDLDRALAELEPKLARLAGGEGDGNPGVLQVRAVYEGDAWTHTVMDLCTGPDLLDWIRLRRGAPVPEPDAARVVAQLAEALAGCHRRGVVHRDVKPDNVLLDVDPAGEAPPRVRLADFGSAAWLGEGARGRAEGLVGTPHDVAPEVVAGGEYGEKVDVWSAGVVMYALLSGGALPFGGETAADVFAAVLRGSLRFPPALFAGVSPAAKDLMRRMMCRDVSRRFSAEQVLRHPWIQSGGGGRELVRPT

SEQ ID NO: 18990 - protein, 348 aa, Geobacillus kaustophilus
MQHIVDVLVIGASQAGLAMGYYLKQNNILFAIVGKENRIGDVWRNRYDSLVLFTPRWFSSLPGMALKGDPNGYPTKDEIADYLEDYAQKFELPIHLNTEVISLQKEDEIFKVTTNNGNYVAEKVVVATGPFQKPYIPPFAESLSDKVYQVHTSRYLNPSQLQEGSVLVVGAGNSGAQIAVELSEDREVYLSVGHKMKFFPLEIMGKSIFWWFKKLGLLNVHINSSLGQFISKQSDPIFGKELKHLIQEGKIKIKPRTESILGDVISFADNSQIQVQNVIWATGFYSDYSWIQIPNVLDHRGKPIHQRGVTSVKGLYFLGLPWQYRRGSALIGGVGADAEYLINDILNH

SEQ ID NO: 18991 - protein, 570 aa, Helicobacter hepaticus
MKVMKGAQMLIQALHLEGVKVVFGYPGGAVLHIYDEIYKQNYFSHILARHEQGAVCAADGYARSSGEVGVAIITSGPGFTNAITGIATAYTDSIPLVVISGQVPITQIGTDAFQEIDAVGISRPCTKHNFLVRNISELPRILKEAFYIARSGRQGPVLVDIPKDITGTLGEFAYPESISLQSYKPTIKGNSRQIKKLCEAIMSAQKPLFYIGGGAILSNASEIIREIVHCTGIPCAETLLARGVLRYDDENLLGMLGMHGSYAANMAVSECDLLVCLGARFDDRVTGKLSEFAKNAKIAHIDIDPSSIGKIIAVDYPIVGDLKHIVSDMMIELSGYDTQKIMRWREHLRSYALTHPMSFEDSVDSIKPQWVIQRLGEHLGDNAIITTDVGQHQMWAAQFYPFSFPRQFLSSGGLGTMGYGLPAALGAKLACPHKTIINITGDGSILMNIQELMTCVVYGIPFVNVILNNNYLGMVRQWQSFFYEHRFSHTDLSLQPDFIKLIESFGGVGFRVEKKCEFDEAFKKALDAKKVAFIEVMIDRYEDVLPMVPSGGAIYEMILSSGEKALREGK

SEQ ID NO: 18992 - protein, 563 aa, Ashbya gossypii
MSEITLGRYLFERLKQVEVRTIFGVPGDFNLSLLDKVYEVDGMRWAGNANELNASYAADGYARVKKISCLVTTFGVGELSALNGIAGSYAEHVGVLHVVGVPSTSAQAKQLLLHHTLGNGDFTVFHRMSANISDTTAVITDISSAPAEIDRCIRACYVHQRPVYLGLPANMVDLTVPASLLNTEIDLSLKPNDPEAEEEVVSTVLELVANAKHPVILSDACASRHDVKQETKQLIDVTQFPAFVTPMGKGSIDEQHPRFGGVYVGTLSAPDVKEAVESADLILSVGALLSDFNTGSFSYSYKTKNIVEFHSDHTKIRSATFPGIKMKTVLQNLVKRIGEAAKGYQPSPVPTYAAPNEDADPKTPLKQEWLWNQVSSFLKEGDIVITETGTAAFGINQTRFPSSTIGISQVLWGSIGFTTGACLGAAFAAEEIDPNKRVILFIGDGSLQLTVQEISTMVRWGLKPYLFVLNNDGYTIERLIHGETAQYNCIQPWKHLDLLPTFGAKDYETHRVATTGEWRALTEKQEFNKNSSIRMIEIMLDVMDAPSSLIKQAKLTAATNAQP

SEQ ID NO: 18993 - protein, 103 aa, Triticum aestivum
VPASRRAGPWTGTSSRSGWWSFVRTALEQTRLRTALTPHPLQEKFRLIRANDDATVLDALSFSARKIRLLRSLTVEKKNYVQEPSLVDMHEEEEIVSPHKEDA

SEQ ID NO: 18994 - protein, 483 aa, Medicago truncatula
MVEHSSGTNLSYRGDIVGMEGGTSLQDDSKYYDDDGRVKRTGTIWTTCSHIITAVIGSGVLSLAWSIAQMGWVAGPGAMIFFSIITLYTSSFLADCYRCGDTEFGKRNYTFMDAVSNILGGPSVKICGIVQYLNLFGSAIGYNIAAAMSMMEIKKSLCVHTSDGKDACHISGNPYMIAFGVAQLFLSQIPDFHNMWWLSIVAAVMSFFYSTIALALGISKVAENGTVMGSLTGVSVGTVTPAQKVWGVFQGLGNIAFAYSYSFVLLEIQDTIKSPPSEGKAMKIAAKISIAVTTTFYLLCGCMGYAAFGDNAPGNLLAGFGVSKAYWVVDAANAAIVIHLFGAYQVYAQPLFAFVEKEAAKKWPKIDREFKVKIPGLPVYSQNIFSLVWRTVFVIISTLIAMLIPFFNDVLGVIGALGFWPLTVYFPVEMYIVQMKIPKWSRKWIILEIMSTFCLIVSIVAGLGSLVGVWIDLQKYKPFSLSN

SEQ ID NO: 18995 - protein, 570 aa, Kluyveromyces lactis
MSLSDDEDFNDIYGDENTAQTTVNNNESTSSTATSTDNQNNTQSNNNQNNVSNSSTDDHKDQASTTNKEANSSSTNTTAATSQLDQLAALQALSSNLSQLQQQVASSNNQPDSNLASNNDKAENNNKENYSASVPEMLQMPQMPQMPGMPDMSQLQQLQQTMSQLQQTASQHEPKAIKADLSRDINKMFIGGLNWETTEEGLRDYFSKYGAVAEVKIMKDTATGRSRGFGFLTFENASSVDEVVKTQHILDGKVIDPKRAIPREEQDKTGKIFVGGIGPDVRPKEFEEFFSQWGSIIDAQLMLDKDTGRSRGFGFITYDTPDAVDRVCQNKFIEFKGKQIEIKRAEPRQLQKQKQPQMTQPMGQNMSNPMQQYQMFQNPMMAGGFNPMMATGFNPQSMNEYYTKMQEYYQQMQQQTGIDYTQMFQQQMQQMQQMMGMMGGLPAGQQPSQSGAGSPPSHSSTPQHNDDSNGVTTIGSSNNGNRSNSGVESGDDSRYDNSSSRDDSRRSGHRAYDRNSDRSSYGSSNRDRDSCRGPSSNYRGGGGRDRDSRRGGNGYGGGSRDRRGYHPYAR

SEQ ID NO: 18996 - protein, 487 aa, Bordetella parapertussis
MTEDILINVTPFETRVALVEQGAVQELHVERSVQRGHVGNIYLGRVVRVLPGMQSAFIDIGLERAAFIHIADLRENRSERSQGQTPTPIEKLLFEGQTLMVQVIKDPLGTKGARLSTQISIAGRMLVYLPHDPHIGISQKIDSESERTQLRERLQALMPPEEKGGFIVRTQAEGATDEEIAADLEYLRKLWASVQAAARSQPAPTALHQDLTLGQRVLRDMVGPHTGTILVDSRSTSSALQEWARVYTPSVAERIRHYSGERPLFDTANVDEEIARALSRRVDLKSGGYLIVDQTEALTTVDVNTGGFVGGRNFDDTIFKTNLEAAQAIARQLRLRNLGGIVILDFIDMEDPDHRETVLAELKKALSRDRTRMTVNGFTQLGLVEMTRKRTRDSLAHQLCEPCPMCQSRGNVRTARTVCYEILREILREARQFNPREFRILAAQGVVDLFLEEESQHLAMLGDFVGKQISLEVESQYSQEQYDIILI

SEQ ID NO: 18997 - protein, 191 aa, Zea mays
MGFSEAQEELVLRSWKAMKSDSESTALKFFLRIFEIAPGAKQMFSFLRDAGDAPLEKHPKLKAHAVTVFVMACESATQLRSTGDVKVREATLKRLGATHARAGVADAHFEVVKTALLDTIRDAVPDMWTPEMKAAWEEAYDQLAAVIKEEMKNAAAAEEQTKNAATAAEETTNAAAAEEETTNAAAAVDAS

SEQ ID NO: 18998 - protein, 573 aa, Candida albicans
MCGIFAAYRQPEVEDFKSKALQYSKLIRHRGPDWSGNVVQNSTILCHERLAIVGLDSGAQPIVSPDGNFTLAVNGEIYNHIQLREQFPDYKFKSLSDCEPIIPLFTKYDIDAPKHLDGMFAWVLYDKKNDRIVAARDPIGITTLYMGKSSKSPKTRYFASELKCLIEECDEIFAFPPGHVYDSNTDEITRYFKPSWWDASKVPEQHVDFKKVRETLELAVRKRLMAEVPYGVLLSGGLDSSLIASIASRETKKAAQASFNPEGIDANKELSGVDDKGSLHSTGVFNQLHSFAIGLPGAPDLLAAEKVAHFIGTIHHSHTFTLEEGLDALDDVIYHLETYDVTTIRASTPMYLLSRKIKAQGVKMVLSGEGSDEIFGGYLYFANAPSAKEFHEECVKRVKNLHYADCLRANKSTMAWGLEARVPFLDKQFLEVCMNINPEDKLIQPGKIEKYILRKAFDTSDEPDVKPYLPEEILWRQKEQFSDGVGYSWIDGLKDTAEKMVSDEEFAHPKPEWGDDIPTTKEAYWYRCKFDKMFNGSKAAASTVMRWIPKAEWGCHADPSGRYAATHDHKVAQ

SEQ ID NO: 18999 - protein, 349 aa, Unknown
  marine gamma proteobacterium HTCC2207
MEQGFLTTNNNYKIAVLGAGSFGTVIANMLAVNGFATTLWMRSDKQLQAINSIGENAAYLPGYQFDPTLRFTTELEQALEGADTVFFAVPSSALRQVAKLAKAWINTDALLISTAKGIEADSFALPSQILEQELPDAKVGVLSGPNLAKEIASYEITATVIASEHDEVCIRAQEILASKYFRIYANHDRYGVELAGALKNIYAIVAGIAEAMKVGQNTKSVVLTRSLAEMSRFACQLGADPLTFLGLSGVGDLYVTCSSPLSRNFRIGVALGSGNSLDQAIIDVGQVAEGVNTTKLVKERADELGIYMPLASALYATMFEQRPIVESLRTMMVAEQNTDVEFMVKPNDR

SEQ ID NO: 19000 - protein, 105 aa, Candida glabrata
MLMPKEERTKIHRHLFQEGVVVAKKDFNQPKHDEIDTKNLYVIKALQSLTSKGYVKTQFSWQYYYYTLTEEGVEYLREYLNLPEHIVPGTYIQNAQQAQRPNRRY

SEQ ID NO: 19001 - protein, 322 aa, Pyrus pyrifolia
MENFPVINLESLNGEGRKATMEKIKDACENWGFFELVSHGIPTELLDTVERLTKEHYKQCLEQRFKELVASKGLEGVQTEVKDMDWESTFHLRHLPQSNISEVPDLKDEYRNVMKEFALKLEKLAEQLLDLLCENLGLEQGYLKKAFYGTKGPTFGTKVSNYPPCPNPDLIKGLRAHTDAGGLILLFQDDKVSGLQLLKDGEWVDVPPMRHSIVINLGDQLEVITNGKYKSVEHRVIAQTDGTRMSIASFYNPGSDAVIYPAPTLVEKEAEEKNQVYPKFVFEDYMKLYAGVKFEPKEPRFEAMKAVEIKASFGLGPVISTA

SEQ ID NO: 19002 - protein, 169 aa, Methanothermobacter thermautotrophicus
MMCLSRYEKATFGAGCFWGVEDAFRKVDGVVSTRVGYMGGHLENPTYEDVCTGLTGHAEVVEVTFDPDVVGYSDLLDVFWSIHDPTTLNRQGPDVGEQYRSVIFYHSDEQRRAAIESRRRLEESGRFRDRIVTAIEPAGTFYEAEEYHQQYLEKNPRRRCYLMRLLSTR

SEQ ID NO: 19003 - protein, 403 aa, Oryza sativa
MVVGAGGGDELKLLGVWDSPYVNRVQIVLNLKGLSYEYVEEDLMNKSDLLLGSNPVHKKVPVLIHNGKPIAESRVIVEYLDEAFAAGAGGSTGASVLPSDPYERAVARFWAAYVDDKVGSPWYTILFARERGEKVEAAARAISALETVEAGAFRDRSSEGKTTNAAAAPFFGGDSIGFVDVVLGSYLGWFRVIEKMIGVRIMDAARTPRLAAWAERFEAADAVRGVLPDDVDKRGSGSERRRVAETGGASASAGERQLPARVEQRGGGRGGGGGGGAQRASSNGRDVDVKTALATPPCASAPLARVCHCEKERPLCSLSSRWPLASLLFSIGLVGRRAPRFPRPFASPVPGAALARRSRRSACSSHMPPRYRSPSAANTEMKRREKRKLKKIADPIVFLLTYI

SEQ ID NO: 19004 - protein, 472 aa, Staphylococcus epidermidis
MGSTVKYRKFILPIVVGLIIWALTPIKPDALNDQAWFMFAIFVSTIIACITQPMTIGAVSIIGFTIMILVGIVDTKTAVQGFGNSSIWLIAMAFFISRGFVKTGLGRRIALQFVKLFGKKTLGLAYSLVGVDLILAPATPSNTARAGGIMFPIIKSLSESFGSSPRDGSERKMGAFLIFTEFQGNLITSAMFLTAMAGNPIAQSLAEKTAHVQITWMNWFVAAIIPGLISLIVVPFIIYKLYPPTVKETPNAKKWATEQLEEMGHMSIAEKLMVGIFIIALALWVLGSFINVDATLTAFIALALLLLTGVLAWSDILNETGAWNTLVWFSVLVLMAEQLNKLGFIPWLSKLIAQGLNGFSWPIVLVLLILFYFYSHYLFASATAHVSAMYAALLGVAVASGAPPLFSALMLGFFGNLLASTTHYSSGPAPILYAAGYVTQKRWWTMNIVLGIVYFIIWIGVGSLWMKLIGMM

SEQ ID NO: 19005 - protein, 872 aa, Arabidopsis thaliana
MEVSNQTRKRKAIDAGHGSQPTAYRGSDGVDLSLLEALEKSSHNGVEALDLKTLKKLVLSFERRLRDNIAARLKYVENPEKFADSEVDLHDDLQKLKVLAGAPELYPDLVASNTVPSIVNLLSHENSDIANDVVQLLQDLTDEDALEDNDEPARVLVDALVENNVLELLVQNMNRLSEADPDEATAIYATLTVIENLVEVKPAVAQLVCERTKLLRWLLTKIKVREFEGIKQYASEILAILLQNSTANQKRLGQMNGVDAVLEGVAMYKSKDPKTPDEEEMLENLFDCLCCLLMPLENKERFVNAEGVELMIIIMKQKKYAYGSAIRALDFAMTNYPPACERFVDVMGLKTAFAAFMAGILRGSRRDRLLSKFVENEFEKIDRLMELYLRYSDRVRSEAERLDQLELDDLELDEDEKYNRKLESGLYSLQLVAVILGHIWCSEHSGMRARVELLLKQQKLSKTDVKQILQIVVDRHVDVPEWLSGMTRNHVGSARAGSNPAVHVMVPFQALQAFGITVHTVCPGKKAGDSCPTAVHDFCGHQTYSESRGHNFTLNATFDEVDLSKYDGLVIPGGRAPEYLALTASVVELVKEFSRSGKPIASICHGQLILAAADTVNGRKCTAYATVGPSLVAAGAKWVEPITPDVCVVDGSLITAATYEGHPEFIQLFVKALGGKITGANKRILFLCGDYMEDYEVKVPFQSLQALGCQVDAVCPEKKAGDRCPTAIHDFEGDQTYSEKPGHTFALTTNFDDLVSSSYDALVIPGGRAPEYLALNEHVLNIVKEFMNSEKPVASICHGQQILAAAGVLKGRKCTAYPAVKLNVVLGGGTWLEPDPIDRCFTDGNLVTGAAWPGHPEFVSQLMALLGIQVSF

SEQ ID NO: 19006 - protein, 207 aa, Arabidopsis arenosa
MASFEESSDLEAIQSHLFEDLLACDGFMGDFDFDASFVSGLWCIESQVPKQEPDSPVLDPDSFVNEFLQVEGESSSSSSPELNSSSSTYETDQSVKKAERFEEEEEARHYRGVRRRPWGKFAAEIRDPAKKGSRIWLGTFESDVDAARAYDCAAFKLRGRKAVLNFPLDAGKYEAPANSGRKRKRSDVQEELQRTQSNSSSSSCDAF

SEQ ID NO: 19007 - protein, 1138 aa, Unknown
  Synechocystis sp. PCC 6803
MVISATVISMKSPLRRLLLSPVLPILIGAGLSVMTVHTWLFLYNQVQERLKQVLTNRLTNIHEQIENQLNIHVRQLEQMAGRWERSPTGTEQTDWRLDARAQAEGFDGYQTIQWVDPKFVVRWVEPLPDDEHDIDYANQYPHQIQSLELAARQKNTILSGVVDLDQGEKGFLVYVPLFIGDRFDGFVVGVFQLDQFIGSVRPLSGNKPDQDSGLRSFGLRIFEGNQLIYNDVPDDWEQDIVVTQELAWANSLPQAEAMTSRWQLQLVPGPILLDQYGSSQWILFSGLLMAWAVAIAVYYLQKSSKHSEQLSESIKQQQKVEEFLKSTLQELAVQKTALDEAAIVAITDTEGVITYVNDKFVEVSGYSREELIGNTHRLVSSGYHSPEFFQQFWQTIRAGKVWHGQINNRAKAGNTYWVDSTVVPFLDDNGNPYQYLAIRFEITSSKQAEKSLRESEARFRMMADTSPIMLWVADQDKKMTFVNQSWLEFRGATLAEESGNGYLEGIHPDDKGHYLGVYSQAFGDPRRFELEYRYRRVDQQYRWIVNVGVPRYLEDGKFMGYVGSCLDITDRKQAQDILQKKLNQILLMRKISQEIRRSLQPTLIFQTAARQVGNVFAVSRCLIHNYSEATTLQVPVVAEYLGGQFTSLLAGEIAVQQAYDPTIIQGDRAMAVVDLDQDLNSTHTKAFYQRFQVKSFLAVRTSYQGKANGIIALHQCDRQRVWTADEIELLEAIAEQMGIALAQAALLEKERERRRELAQKNLELEKATWAAEAANRAKGEFLAMMSHEIRTPMNGVIGMSELLIMTDLNLQQLDYVQTIRQSGETLLTIINDILDFSKIEADKLVLETQAFELRPLIETVLEMFGPIARAKHLELTYGIDPQTPARILGDQVRLRQILSNLIGNALKFTEKGEVVLTVKGEPFDPAESYHTILNLPHPSHRICFNLRDTGIGIPLDRQDRLFKSFSQVDSSTTRKYGGTGLGLVISQRLTQMMGGVLTVTSEPGVGSNFRFCILTTAQAPALAEADSVQQMKGKQVLIVDDNETNRRILQDQCQAWGLVCHCFTSGESALDWFARCPDLDAAILDLQMPNMDGITLAHHLRQFAQGKDLPIILLSSLVAGGMSCLYFRRCSINQCVSP

SEQ ID NO: 19008 - protein, 161 aa, Zea mays
  misc_feature (147)..(147): Xaa can be any naturally occurring amino acid
MATSASALLSPTTFSTAISHKNPNSISFHGLRPLRLGGSSSALPKLSTTGRKSSSTVVRAELSPSIVISLSTGLSLFLGRFVFFNFQRENVAKQGLPEQNGKTHFEAGDDRAKEYVSLLKSNDPIGFNIVDVLAWGSIGHIVAYYIXLATSSNGYDPSFFG

SEQ ID NO: 19009 - protein, 184 aa, Propionibacterium acnes
MRASDIPGDFDHVLYTEEQVASRIREVAAQIDADYAGREILMVGVLNGAVMTMADLCRAMTSHMSMDWMAVSSYGAGTKSSGVVRILKDLTKDIDGRDILIVEDIIDTGLTLSYLVQNLRSRNPNSIEIMAMFRKPEVVTCPLDVKYVGFDIPNEFVVGYGLDYADKYRNLTDVATLAPHVYKS

SEQ ID NO: 19010 - protein, 637 aa, Oryza sativa
MAGARSAPSVAAAPLPMPLPRPSSSGSTLQKLVGPAAPSLAPLTLRAAFVSFPALLPRPGTSGSALPRPARAGFPPRCPLSHASTAAPFPTQPPSPSSLPLPSSTRFGQPDPLAGRLGRQIRKPSLMRGGTGRRWREKGRRREEGEGWERGVERREAEGPREEGESRREFGGCWILIASKFILQWRPLPTVSENPIFAGGHLREREENTTNTELNQAFAAAAAAACVKLKGVKPMSFGNLGGGGGAGGSGKAAASSFLQLPLSTAAAATAYYGTPLALHQAAAAAGPSQYHGHGHPHHGGGHHHSKHGGAGGGEISAAEAESIKAKIMAHPQYSALLAAYLDCQKVGAPPEVLERLTATAAKLDARPPGRHDARDPELDQFMEAYCNMLAKYREELTRPIDEAMEFLKRVESQLDTIAGGAHGGGAGSARLLLADGKSECVGSSEDDMDPSGRENEPPEIDPRAEDKELKFQLLKKYSGYLSSLRQEFSKKKKKGKLPKEARQKLLHWWELHYKWPYPSETEKIALAESTGLDQKQINNWFINQRKRHWKPSEDMPFVMMEGFHPQNAAALYMDGPFMADGMYRLDGWFELKSKLLVKLLDLDVLLPRAVNFIVSGFGNQACLVKHLEIMYTFPDDN

SEQ ID NO: 19011 - protein, 162 aa, Arabidopsis thaliana
MNRLPSSEDGDDEEFSHDDGSAPPRKKLRLTREQSRLLEDSFRQNHTLNPKQKEVLAKHLMLRPRQIEVWFQNRRARSKLKQTEMECEYLKRWFGSLTEENHRLHREVEELRAMKVGPTTVNSASSLTMCPRCERVTPAASPSRAVVPVPAKKTFPPQERDR

SEQ ID NO: 19012 - protein, 449 aa, Haemophilus somnus
MSAIVSLEDFLAKVEQRDGHQPEFLQAVREVFTSIWPFLEKNPKYRSEALLERLVEPERAFQFRVAWTDDKGQVQVNRAFRVQFNSAIGPFKGGMRFHPSVNLSILKFLGFEQIFKNALTTLPMGGGKGGSDFDPKGKSDAEVMRFCQALMAELYRHVGADTDVPAGDIGVGGREVGYLAGYMKKLSNQAACVFTGRGLSFGGSLIRPEATGYGLVYFAQAMLAEKGQSFAGKTVVVSGSGNVAQYAIEKALQLGAKVVTCSDSSGYVYDPEGFTQEKLTALLDIKNVKRGRVKDYAEQFGLQYVEGARPWGVKADIALPCATQNELELSDAQQLIANGVQLVAEGANMPTTIEATDAFLEAGVLFGPGKAANAGGVATSGLEMAQSSQRLYWTAEEVDEKLHRIMLDIHANCKKYGTVEGQENINYVVGANVAGFVKVADAMLAQGVY

SEQ ID NO: 19013 - protein, 132 aa, Brassica napus
  misc_feature (17)..(17): Xaa can be any naturally occurring amino acid
  misc_feature (29)..(29): Xaa can be any naturally occurring amino acid
  misc_feature (32)..(32): Xaa can be any naturally occurring amino acid
  misc_feature (40)..(40): Xaa can be any naturally occurring amino acid
  misc_feature (48)..(48): Xaa can be any naturally occurring amino acid
  misc_feature (50)..(50): Xaa can be any naturally occurring amino acid
  misc_feature (64)..(64): Xaa can be any naturally occurring amino acid
  misc_feature (67)..(67): Xaa can be any naturally occurring amino acid
  misc_feature (69)..(69): Xaa can be any naturally occurring amino acid
  misc_feature (80)..(80): Xaa can be any naturally occurring amino acid
  misc_feature (82)..(83): Xaa can be any naturally occurring amino acid
  misc_feature (90)..(93): Xaa can be any naturally occurring amino acid
  misc_feature (96)..(96): Xaa can be any naturally occurring amino acid
  misc_feature (98)..(98): Xaa can be any naturally occurring amino acid
  misc_feature (100)..(103): Xaa can be any naturally occurring amino acid
  misc_feature (105)..(105): Xaa can be any naturally occurring amino acid
  misc_feature (107)..(111): Xaa can be any naturally occurring amino acid
  misc_feature (113)..(113): Xaa can be any naturally occurring amino acid
MAYSMLSSAAVVTSPAXATMVAPFTGLKXSSXFPVTRKAXNDITSIVXNXGRVSWMKVWPPVGXKKXEXLSYLPDLTEAXLXXEAYYLLXXXXILXCXLXXXXLXYXXXXXRXRPTPLHFSFPKRSAALPYP

SEQ ID NO: 19014 - protein, 238 aa, Picea glauca
MEHLNTAAAQASSSLYGVGMAEYGDAGVSSMMALITQHEPHDSESIMSTRMPSSFSSFHGHADCLLSAAMFQASQGDHKLKRQPGMDQLVSEQTGMSDSSMPSVKTEVCSGLRNQFEFHREQTGNCYTDQSSNTPVNPLVTSLASQARGEAQMIPSLDANSPHFNVDNEEYAIKSKILAHPQYPSLLGAYIDCQKIGAPPEAVARLDALTREYQNQQRRTVSIGMDPELDQFMEAYCE

SEQ ID NO: 19015 - protein, 266 aa, Zea mays
MPPPAPLFLSLASTPPPALMPVHHPRAPQSLTLVPPVASSRKAAAVPACPVASPRHSDYFDPRAPPPPRGDGGYGRPPNGAQDGRVFTSYSIYKGKAALSFDPRPPLFVPLDSGAYKVAKEGFVLLQFAPAVATRQYDWTRKQVFSLSVWEIGTLLTLGPTDSCEFFHDPFKGRSEEGKVRKVLKIEPTPDGNGRFFNLSVQNRLINVDESIYIPITKGEFAVIVSTFNYIIPHLMGWSTFVSSIKPEESRPYSRPQSTSEYEWRR

SEQ ID NO: 19016 - protein, 494 aa, Helicobacter hepaticus
MDTARNNKDFLNAHGFAKFGGQPAACMNCHSGWTPWLIKNAANGDFTAFNSTKYWTMIKNVPTRNGIEEGSEEHGGPHGGKRMGVTCADCHNPDDMSLRVVRPALINALVDRGYQKDAAQGIKADRKEMRTLVCAQCHVEYYFKPTGEKVKVMGESIASDSSKKWWNGTQKTYDEFEHWRDGNKATEIEVDGINLTFPWSAWKKGEVFRIEMFDEHYDAVRPIFKEDWTHKETKAPMLKIQHPEYEMFSGGVHAANGVSCADCHMPYIKGAGGKKVTQHNVTSPLFDINSACKTCHTQSEEYLKKQIADIQKSVAFDLRSAEYATVSLIFDIKKLREELGKLPAYQSEGKPDDTKISKALAEPLELHRRGQMRGDFVGAENSTGFHNPREASRMLLQAVEMARMGQTKCVEIANANGIKGFKTSNLGFDEIQKFNPGEIVYKIDLNGHTAGERYYKHHEINGEAPQELLELDKNTKPYNFSEVDKISASAKSAK

SEQ ID NO: 19017 - protein, 301 aa, Oryza sativa
MDPTKSSTPPPVMGAPVGFPPGAYPPPPPAGAAAAAYAQQLYAPPAAAAAQQAAAAQQQLQMFWAEQYREIEATTDFKNHNLPLARIKKIMKADEDVRMIAAEAPVVFARACEMFILELTHRGWAHAEENKRRTLQKSDIAAAIARTEVFDFLVDIVPRDDAKDADADADAAADGIPRPADGVPATDPLAYYYVPQQDISTAAVVWALTHVVQHGDTILLLAVMLLPHRAQLWQEVLGVSALCRGLCERPQERVDSEFGCRLFVTSTSTTKARWQWWETAGRWPSSSGGAWACFGRGRAGA

SEQ ID NO: 19018 - protein, 364 aa, Pseudomonas putida
MNSAIGPYKGGLRFHPSVNLGVLKFLAFEQTFKNSLTSLPMGGGKGGSDFDPKGKSDAEVMRFCQAFMSELYRHIGADVDVPAGDIGVGAREIGFLFGQYKRLSNQFTSVLTGKGMTYGGSLIRPEATGFGCVYFAEEMLKRRGQSVEGKRVAISGSGNVAQYAARKVMDLGGKVISLSDSEGTLYCEAGLSEAQWLALLELKNIKRGRISELASAHGLEFRAGQHPWSLPCDIALPCATQNEVDAGAARTLLRNGCVCVAEGANMPTTLAAVDIFIEAGILFAPGKASNAGGVAVSGLEMSQNAMRLLWTAGEVDSKLHAIMQSIHHACVHYGEDNGQINYVKGANIAGFVKVADAMLAQGVV

SEQ ID NO: 19019 - protein, 222 aa, Hordeum vulgare
MAGEKGLVLLDFWVSPFGQRVRIALAEKGLPYEYVEEDLIAGKSDRLLRSNPVHKKIPVLLHDGRPVNESLIILNYLDDAFPDAPALLPSDPYARAQARFWADYVDKKVYDCGTRLWKVKGEPQAQARAEMLEVLKTLDGALGDKPFFGGDKFGFVDAAFAPFTAWFHSYERYGEFSLAEVAPKIAAWAKRCGERESVAKSLYSPEKVYDFIGLLKKRYGIE

SEQ ID NO: 19020 - protein, 373 aa, Rickettsia conorii
MSQNYYQILGVSKTASQADLKKAYLKLAKQYHPDTTDAKDAEKKFKEINAAYDVLKDEQKRAAYDRLGHDAFQNQQSRGGGGNHGGFHPDINDIFGDFFSDFMGGSRRSSRPTSAKVRGSDLKYNLTINLEEAFHGIEKNISFSSAVKCDTCHGSGSEKGETVTTCDACSGVGATRMQQGFFTIEQACHKCQGNGHIIKNPCKKCHGMGRYHKQRNLSVNIPAGVENGTRIRHTGEGEAGIRGGNSGDLYVDITIKPHDIYKVDGANLHCKLPISFVNAALGGEIEVPVIEGGKVNLTIPAGTQNGDQLRLRSKGMSKMRSTIRGDMLTHIHVEVPKNLSKRQRELLEEFKKESINEKENDGSFFNKMKSLWS

SEQ ID NO: 19021 - protein, 173 aa, Oryza sativa
METTGGGGSPKEAVVPSAASGDTTLGRHLAHRLVQVGVSNVFAMPGDLNLTLLDHLIAEPGLHIVGCCNELNAGYAADGYAWARGVGACTVTFTVRGQLLHGRRRRSHRFWNQVTGDEAGAAFRNQECAGAAPSLPSAVARRSGSVVVDGGSASPSSPPSPSSETTASWDRHG

SEQ ID NO: 19022 - protein, 230 aa, Zea mays
  misc_feature (18)..(18): Xaa can be any naturally occurring amino acid
  misc_feature (26)..(26): Xaa can be any naturally occurring amino acid
  misc_feature (49)..(49): Xaa can be any naturally occurring amino acid
  misc_feature (62)..(62): Xaa can be any naturally occurring amino acid
  misc_feature (88)..(88): Xaa can be any naturally occurring amino acid
  misc_feature (108)..(108): Xaa can be any naturally occurring amino acid
LSAADASTVYAITVEGYXERRLGITXSEAPVFMDPHGSGMRALSRSLIXSVLDLGRCTIVSXLSNMDFESYVLSESSSLIYPLEIVVXTCGTTKLLFTIPRILELAQXLFIPVADMKYSRVTVIFPTEQSSPQMSLSDEVAALNRYFGELKSDGDAYVIRDPPTAGQKWHVFYASEYPEIAMWNLEMRMTVLDEMTASVLFKTNADGNSICVKDMTKISGISEMILGMEI

SEQ ID NO: 19023 - protein, 274 aa, Xanthomonas oryzae
MVGGLRLGSGRRCSGRRAGRARLQCGDGLLQRIEFFAGAQQYRALHVELFTGDQVQLAQPGLQRALEGALQFFARLAQARRHQVAEAAGEVVELIEIDHGVLRRSVGSLVQAGTRGTSARQSADSKDSPIRLSSAVTAARSGMSVAAVHGMLRGRHALGPAPMKMIMAIVKPFKLDDVREALAGCGVAGITATEVKGFGRQKGHAELYRGAEYVVDFLPKVKIEVAVTDDQAERVVEAIVAAVGTGKIGDGKVFAYDLGTVVRIRTGELGSDAL

SEQ ID NO: 19024 - protein, 167 aa, Aspergillus oryzae
MSLTRQSHRTVDRDEVERLRKRFMKLDKDSSGTIDRDEFLSLPQVSSNPLATRMIAIFDEDGGGDVDFQEFVSGLSAFSSKGNKEEKLRFAFKVYDIDRDGYISNGELFIVLKMMVGNNLKDVQLQQIVDKTIMEADKDQDGKISFEEFTDMVENTDVSLSMTLSQI

SEQ ID NO: 19025 - protein, 314 aa, Mycoplasma gallisepticum
MMSYRVDGKNDLFDLVIVGSGPAGISAAIYAKRANINVCVVEGSAPGGKILKTGFIDNYPGYSSIKGPDLAVNMLNQLNSLSVPIFYSQVNAIEKQENYFFTYLDSKTLLSKAVIVATGTLERKLGLANEAKFETKGISYCAICDGPLYKNRDVAVVGGGNAAVEESLYLSGICNKVYLVHRRDEFRADSYAVAKLKEKKNVHFLLSHVVDSYLGDQTLKGIKVKNLKNNELTDLTIDCLFPYIGAVPNTSFLKPFNILNEEGYVLVDANQKTSVDGLYAAGDCVHKKIRQISTAISDGTIAALAVNDFFKLHK

SEQ ID NO: 19026 - protein, 204 aa, Oryza sativa
MRVMVALRLKGVEYELLQETMGKKSELLLASNPVHKKIPVLLHRGKPISESLVIVQYVDEVWPPPASILPRDDPYAAAIHRFWGQYIDDMFPPRIRILRGTVPGDKDEASDEMTTALLYLEEAFVECSKGKQYFGDDSIGYLDIALGSHLGWIRAVERIAGVELLGGAKVPNLAAWADRFCGHPAVVDVMPDVDILVEFTAKLI

SEQ ID NO: 19027 - protein, 405 aa, Trichodesmium erythraeum
MMEKQIMKTDMRLGVKTNTEYSNRTFVYEVEGLRQSQTAGELNNPIRRSGTVYITVPYSRMNQEMRRITGMGGKILSIKTLNEHSEANSQKTKTKQKTKPMTEAKPRRSEKKSVPVNTYRPKNPFIGKCLSTAELVNEGGEGTVRHLVFDLSGSDLHYLEGQSIGIIPPGKDAKGKAHKLRLYSIASTRHGDHLNDQTVSLCVRRLEYNHPETGERIYGVCSSYLCGMEEGADVAITGPVGKEMLLPDDEDATIIMIATGTGIAPYRAFLWRMFKEREQNPDYQFKGLAWLFFGCPYTPNILYKEELEELQREFPDNFRLTYAISREQKNKDGGKMYIQHRIQENAEELWQLIQKPNAHTYICGLKGMEDGIDEGMSAVTGQFDIDWGDYQKKLKKEGRWHVETY

SEQ ID NO: 19028 - protein, 306 aa, Dehalococcoides ethenogenes
MSPLLYDVIIIGGGPAGLTAALYTGRAKLKTLVIERAFIGGQITRSEKVDNYPGFPEGITGFDLTQQMQIQAEKYGAEIISAEVTALNKAKDSFELSTEAGKLSGRCIIICGGTERNKLGVPGEEEFSGRGVSYCATCDAPFYNDKVVAAVGGGNMAIYEALHLSEFAKKVYLIHRRQGFRADAVLVDKAKSKGNIEMVLDTVITSINGKDSIQSLSLNNLKTQKTSDLPVNGLFVAVGLQPNTAYLKGVVDMDKNGSILVNDQMETSVSGILCAGDIRSGSIRQVISAAGDGAVAALSAKRYLDR

SEQ ID NO: 19029 - protein, 419 aa, Bordetella parapertussis
MSSIETYMQSVGEQTRTASRAMMRATGAAKNQALLAMAEAILAQRAELQAANAKDVAAARANGLEAALLDRLTLSDRSIALMAEGLRQIAALPDPVGSITATSVRPNGMRVAQMRVPLGVIGIIYESRPNVTIDAAALCLKSGNATILRGGSEALHSNVALGRIVQAGLQAAGLPTAAVQVIDTTDRAAVGKLVTMTEHVDVIVPRGGKGLISRLAQEARVPLIKHLDGNCHVYVDAAADLAKAHDIAFNAKTYRYGVCGAMETLLVHADVAQRLLPVLGQALHEHGVELRGCARALQWLPEGKPADDADWATEYLGPILAVRVVDTIDEAMDHIARWGSGHTDAIVTENLSAAQRFQREVDSSSVYVNLPTCFADGFEYGLGAEIGISTNRLHARGPVGLEGLTTLKWVLNGEGQVRG

SEQ ID NO: 19030 - protein, 228 aa, Oryza sativa
MGATSPSGLELTMAVPGLSSSGSEGAGCNNNNAGGGCNMRDLDINQPASGGEEEEFPMGSVEEDEEERGVGGPHRPKKLRLSKEQSRLLEESFRLNHTLTPKQKEALAIKLKLRPRQVEVWFQNRRARTKLKQTEMECEYLKRCFGSLTEENRRLQREVEELRAMRVAPPTVLSPHTRQPLPASALTMCPRCERITAATGPPAVRPPPSSAAAAAPSPFHPRRPSAAF

SEQ ID NO: 19031 - protein, 476 aa, Bacillus cereus
MQNKIIMMFQKDFRLYDNPALFEAAQSGEVVPVYVQDETFSIGSAAKWWLHHAIIDVQKQLKALGATFIIRKGKTQEEILSLIEQLDITAVYWNICYEPDRLQSNQKMKMMLEDKGIICKEFNSHLLLEPWIIKKKDNTEYKVFTPFYNAFQKQAIPKPTSKVQSIKWGSSLPASLSVSELHLLPTIPWTSHMESIWNPTEEGAYKTFKKFFSSKLTFYSEGRDFPNQNVHSMLAPYLSFGQISVKLMFHYLINKSTERQSSLFEKQVNSFIRQLIWREFSYYLLYHYPFTVYKPLNKNFEHFPWDKEEELLRVWQKGETGYPFIDAGMRELWQTGFMHNRARMAVASFLVKHLLIPWQEGAKWFMDTLLDADIANNTMGWQWVAGSGADASPYFRIFNPITQGEKFDKDGEYIRKWVPELRDIPNKYIHKPWEAPEPILQKANIQLGDTYPLPVVDHKAARERALCAYKSMKEFI

SEQ ID NO: 19032 - protein, 741 aa, Pyrus pyrifolia
MLACNCIEPQWPADELLMKYQYISDFFIALAYFSIPLELIYFVKKSAVFPYRWVLVQFGAFIVLCGATHLINLWTFNMHSRTVAIVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLHQQNPVGYTVPIHLPVVNQVFSSNCAVKISPNSPVARLRQLAGKHIPGEVVAVRVPLLHLSNFQINDWPELSTKRYALMVLMLPSDSARQWHVHELELVEVVADQVAVALSHAAILEESMRARDLLMEQNIALDLASREAETAIRARNDFLAVMNHEMRTPMHAIIALSSLLQETDLTPEQRLMVETILKSSNLLATLINDVLDLSRLEDGSLQLDIATFNLHSIFREVHDLIKPVASVRKLSVALNIAADLPVCAIGDEKRLMQIILNVVGNAVKFSKEGSISITAYVAKSESLRDFRAPDFFPVQSDNHFYLRVQVKDSGSGINPQDIPNLFTKFTQTQTLASQNSGGSGLGLAICKRFVNLMEGHIWIESEGLGKGCTATFIVKLGFPERSNESKQPFAPKLQANHVQTNFPGLKVLVMDDNGVSRSVTKGLLVHLGCDVTTVSSIDEFLHVISQEHKVVFMDVCMPGIDGYELAVRIHERFTKRHERPVLVALTGSIDKMTKENCMRVGMDGVILKPVSVDKMRSVLSELLEHRVLFEAM

SEQ ID NO: 19033 - protein, 477 aa, Oryza sativa
MPTITHYVLDPLLETGSATQSQKAASKPPPAPPLPQEKAAEKPIPVPVAPVRRAQTASATLYATPESTSLPDSPSSFPGTWSPYLINHKRRGPCLVKTLSQGDVGSDGSQQPTLSVTLPPLPKRSQSFEAQEPEFEFQQASNGVLEGDSGVVETLDWQNGMLQKGKGTVSGEYGHDQAEFEFQHGNPDATVRPVNVGRPANGGTPRNINNDAFFELQDSLSMASNSEAEDAGGHERWWKPSSPLGTSVGTPGAEFYDAFEEISSDGATRSSQCMDDDLREMRLSLLMEIERRKQAEEALENWQKEWKKLSDHLSVIALTLPPPSLAEDTDDSSMDPGAELCQQITVSQLVAAAIARGFARAEVETDMETKIAAKNFEIARLSDRVQYYEAANREMSQRNQEAIELERSKYSLWCVESPRCQRCRGNNEISERRDRSGSGARLGLQLPLAQQPLPGPTYLQRSPKPVKTLIPTAIRAR

SEQ ID NO: 19034 - protein, 767 aa, Pyrus pyrifolia
MLKALASWLSVSLLLFCVSASDNGFPRCNCDDDGSLWSIESILECQRVSDFLIAVAYFSIPIELLYFVSCSNVPFKWVLFQFIAFIVLCGLTHLLNGWTYGPHPFQLMLALTVFKILTALVSCATAITLITLIPLLLKVKVREFMLKKKTWDLGREVGLIMRQTEAGMHVRMLTQEIRKSLDRHTILSTTLFELSETLGLQYCAVWMPNETKTEMILTHELKGRNYSHMYNFCIPISDPDVIHIKGSDGVNILRPDSALVHASGDSGEPGPVAAIRMPMLRVSNFKGGTPELIETCYAILVLVLPGGQPRSWSSQDLEIIKVVADQVAVALSHAAVLEESQLMREKLAEQNRALQQAKMKAMMASHARNAFQKVMSDGMRRPMHSILGLLSLMQDDTLDRDQRVIVDAMVRTSNVLSTLINDVMDNSAKESGRFPLEVRSFGLHGMIKEAACLAKCLCVFRGFGFAIDVNKSLPDHVMGDERRVFQVILHMVGSLLNGNNVGGFVMFRVASEKGSQGRSDQRWAAWRHSSSDGDVCVRFELGISNSGSQSEVTSPAVQLVGRRYTSEGVDEGLSFTICKKLVQMMQGNIWAVPNPQGFAQSMALVLRFQLRPSIAIAISEPGESYEHPHSNSLFKGLQVLLTDDDDVNRVVMRKMLEKLGCIVTAVSSGLECLSTIGTFGPAGSSFQVVLLDLHMPELDGFEVAIRIRKFRSLTWPLIIAVTASADEDVWDRCMQTGINGVIRKPVLLQGIANELRRVLLQANKGMA

SEQ ID NO: 19035 - protein, 472 aa, Candida glabrata
MAPKEDWEKYKAPVESDDDNKLKDDKSIPLTEGDIQVLKTYGAAPYAAKLKETEKDLKEIEQRIKEKSGIKESDTGLAPSHLWDIMGDRQRLSEEHPLQVARCTKIIKSSASNEVSDESAVNGANTTNSATTGSGNDGDAEGDDDEDAKYVINLKQIAKFVVGLGERVSPTDIEEGMRVGVDRSKYHIELPLPPRIDPSVTMMTVEEKPDVTYSDVGGCKEQIEKLREVVELPLLSPERFATLGIDPPKGILLYGPPGTGKTLCARAVANRTDATFIRVIGSELVQKYVGEGARMVRELFEMARTKKACIIFFDEIDAVGGARFDDGAGGDNEVQRTMLELITQLDGFDPRGNIKVMFATNRPNTLDPALLRPGRIDRKVEFSLPDLEGRANIFRIHSKSMSVERNIRWELISRLCPNSTGAELRSVCTEAGMFAIRARRKVATEKDFLKAVDKVINGYKKFSSTSRYMQYN

SEQ ID NO: 19036 - protein, 376 aa, Xanthomonas campestris
MSKRDYYEVLGVARGASDEELKKAYRRCAMKYHPDRNPGDAAAEATFKECKEAYEVLSDGNKRRAYDAHGHAAFEHGMGGGGGGPGGPDMGDIFGDIFGNIFGGGAAGPRAARRGADVGYVLELDLEEAVAGIERRIEIPTLIECEPCHGSGSEDGKVEVCATCHGRGQVRIQRGIFAMQQSCPHCDGRGTLIQNPCKTCHGAGRVEEDKVLSIKVPAGVDTGDRIRLAGEGEAGPAGTPPGDLYVEVRVREHAIFQRDGDDLHCEVPIRISQAALGDTVRVATLGGEAEIRIPAETQTGKLFRLRGKGVRSVRSRSEGDLYCRVVVETPVNLTADQRELLKQFEATFTGEDARKHSPKSATFIDGVKGFWDRMTS

SEQ ID NO: 19037 - protein, 971 aa, Candida glabrata
MTAEALVNGTSYTTLVAHSQESFKNAVEFYKNFLSLMKLNDKNANEATLYNSSVCLKIVLEEDSSKNQAAMHRVTKLSEMSKKQDWRAQVKDSLVFNIVDIQSIQKSLIANNFPIQAYPTTLQPMQLFTIDPLGNVVGVTCTKNAASTRPTKPQADVTTVPPSALASNVPSALPSKVQSFTDLSYCMKTTDHYPSLPTKATRVTPESKKAIAVMTSGGDAPGMNSNVRAIVRSALFKGCRAFVVMEGYEGLVRGGPEYIKEFSWEDVRGWSTQGGTNIGTARCMEFRERKGRLLGAQHLIEAGVDALIVCGGDGSLTGADLFRSEWPSLIDELLKENRIDNDQYERYKHLNICGTVGSIDNDMSTTDATIGAYSALDRICTAIDYVEATANSHSRAFVVEVMGRNCGWLALLAGIATSADYIFIPEKPATSSEWQDQMCDIVAKHRSRGKRTTIVIVAEGAIANDLTPISPSDVHKVLCDRLGLDTRITTLGHVQRGGTAVAYDRILATLQGIEAVNAVLESKPDTQSPLIAINENKITRKPLVESVKLTKSVADAIQAKDFKKAMSLRDTEFIEHMKNFMAINSADHNEPKLSEDKRLKIAIVNVGAPAGGINSAVYSMATYCMSQGHKPYAIYNGFSGLARHESVRSLKWQDMLGWQSRGGSEIGTNRVTPEEADLGMVAYYFQKYQFDGLILVGGFEAFESLHQLERARETYPAFRIPMVLIPATLSNNVPGTEYSLGSDTALNALMEYCDIVKQSASSTRGRAFVVDVQGGNSGYLATYAALAVGAQVSYVPEEGISLEQLSQDIEYLAEAFEVAQGREGFGKLILKSTNASKALTAEKLAEVITAEANGRFDAKAAYPGHVQQGGLPSPIDRTRATRFAIRAVDFIEEQQSVIANARAANDVFVADDKDVESTATVLGVKGSQIVFSSIRQLYDFETEVGKRMPKVIHWQNARAIADHLVGRKRVD

SEQ ID NO: 19038 - protein, 314 aa, Pyrus pyrifolia
MATFPVVDMSLVNGEERAATLEKINDACENWGFFELVNHGISTELLDTVEKMNKDHYKKTMEQRFKEMVVAKGLDAVQSQIHDLDWESTFFLRHLPSSNISEIPDLEEDYRKTMKEFAVELEKLAETLLDLLCENLGLEKGYLKKAFYGSKGPNFGTKVSNYPPCPKPDLIKGLRAHTDAGGIILLFQDDKVSGLQLLKDGEWVDVPPMHHSIVINLGDQIEVITNGKYKSIMHRVIAQSDGTRMSIASFYNPGDDAFISPAPALLEKKSEETPTYPKFLFDDYMKLYSGLKFQAKEPRFEAMKARETSSVATA

SEQ ID NO: 19039 - protein, 293 aa, Unknown
  Populus tremula x Populus alba
MDPDSRDPPIEYREGYALSGKIMLSAILILFFVIIVMVLLHLYARWYLTRARQRQVRRVRNRRTHLVFYVDSPQNPNNVTSHVTRGLEETVKNSLPVFVYPRKTHQDSIECAVCLSEFEENERGRVLPKCNHSFHTECIDMWFHSHSTCPLCRSPVEPVAENPVPEGSNFGISEAGSGLCTSCQHEEDHLGSASTSSFNGGRKPVGLIGVTIDVPRRNGNFEDESNTESPSASHSFRSPMSRMLSFKRMLSRERRGTVSPTVANSVSCGGGSGTTEFDIEQGRDESMPQQTRC

SEQ ID NO: 19040 - protein, 518 aa, Medicago truncatula
MAMAMALRRLSSSINKSSRPLFSASSVYYKSSLPDEAVYDKENSRVSWPKQLNSSLEEIDPEIADIIELEKARQWKGLELIPSENFTSLSVMQAVGSIMTNKYSEGYPGARYYGGNEYIDMAETLCQKRALEAFRLDPAKWGVNVQPLSGSPSNFHVYTALLKPHDRIMALDLPHGGHLSHGYQTDTKKISAVSIFFETMPYRLDESTGYIDYDQLEKSATLFRPKLIVAGASAYARLYDYARIRKVCDKQKAVMLADMAHISGLVAAGVIPSPFDYADVVTTTTHKSLRGPRGAMIFFRKGLKEVNKQGKEVFYDYEDKINQAVFPGLQGGPHNHTITGLAVALKQATTPEYKAYQEQVLSNCAKFAQALSEKGYELVSGGTENHLVLVNLKNKGIDGSRVEKVLEAVHIAANKNTVPGDVSAMVPGGIRMGTPALTSRGFVEEDFVKVAEYFDASVNLALKIKAESKGTKLKDFVETLQSSSYVQSEISKLRHDVEEFAKQFPTIGFEKSSMKYNK

SEQ ID NO: 19041 - protein, 504 aa, Desulfitobacterium hafniense
MDKGYVYLVGAGPGDPKLITVKGAECIAKADVLIYDRLASRRLLTLARPDCELIYVGKSPDRHTLRQEEINALLVQKGLEGKIVTRLKGGDPFVFGRGGEEAEDLLQAGIPFDIVPGVTSAISVPAYAGIPVTHRDLTSSFAVITGHEDPTKNSSALAWEHLATAHGTLIFLMGMENLSLIATKLMENGRSPSTPVGIIQWGTRPEQRVLVGELQNIAQLVKEEGFTNPSIIIVGEVVQLREKLQWFEKRPLFGQRIIVTRARHQASALSQGIEDLGGEPWEFPAIEIVPPRDPQPLIQAIKNLKRFEWLIFTSVNGVEEFFKVLMEQGRDVRDLAGMDVVAIGPATRDALEKRCLKVSFVPEEYRAEKIIEGLASRVLPGQSVLLARAEEARDILPESLKALGADVWDVPTYRTVLGNANKEELMKLLEEKAVAAVTFTSSSTVRNFLQLIDGRQSLLDGVKLYSIGPITSKTAQEFGLSIYREAKQYTIKGLLETLARGNEE

SEQ ID NO: 19042 - protein, 380 aa, Unknown
  Populus tremula x Populus alba
MCGGAIISGFIAPTTTARSSRRLTSGFEWLEPKKPFNNKHLKPVVADPEDDFEADLQEFKDESDVDEDYDVFADAKPFAFSASASEPAKKRGLPRGSTAVKSAGFSGLAKNSAKRKRKNQFRGIRQRPWGKWAAEIRDPRKGVRVWLGTFNTAEEAARAYDSEARRIRGKKAKVNFPDEAPCASARHPIKENSQKRLTKANLSQDFSYLSNPETDYNNMGFVEEKPQVSQFGIMNSIPVNGDSGVTPLTPSDNASMYFNSDKGSNSFDCDFGWGEQGAEILSVLAATPEVDESVFVEANPKKLKSYTEYAVPVEERNGKSLSEELLAFDNQLMNLQMPDLVGNWEASLDSFLNGDTTQDGTNAVDLWSFEDFPSMVGGVY

SEQ ID NO: 19043 - protein, 523 aa, Mycobacterium avium
MSTVEVSAPEAAPPSPGRWRALLLAAVAACAACGIIYELALLTLSASLDGGGIVATSLIVAGYIAALGVGALLAKPLLAHAALGFIAVEALLGVVGGLSAAALYVVFAFLDGSVGSTWVLAVSTALIGGLVGAEVPLLMTLLQRGRTAGPADAGRTLANLNAADYLGALLGGLVWPFLLLPQLGMIRGAAATGMINLAAAAVVAIFLLRQVVSARQLALALCALAAALALLATLLLRSADVETTSRQRLYADPIIAYRHTPYQEIVVTRRGDDTRLYLDGGLQFSTRDEYRYTESLVYPALGNGARSVLVLGGGDGLAARELLRQPGISRIVQVELDPAVIEIARTTLRAANGGSLDNPRVRVLTGDAMAWLRGPNPDRFDAVIVDLPDPDTPVLGRLYSTEFYTLAARALAPGGLLVVQAGSPFSTPTAYWRTVSTIRAAGYAVTPYHVHVPTFGDWGFVLAQRGDTPPAPKVPPDAPPLRFLDQRVLQAAVVFSGDVGPRPLEPSTLDNPRIVGDMRHGYD

SEQ ID NO: 19044 - protein, 321 aa, Unknown
  Thermotoga sp. RQ2
MSKIWTEKIFDDPEIFILRVDDDQIKYFEAVWEITEGISYNAYLVKLNDANVLIDGWKKNYAKEFIDILSKIVDPKEITHIVVNHTEPDHSGTLPATLEAIGHDVEIIASNFGKRLLEGFYGIKDVTVVKDGEEKEIGGKKFKFVMTPWLHWPDTMVTYLDGILFGCDVGGGYLLPEILDDSNESVVERYLPHVTKYIVTVIGHYKNYILEGAEKLSSLEIKALLPGHGLIWKKDPQRLLNHYVSVAKGDPKKGKVTVIYDSMYGFVENVMKKAIDSLKEKGFTPVVYKFSDEERPAISEILKDIPDSEALIFGVSTYEAE

SEQ ID NO: 19045 - protein, 293 aa, Haemophilus influenzae
MSTFVWILRIILNFLLNLFITTNGVIIVNAFKKSLIVAASFASLSLFNSATAELVYKPLEQPVEPAKPDLKIESVNEKFAEKYPNQYNSWCSTANGDGENIIYADEENPRLIVLWGGYAFAKEYNAPRGHFYAVTDVRNILRTGAPKTANDGPQAMACWTCKGPDVPRLIAEWGEKDYFNAKWAKGGPEIVNSIGCADCHDTTSKDFAEGKPALRIARPHVLRALDALEKATAEKDKAEGRPHNNLSFNTAARTEKRAEICANCHVEYYFAGDIKQVTFPWDNGQTVDDIEKY

SEQ ID NO: 19046 - protein, 168 aa, Avena vaviloviana
VMASSATTVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 19047 - protein, 150 aa, Cenarchaeum symbiosum
MKATFAAGCFWHVEEIFRKIEGVQDTAVGYTGGVPENPTYEQVCTDGTGHAEAVQVEYDPDRVTYEKLLDVFWGNHDPTTRNRQGPDVGTQYRSAIFFHSTEQEEAAKISKEKLGGSGRFKNPIVTEIAGAPAFYRAEDYHQRYLEKRGL

SEQ ID NO: 19048 - protein, 287 aa, Alteromonadales bacterium
MANLDQSKWFTEISDRDGSAFSLRINKKLDEKQSPFQKVEMFETTDFGNLMIIDGCTMVSTRENFFYHEMISHPALLAHPNPKNVVIIGGGDCGTLREVLKHPGVESVTQIDIDEVVTQMSLKYFPELCESNNDARATVMFDDGIKYMREAAGESIDVVIVDGTDPVGPGEGLFNHAFYTSCLNALRPGGILVQQSESPLMHMPLLVEMREAMLSVGFNDLQTLPFPQPIYPSGLWSVTLARKSETFNGFREDGAAQIAEQSEYYNSGIHHGALATPNFMKRAFDKK

SEQ ID NO: 19049 - protein, 204 aa, Capsella rubella
MATIEESSDLEAMQKHLFEDFLVSDGFLGDFDFDASFVSGLWCIEPQVPKQEPDSPVLDPDSFVNEFLQVEAKSSPELNTSSSSTYETDQCVKKAERFEEEVETRHYRGVRRRPWGKFAAEIRDPAKKGSRIWLGTFESDVDAARAYDCAAFKLRGRKAVLNFPLDAGKYEAPANSGRKRKRSDAQEELQRTHSNSSSSSCDAF

SEQ ID NO: 19050 - protein, 152 aa, Haemophilus somnus
MQTTYRKLTKNKKIALVAHDHCKQDLIQWCQTNRTLLQPHILYATGTTGNLIHQETNLEIKNLLSGPMGGDQQLGGLIAEGKIDLLIFFWDPMNAVPHDPDVKALMRIATVWNIPVAMNIATADFLISSPAFQQETEIRIPDYQGYLKERLK

SEQ ID NO: 19051 - protein, 200 aa, Glycine max
LTYHVQVGSTVQTNNSIVNEVFNSPQAMRIPPTCPLARIRPLVGRYVPPEVVAVRVPLLNLSNFQINDWPDISAKSYAIMVLILPTDSVRKWRDHELELVDVVADQVAVALSHAAILEESMRARDQLMEQNVALDLARREAEMAIHARNDFLAVMNHEMRTPMHAIIALSSLLLETELTPEQRVMIETVLKSSNCLNTIK

SEQ ID NO: 19052 - protein, 1007 aa, Oryza sativa
MALAGSMAAAAATSTLLLLLLLLLLATATHGAAADTVSSPASPEAAALLNLSAALGDPSGYLSTHWTHDTAFCSWPRLSCDADGSRVLSLDLSGLNLSGPIPAAALSSLSHLQSLNLSNNILNSTFPEGLIASLKNLRVLDFYNNNLTGALPAALPNLTNLVHLHLGGNFFFGSIPRSYGQWSRIKYLALSGNELTGEIPPELGNLTTLRELYLGYFNSFTGGIPPELGRLKELVRLDMANCGISGVVPPEVANLTSLDTLFLQINALSGRLPPEIGAMGALKSLDLSNNLFVGEIPASFASLKNLTLLNLFRNRLAGEIPEFVGDLPNLEVLQLWENNFTGGVPAQLGVAATRLRIVDVSTNRLTGVLPTELCAGKRLETFIALGNSLFGSIPDGLAGCPSLTRLRLGENYLNGTIPAKMFTLQNLTQIELHDNLLSGELRLDAGVVSPSIGELSLYNNRLSGPVPVGIGGLVGLQKLLVAGNRLSGELPREIGKLQQLSKADLSGNLISGEIPPAIAGCRLLTFLDLSGNRLSGRIPPALAGLRILNYLNLSHNALDGEIPPAIAGMQSLTAVDFSDNNLSGEVPATGQFAYFNATSFAGNPGLCGAFLSPCRSHGVATTSTFGSLSSASKLLLVLGLLALSIVFAGAAVLKARSLKRSAEARAWRLTAFQRLDFAVDDVLDCLKEENVIGKGGSGIVYKGAMPGGAVVAVKRLPAMGRSGAAHDDYGFSAEIQTLGRIRHRHIVRLLGFAANRETNLLVYEYMPNGSLGEVLHGKKGGHLQWATRYKIAVEAAKGLCYLHHDCSPPILHRDVKSNNILLDAEFEAHVADFGLAKFLRGNAGGSECMSAIAGSYGYIAPEYAYTLKVDEKSDVYSFGVVLLELIAGRKPVGEFGDGVDIVHWVRMVTGSSKEGVTKIADPRLSTVPLHELTHVFYVAMLCVAEQSVERPTMREVVQILTDLPGTAAATAMDAPSHGSGKEQDRSAEMQQQDGSRESPPQQDLLSI

SEQ ID NO: 19053 - protein, 391 aa, Unknown
  Candidatus Kuenenia stuttgartiensis
MKPIPLKEGIYWVGEVDWDLRNFHGYSTNRGSTYNSYLVIDEKITLIDGVRPYLFDKMMQRLSSLIDPASIQYVIANHVEMDHSGSLPLIMDIAKNATIVTSLNGQKGLLAHYKGNDWNMKVVQTDEEVNIGKRTFRFFLTPMVHWPDNMASYLVEDKILFSNDAFGQHIASHERFDDELYLGAVIEEAKKYYANIVLPYSMLVKKTIEKLSHIPIDMIAPGHGIVWRSHIKNIIDEYNKWAANQTKNKCLIIYDTMWKSTEKIAHALQNAFNHGGISTKMINLRYNHLSDVVTDVLDARFICVGSPTLNSNLLPTVSAFLTYLKGLSPKDRIGLAFGSYGWGGQSVSHVEDALKECGFDLLESIKIQYIPDETQLQEIYEKTKQEIAKRG

SEQ ID NO: 19054 - protein, 112 aa, Haemophilus somnus
MKKIEAIIKPFKLDDVRESLADIGITGMTVTEVRGFGRQKGHTELYRGAEYMVDFLPKVKMEIIVPDEIVEQCIEAIIETAQTGKIGDGKIFVYDVNRVIRIRTREENEEAL

SEQ ID NO: 19055 - protein, 424 aa, Zea mays
  misc_feature (379)..(379): Xaa can be any naturally occurring amino acid
MALAVRTPRFQPRPASISAPTTPASTSLAAANARPRPCAVAAVRASPFTEATSSSRYRRDAWSYAADGSSNSASPSSAAAAAAGRRDDEIALQLPELRRLLDALRASRGRGAEEGGGPGRVALVGTGPGDPELLTLKAVRAIEAADLVLYDRLVSNDVLDLVGEGARLLYVGKTAGYHSRTQEEIHELLLSFAEAGANVVRLKGGDPLVFGRGGEEMDFLQQQGIKVEVIPGITSASGIAAELGIPLTHRGVATSVRFLTGHSRNGGTDPLYVAGSAADPDTTLVVYMGLSTLPSLAPKLMKHGLPPDTPAVAVERGTTPQQRTVFASLKDLVDEVKSPDLVSPALIIIGKVVSLSPFWVESSEHDALKVQSSYANEAXDATRFSWFLVTGQSPRNAKSQIWEHRFDLVYTEPSQEAWILNGGW

SEQ ID NO: 19056 - protein, 293 aa, Zea mays
  misc_feature (14)..(14): Xaa can be any naturally occurring amino acid
  misc_feature (241)..(241): Xaa can be any naturally occurring amino acid
MASSVAAAASTFLXGTRLADPAPQNGRIVARFGFGLGGKAKPAPKKVAKTSTSSDRPLWFPGAVAPDYLDGSLVGDYGFDPFGLGKPVEYLQFELDSLDQNLAKNEAGGIIGTRFESSEVKSTPLQPYSEVFGLQRFRECELIHGRWAMLATLGALSVEWLTGVTWQDAGKVELVDGSSYLGQPLPFSISTLIWIEVLVIGYIEFQRNAELDPEKRLYPGGSYFDPLGLAADPEKKERLQXLAEIKHARLAMVAFLGFAVQAAATGKGPLNNWATHLSDPLHTTIFDTFGGSS

SEQ ID NO: 19057 - protein, 238 aa, Brassica napus
MVDAKQVRFIVGVIGNVISFCLFFSPAPTFWRIIKNKSVEEFQPWPYVATMMNCMLWVFYGLPVVHKDSILVTTINGVGMVFEAFYISIFLVYCGGKKNFRRNIGLYLVAEVIAVAAIGLITLFAIQNEFAKQTFVGVICDVFNIAMYGAPSLVIKKVIRTRSVEYMPFLLSFVSFVNAGIWTAYSLIYKLDLYVLISNGLGTALCASQLIVYGLYRNATPRDEDKTKPSEIEILATA

SEQ ID NO: 19058 - protein, 448 aa, Archaeoglobus fulgidus
MCIMKYDVLIIGGGPAGIVTATTAKKFYPAKSVAIIKKEETSLVPCGIPYIFKTLGSVEADVMPTKPAENLGIEFIIDEVEDVDVKAKVVRTKGGKSISYEKLVFATGSTPVMPRIEGVEKKGVFTVSKNIEELRKLHEAVKKAEKVVIVGGGFIGVEVGEQIAKAGKKFTMVEMMDQLLPAAFDKEFARIAEEELKKLGVEVYLNSTVKRITGNSSVEAVELADGRKIEADVVIMSVGYRPNIELAKKAGLRISIGNRIWTDEYGRTSEKDVFAVGDCSEEKDFFTRETSRVMLASTATFEARIVGANLYSLKVVRVNKGTVGVFSTFVGDVALGAAGLTEEMAKKEGFEVVAGYGESLNRHLASIPGAAKTKVKLIFAKESGVILGGQVTGRYEVGEMVNQIAMAIQNNLTASEIDTLQIGTHPLLTSAPTTPPVILAAEDALRKM

SEQ ID NO: 19059 - protein, 432 aa, Sorghum bicolor
MGLSTAYSPAGSGLVPAPLARAARRRSVQVRRPRLATVRCSVVDAAKQVQDGVATAVGGGAASGNECFGVFCNIYDLKAEDKTKSWKKLVTIAVSGAAGMISNHLLFKLASGEVFGQDQPIALKLLGSERSFQALEGVRMELEDSLYPLLREVSIGIGPYEVFQDVDWALLIGAKPRGPGMERAALLDINGQIFADQGKALNAVASRNVKVLVVGNPCNTNALICLKNTPNIPAKNFHALTRLDENRAKCQIALKAGVFYDKVSNVTIWGNHSTTQVPDFLNAKIDGRPVKEIIQDTKWLEEEFTMTVQKRGGVLIQKWGRSSAASTAVSIVDAIKSLVTPTPEGEWFSTGVYTTGNPYGIAEDIVFSMPCRSKGDGDYELATDVSMDDFLWERIKKSEAELLAEKKCVAHLTGEGDAFCDLPEDTMLPGEN

SEQ ID NO: 19060 - protein, 242 aa, Neisseria meningitidis
MSQITMRQMIEAGVHFGHQTRFWNPKMAQYIFGARNKIHIVNLEKTLPMFQDAQEAVRRLVANKGTVLFVGTKRQARDIIREEATRAGMPFVDYRWLGGMLTNYKTVKQSIKRLEEKTAALENAAESGFSKKEILEMQRDVEKLERSLGGIKNMKGLPDAIFVIDTGYQKGTLVEAEKLGIPVIAVVDTNNSPDGVKYVIPGNDDSAKAIRLYCRGIADAVLEGKNQALQETVAAAQEAAAE

SEQ ID NO: 19061 - protein, 249 aa, Triticum aestivum
MLRPSPYSSRRLLQSGDPSRIPGIPPADPPAGVSSDVVVILAALLCALICVVGLAAVARCARSRRNANAHANQSSPSGSPAHALAAFGGGGGGHNHGTTTTTTTGASGGSVTTTSKGLKKKALKALPKLAYADAVAAAAAARGAVAGGEEEEGQDGILAECAICLTEFGEREEVRVMPQCGHGFHVDCVDTWLRSNSSCPSCRRPIVLDDPAPPKRCRKCEETILEAVIASSSSSAGGSRGGGRGGFLP

SEQ ID NO: 19062 - protein, 316 aa, Unknown
  Bradyrhizobium sp. BTAi1
MSRLFRAAAAQMGPTQRADSRAHTLARLIGLLDKAAAEGAKLVVFPELAFTTFFPRWILEGDALDSYFERSMPNPSVAALFDRARTLGVGFYVGYAELTPDGRRFNSAILVDPDGEIISKYRKVHLPGSVEPRPGAKYQQLEKRYFGYGDLGFPAVRAGSDWGGAIMGMMICNDRRWPESWRVLGLQGVELVCVGYNSAAYDPNGGNTEDASLRTFHSTLVAQANAYMNATWAIAVAKAGDEDGSGLIGGSCIVDPNGCIVAQAKTLGDEVIVADIDLDLCRQGKDKMFNFAAHRRPDQYKVITERAGVVEPVAVD

SEQ ID NO: 19063 - protein, 231 aa, Unknown
  Bradyrhizobium sp. BTAi1
MAKDTTGRMHVQVKTGGKRKLSSKLWLERQLNDPYVAQAKRDGYRSRATYKLIEIDDKYHLLKPGMTVVDLGAAPGGWSQIAARRVGAEAGKGKVIAIDLLEMGEVPGVTFTQMDFHAQDAPEKLRAMLGGRADVVMSDMAANTTGHRKTDQLRIVGLVELAAHFAGEVLKPGGSFLAKTFQSGADAELLAQLKRDYATVRHVKPAASRQDSSERYVLAMGFRGGEPAELL

SEQ ID NO: 19064 - protein, 361 aa, Magnetospirillum magnetotacticum
MSSAAPRASTPDDVLDPRAMREPLPNAWYCVGPAASVAGGKMRAVALNGEQVVLGRAKDGALFALRDRCPHRGMALSKGKFDGDTLMCPFHGWRFGTDGRCRDVPTLSEHDASDFSCIAVQRFPIVESAGFLWVNPHLGPSDLEAVPAVPSLGFEPAGSLVLELEVEASFDLTTLSLVDPGHVAFVHDNWWFRASKELREKVKTFQPVPHGFVMTSHATTTSSPLYRLLGGAPEVEIEFRLPGVRLERIAAGTKRVANYTFATPMGPNRTMLTNALYWSMPALNLLKPIARPLMRQFLTQDQQVLQHAQAGLDRKPTMVLLGQGDLPSQWYFRLKRETLEAAREGRPFANPLVRQELRWRS

SEQ ID NO: 19065 - protein, 245 aa, Unknown
  Dehalococcoides sp. CBDB1
MPTTNIKELLEAGAHFGHQTSRWHPRMKKYIFTKRNGIHIIDLEKTVVMLDKACNYINQVVSDGGKVLFVGTKKQAQEILAEEAKRCGMYFINQRWTGGILTNFHSIQSRIDYLVRLEDQQARGDFSRLPKKEAQKLGEEIARLNRTMGGFKEMTRLPDVIFVVDPIKEKIAMAEAKRMGVPLVAMVDTNCNPDEVDYPVPSNDDAMRAIKLICSKMADAVIEAQNAMKVTEVETTGEAQAETAG

SEQ ID NO: 19066 - protein, 364 aa, Oryza sativa
MAQRSPGPAHRTVTDLSVRPSCLVSPVAVRANGNTHENAEKGARRGRWTFWRQELRRQSCVSIVASQAATVALHYKASKPEQQTTCAAEETSMRWREMGWRPAEEGSSSGTSSTQITCAGGSRRCRRRAQPPYWGSRTPTQRTHGRGMARRAASEWSSSGPTPLALAPAEATTSGERWSAMEAERCLSPALAPNRGCGDVVATRMDVRWCGDSMHRSCPARHLAKQVAGGVLAGLGPGQAQWGSVSLRPRKEGGLQVGISDVFAVPGDLNLTLLNHLISPSPASTSSAAATSSTLASYAADGYARARGVGACAVTFTVRGQLLHGCRHRSHRFWNQVMGDEARKQAPPLGIRSARARLRRCCRW

SEQ ID NO: 19067 - protein, 175 aa, Xylella fastidiosa
MHPKNFQHQLKTIPQPPEETRDFVFNHTMLRVKDINASLDFYARILGFRLIDQRDFHEAQFSLYFLALLPQTVHISDNDTERRLWMSGIPGVLELTHNYGTETQEGQIYHNGNSEPRGFGHICISVPDLYSACARFDTLQVPYQKRLTDGRMKNIAFIKDPDGYWVEIISNTPLP

SEQ ID NO: 19068 - protein, 356 aa, Olimarabidopsis pumila
MEKGEDSSTFKMGNSAQERSLPYVPDCYVVPPSCEPCDSNSDVVPTIDVSRLKGVDDDRREVIRELSLACQRLGFFQIVNHGINQNILDDALEVAKGFFELPAKEKKKFMSNDVYAPIRYSTSLKDGLDKIQYWRIFLKHYAHPLHRWIHLWPENPPEYREKMGKFCEEVRKLSIEIMGAITESLGLGRNYMSSRMDENGMQVMAVNCYPPCPDPETALGLPPHSDYSCITILLQNLAGLKIFNPMAHGGSGGWVVVPQVTGALKVHIGDHVEVLSNGLYKSVVHKVTLNEENMRISLASLHSLGMDDKMSVPCELVNHENPVRYRESSFNDFLDFLVKNDISQGDRFIDTLRIKD

SEQ ID NO: 19069 - protein, 265 aa, Oryza sativa
MEIDDDVIYSLIRNWDNDSSSSWIELLDHAIVSPASCFVPWKRTELDKEAVAGGEAAQRLLKKVVGGGGAWMNRAAGSCSIKNHVMSERRRREKLNEMFLILKSLVPSIDKVDKASILSETIAYLKELERRVQELESGKKVSRPAKRKPCSETIIGGGGGGGGAGAVKEHHHWVLSESQEGTPSDVRVIVMDKDELHLEVQCRWKELMMTRVFDAIKSLRLDVVSVQASAPDGLLGLKIRAKYASSAAVVPAMISETLRTAVAGY

SEQ ID NO: 19070 - protein, 162 aa, Zea mays
  misc_feature (105)..(105): Xaa can be any naturally occurring amino acid
  misc_feature (111)..(111): Xaa can be any naturally occurring amino acid
MGRRPARCYRQIKNKPYPKSRYCRGVPDPKIRIYDVGMKRKGVDEFPYCVHLVSWEKENVSSEALEAARIACNKYMTKSAGKDAFHLRVRVHPFHVLRINKMLSXAGADRXSELEMRGGFGKASGQPGLRGEHWPGPPFSWSKERKKMACHCQEKLSGPRQV

SEQ ID NO: 19071 - protein, 493 aa, Triticum aestivum
  misc_feature (179)..(179): Xaa can be any naturally occurring amino acid
  misc_feature (281)..(281): Xaa can be any naturally occurring amino acid
  misc_feature (289)..(289): Xaa can be any naturally occurring amino acid
MTKDVEMAARNGGNGAVAGEAYYPSPPAQGGDADVDDDGKQRRTGTVWTASAHIITAVIGSGVLSLAWATAQLGWVVGPITLMLFAAITYYTSGLLADCYRTGDPLTGKRNYTYMDAVASYLSRWQVWACGVFQYVNLVGTAIGYTITASISAAAINKANCFHKNGRAADCGVYDSMYXVVFGVVQIFFSQVPNFHDLWWLSILAAVMSFTYASIAVGLSLAQTISGPTGKATLTGTEVGVDVDSAQKIWLAFQALGDIAFAYSYSMILIEIQDTVRSPPXPENKTMKXATLVGVSTTTAFYMLCGCLGYAAFGNGAKGNILTGFGFYEPYWLIDFANVCIVVHLVGAYQVFCQPIFAAVETFAAATWPNAGFITREHRVAAGNGKRLGFNLNLFRLTWRTAFVMVSTLLAILMPFFNDILGFLGAIGFWPLTVYFPVEMYIRQRGIPRYTTRWVALQTLSFLCFLVSLAAAVASIEGVTESLKNYVPFKTKS

SEQ ID NO: 19072 - protein, 563 aa, Unknown
  Synechococcus sp. WH 7805
MTYVLDRLADLGIGHVFGVPGDYSFPLNDAVEVHPRLQWVPSANELNAAYAADGYARRRGAGIVCTTYGVGELSALNGVMGAMAERVPVFHLVGTPSVRIVRQGLICHHTLGDTRYDRFEAISAAAGCVSARLTPENVVVELERVIDKALEDSRPAYLTVPMDLALMPITGTPIQGTPMGAVDQHASVAVELEAVLDLVMGRLAEAARPLVMPTVTLKRFGLVETFAAFLEASGLAYATTPMDKSLLSEGHPAFLGMYNGARSTPAALQGVVEDADLLIDFGGLVMEDLNTGLWSGHLDASRVISLHADWVQAGDQVFTSVSISEVLAGLIKRFQATGSRPSHWGEQRPVQPEPLLPLRGEGDQPTGSASFYGRLQRFLRPTDLLVTDTGTCMLKLNAMRLPDGVAIESQTLWGSIGWATPAALGCALADSERRVVLVTGDGAHQLTVQEIGVMGFTGAKPVVIVLNNGLYGVEALLSETGHAYNDLPPWRYAQLPEAFGCQGWWSGRVSTVAELEQALVAINAHDGGAYLEVMIPPEESQPLAETLIETMHQTATPHPEAAE

SEQ ID NO: 19073 - protein, 238 aa, Picea glauca
MEHLNTAAAQASSSLYGVGMAEYGDAGVSSMMALITQHEPHDSESIMSTRMPSSFSSFHGHADCLLSAAMFQASQGDHKLKRQPGMDQLVSEQAGMSDSSMPSVKTEVCSGLRNQFEFHREQTGNCYTDQSSNAPVNPLVTSLASQARGEAQMIPSLDANSPHFNVDNEEYAIKSKILAHPQYPSLLGAYIDCQKIGAPPEAVARLDALTREYQNQQRRTVSIGMDPELDQFMEAYCE

SEQ ID NO: 19074 - protein, 117 aa, Glycine max
MGPRPARCYRQINNTPYHKSRFCRGAPDPKIRIHHVGMKNKGVAEFAFCVHLPRWEKENVSSEALEAARIACNTYMVKFDGQDRFHSTVRVHPFHVLRINNMLSRAGTDSLQTAMRG

SEQ ID NO: 19075 - protein, 333 aa, Mycoplasma gallisepticum
MMAIQTQRIAILTSGGDSPGMNPAIYGLVQQAIINNIQPYLVYEGYKGLVEDQIVLANQQEVIDHFFDSGTFIYSARLVEFKDLEVRKKAVSNLKAKKIDTLVVIGGDGSYQGAKLLSEMGINVIVMPGTIDNDVSSSDYTIGFYSALEHITRTIQEIISTSVSHNRVSISEVMGRHCGDLAVYAALATKADLVITSENIKTTQEIVDLAAKRMLQDHKRTFTVIVCEHIYGEDGRDSLKTIAQQINDQLGIKTNLNILTYGQRGQVPTPMERILAMKFAIKAFECINEQRYGVVLGLSGDEIVAYNFQEALNKRNPSRIKLINLSNRINGGF

SEQ ID NO: 19076 - protein, 441 aa, Capsicum annuum
KEKDCDTHDLPLKARKFESFFTQLYSVTLASSGELICKDFFLYMESNQFGLFATSTAQIHDVPPTGGATQGVPSVEKITFHLLRLEDGAILGERVFHNDYVNLAHSIGAFLYDDLLAIVSLRYQRIHILQIRDSGDIVDVRAIGEFCREDDELFLNSNSQVLVDHVGNGFHHSLPESETFFLSGIKQRLLSFIFRGIWNEETDQTMRVQCLKKKFYFHFQDYIDLIIWKVQFLDRHHLLIKFGSVDGAVSRNTDSHPSFLAVYNMETTEIVAFYQNSADELYFLFELFSDHFHVSSKSSLHMNLMSSHSNNIHAFEQLRCTKNKAISFSQFVKKMMASLPFSCQSQSPSPYFDQSLFRFDEKLISAIDRHRQSTDHPIKFISRRQPNILKFKMKPGPEAGSMDGRTKKICYFLFHPILPLALSVQQTLFLQASVVNIHFRQ

SEQ ID NO: 19077 - protein, 72 aa, Bifidobacterium longum
MAKDGVIEVEGQVVEALPNAMFRVELENKHIVLATISGKMRKNYIRILPQDRVVLEMSPYDLNRGRITYRYK

SEQ ID NO: 19078 - protein, 380 aa, Escherichia coli
MISFFPKIEWQRIMSDSQTLVVKLGTSVLTGGSRRLNRAHIVELVRQCAQLHAAGHRIVIVTSGAIAAGREHLGYPELPATIASKQLLAAVGQSRLIQLWEQLFSIYGIHVGQMLLTRADMEDRERFLNARDTLRALLDNNIVPVINENDAVATAEIKVGDNDNLSALAAILAGADKLLLLTDQKGLYTADPRSNPQAELIKDVYGIDDALRAIAGDSVSGLGTGGMSTKLQAADVACRAGIDTIIAAGSKPGVIGDVMEGISVGTLFHAQATPLENRKRWIFGAPPAGEITVDEGATAAILERGSSLLPKGIKSVTGNFSRGEVIRICNLEGRDIAHGVSRYNSDALRRIAGHHSQEIDAILGYEYGPVAVHRDDMITR

SEQ ID NO: 19079 - protein, 311 aa, Staphylococcus aureus
MTEIDFDIAIIGAGPAGMTAAVYASRANLKTVMIERGIPGGQMANTEEVENFPGFEMITGPDLSTKMFEHAKKFGAVYQYGDIKSVEDKGEYKVINFGNKELTAKAVIIATGAEYKKIGVPGEQELGGRGVSYCAVCDGAFFKNKRLFVIGGGDSAVEEGTFLTKFADKVTIVHRRDELRAQRILQDRAFKNDKIDFIWSHTLKSINEKDGKVGSVTLTSTKDGSEETHEADGVFIYIGMKPLTAPFKDLGITNDVGYIVTKDDMTTSAPGIFAAGDVRDKGLRQIVTATGDGSIAAQSAAEYIEHLNDQA

SEQ ID NO: 19080 - protein, 417 aa, Escherichia coli
MLEQMGIAAKQASYKLAQLSSREKNRVLEKIADELEAQSESILNANAQDVADARANGLSEAMLDRLALTPARLKGIADDVRQVCNLADPVGQVIDGGVLDSGLRLERRRVPLGVIGVIYEARPNVTVDVASLCLKTGNAVILRGGKETCRTNAATVAVIQDALKSCGLPAGAVQAIDNPDRALVSEMLRMDKYIDMLIPRGGAGLHKLCREQSTIPVITGGIGVCHIYVDESAEIAEVLKVIVNAKTQRPSTCNTVETLLVNKNIADSFLPALSKQMAESGVTLHADAAALAQLQTGPAKVVAVKAEEYDDEFLSLDLNVKIVSDLDDAIAHIREHGTQHSDAILTRDMRNAQRFVNEVDSSAVYVNASTRFTDGGQFGLGAEVAVSTQKLHARGPMGLEALTTYKWIGIGDYTIRA

SEQ ID NO: 19081 - protein, 299 aa, Dianthus caryophyllus
FIVLCGATHLINLWTFRIHTKTVEIVMTTAKLLTAVVSCVTALMLVHIIPDLLSVKTRELFLKNKAAQLDREMGLIRTQEETGRHVRMLTHEIRSTLDRHTILKTTLVELGRTLALEECALWMPTRTGLELQLAYTLRQQYPVDYTVPIQLPVITQVFSTNRAVKISPNSPVARIRPVMGKYMPGEVVAVRVPLLHLSNFQINDWPELSTKRYALMVLMLPSDSARQWHVHELELVEVVADQVAVALSHAAILEESMRAQQQLMEQNVALDLARREAETAIRARNDFLAVMNHEMRTPM

SEQ ID NO: 19082 - protein, 317 aa, Vigna radiata
MANFPVVDMGKLNTEERGAAMEMIKDACENWGFFELVNHGISIELMDTVERLTKEHYKKTMEQRFKEMVANKGLESVQSEINDLDWDSTFFLRHLPVSNVSENTDLDQDYRKIMKQFAEELEKLAEHLLDLLCENLGLEKRYLKQVFYGSKGPNFGTKVSNYPPCPTPDLIKGLRAHTDAGGIILLFQDDKVSGLQLLKDDQWIDVPPMRHSVVINLGDQLEVITNGKYKSVMHRVIAQTDGTRMSLASFYNPGDDAVISPAPALVKESDETSQVYPKFVFNDYMKLYAGLKFQAKEPRFEAMKAVSSVDVGAIATV

SEQ ID NO: 19083 - protein, 520 aa, Moorella thermoacetica
MENTRGKVFLVGAGPGDPGLLTVKGRECLARAGAVVYDRLLNPALLEYAPPEAVKIYVGKAPDRHALSQDEINDLLVDLARQGKQVVRLKGGDPFVFGRGGEEALALRAAGIPFEVVPGVTAAVAVPAYAGIPVTHRGLASTAAFITGNEDPRKGNSAINWEGLARAVDTLVFLMGMANLPYIVSRLLACGRSPDTPVALIRWGTRAEQETLTGTLADIEGRAQEAGFRNPAIIIIGQVVNLRSTLAWLEDKPLFGRRVIVTRPRAQAEGLTRSLADLGAEVINFPVIRTEPPADWHPLDTALDAIGEFDWIIFTSANGVRYFWRRLLERHQDIRSLAGIRIAAIGPATSRALKERGLLTDWQPREYVAEAVASGLGPRVRGRRVLLPRADIARPFLAVDLRRQGAEVTEVTAYRTVKNEENAGSLKEMLAAGKVAAVTFTSSSTVRAFLDLLGDGALDLVQGIDVFCLGPVTAATAREAGLQVAATAGEYTEEGLVRAMENYYTTIRAGGGDSNQSRSL

SEQ ID NO: 19084 - protein, 462 aa, Oryza sativa
MDPCPFVRVLVGNLSLKMPVAPRPAGAGAGVHPSTSPCYCKIRLNKLPYQTADAPLLLPPSPEASAAPAPAPATGALAAAFHLSKADLDRLTAKPSLFGSRTARLKIVVYAGRRGTTCGVGGGSGRLLGKVVIPLDLKGASAKPVVYHSSWICIGKRGRKPSSVSAANAQLNITVRAEPDPRFVFEFDGEPECSPQVLQVQGSMKQPMFTCKFSCRSNSDLRSRSMPADMGSGGRNWLTAFGSDRERAGKERKGWSVTVHDLSGSPVALASMVTPFVASPGTDRVSKSNPGAWLVLRPGDGTWKPWGRLECWRERGAGAAAGDSLGYRFELVLPDPTGMGVGVSVAESTIPASKGGRFAIDLTATQQFGRSGSPACSPCGSGDYGMWPFGSCRGFVMSPAVQGEGKCSRPAVEVGVQNVGCAEDAAAFVALAAAVDLSMDACRLFSHRLRRELSASRSDLLR

SEQ ID NO: 19085 - protein, 230 aa, Salinibacter ruber
MTPSTQSYWLLGAALLAAVLAGGMFFQGPAPDGNAPSPAPTDSVPAAVADTATFAGGCFWCMEPPYDKIDGVASTTSGFAGGEEVDPSYREVASGATRHTEVVQVVYDSTTVSYERLLRVYWHNVDPFDGTGQFCDRGSQYRPAIFAHDAQQQRSAERSKDTVAAQFDRDIAVQVQSLDAFYAAEQYHQNYYQKNPADYKRYRQGCGRDARLREIWGEAALSDAPLDGTT

SEQ ID NO: 19086 - protein, 502 aa, Oryza sativa
MGMERPQEKVATTTTAAFNLAESGYADRPDLDDDGREKRTGTLVTASAHIITAVIGSGVLSLAWAIAQLGWVIGPAVLVAFSVITWFCSSLLADCYRSPDPVHGKRNYTYGQAVRANLGVAKYRLCSVAQYVNLVGVTIGYTITTAISMGYLLSTMTNYSSKFGHAIKRSNCFHRNGHDAACLASDTTNMIIFAGIQILLSQLPNFHKIWWLSIVAAVMSLAYSTIGLGLSIAKIAGGAHPEATLTGVTVGVDVSASEKIWRTFQSLGDIAFAYSYSNVLIEIQDTLRSSPAENEVMKKASFIGVSTTTTFYMLCGVLGYAAFGNRAPGNFLTGFGFYEPFWLVDVGNVCIVVHLVGAYQVFCQPIYQFAEAWARSRWPDSAFVNGERVLRLPLGAGDFPVSALRLVWRTAYVVLTAVAAMAFPFFNDFLGLIGAVSFWPLTVYFPVQMYMSQAKVRRFSPTWTWMNVLSLACLVVSLLAAAGSIQGLIKSVAHYKPFSVSS

SEQ ID NO: 19087 - protein, 591 aa, Cryptococcus neoformans
MPFGFTHKPLVALANSAICSFFREIEVYGAENVPTEGPIIFACTHANMAVDPALLSNTVPHGHLMHYWVKDSLFKNPAVGWLLHNAGNIAVDRTTRNNQMLFRGTFEALALGECIGVFPEGTSHTEPHIIPLKDGTSWAALEYVRYLQGTEENKGAKKGKKAVVVPVGIAYVDKAKYRSRVVVHYRKPITMEQFESQFLSDEPGANKVAVKNLTKAITLEFRKMTVNCPDWDTAFAAQMARELLWERESDLPLADYVQVSQTLVDLFCTPNSKIENLKTLLATYQRLLTSSRLSNAALVGLKLPRQLNPDSVTSLPSRFSTLWLLIKDSIACLIRLPFFIVPMLLHIPVYIVGILGARLVEDELETQAQMKITFGLLLSFLTYPVLFFSLWAVFRNWTLGTVMAAGAVWLLGRYHSALIDENYDAMKRLVAAWRLVVGVWLPRDFEMPLPNFVAQYSLFAPDPPKVAGLPPATPPEKYQKPKRLSSRVLVKHILRVRAQAARELAELLLELENGEEVVAQTWLAEEFGGKVLQQSQQDGAEEQLTGRWVKQGGTRSGREVLQYLKSKGARLGFTAEEVGAVNASGVDTEME

SEQ ID NO: 19088 - protein, 357 aa, Unknown
  Frankia sp. CcI3
MDAVMLVGGQGTRLRPLTMSAPKPMLPVAGVPVTAHMLARARDAGIDRVVLATSYRAEVFEEYFGDGSAHGLQLEYVTETEPMGTGGAIRNVAERLHGGPGDPVVIFNGDILAGLDIQALVARHTGTGAAVTLHLTRVVDPRAFGVVPVDDDGRVTAFLEKTPDPPTNLINAGCYVFRRSVIDTIPTGRPVSVERETFPGLLAAGTAVMGYPDDTYWLDLGTPAAFVQGSRDLVTGRMASPALPGPVGDCLVLPGAVVAADAKIGGGATVGAGAWVGAGAAIDGAVLFDGAVVEAGAVVRDSVIGRDAVIGSGVALDGVVIGDGVRIERGNELRSGARVFPGVVLSAGAVRFSSDRT

SEQ ID NO: 19089 - protein, 370 aa, Coprinopsis cinerea
MFEIGIKLGEAVFRMSQAGITPISERETRGSPPTNYILPEYVHFKNPQGRYLKSTANKIGWYGLKWDPTVPDIDCRFRVQHIPEEPGNFYVLGRAGDKYRFSVSMYKTSGSTKYYDCDVSSIPVNVVPPSYVWRLVAVGGNDIYLVSDNTYDRPIIFMSNYDNQRYRLWDHNNDSWLDVVRSTTYAGDSNRITVERAALRTDIYDVNYNIDAGKVIDLTPTIAVEKVLENRTGADASQSVAYTYTKSEEGNWNNVLGIELGQTFTFKAGIPFIAQGEAEISISEAYERQWGGSTIESNEVQTSTTVTVPAHTTVRLTVLIYKSQLDIPFTYTERITNFDGTVTEIKNKEGMYHNVQFIKDHATSEVIGRI

SEQ ID NO: 19090 - protein, 945 aa, Arabidopsis thaliana
MSQCIDGFKHVCSSFFRCFDIDIYKQSGGLGDPELLARETVFSVSEIEALYELFKKISSAVIDDGLINKEEFQLALFKTNKKESLFADRVFDLFDTKHNGILGFEEFARALSVFHPNAPIEDKIDFSFQLYDLKQQGFIERQEVKQMVVATLAESGMNLSDEIIESIIDKTFEEADTKHDGRIDKEEWRTLVLRHPSLLKNMTLQYLKDITTTFPSFVFHSQFLSTRLSMDSTRNSASSNSTGCFTDQKKRKALYEVFKKLSGVDCQRNEGNVVEGVTCYYGEMNKEQFHVAIFQTDKNESLFSERVFDLFDTNHDGLLGFEEFARALSVFHPSAPIDDKIDLSFQLYDLKQQGFIERQGVKQLVVATLAASGMSQSDEIVESIIDKTFVQADTKHEGMIDEEEWMDLVFRHPLLLKNMTLQYLKRRRRRLLTTTAMAMAMEISLPFVGSSMALSAGKSRNSVSRISRVGFSSVSAVHVPRRMFMQLSGFGSVLTLLDFPSLAAPVPQMKEPEVIRTLKLPSGVRYQEIIEGEGREAHEGDLVELNYVCRRANGYFVHSTVDQFSGESSPVKLILDENDVIEGLKEVLVGMKAGGKRRALIPPSVGYINETLKPIPEEVVRSLLFIFHNELATYFGPRRSLLSHANEPLVFEIQLLKAWINKGITIPVFLNSLKKFPNYSFYSGKKMVKLSYLRNDAVDFYRRYSIGSPVFFFPNPETQKMSQGWFSMGGSSTVDQQQQSGSSLLADWNSYAASRDFEESGGSFGFDIESAVRSANDTVSGTFSVVSKGVRDIPGSLQSATSSMPSGKALMYFGLLLASGVFFIFIAFTMFLPVMVLMPQKFAICFTLGCGFIIGSFFALRGPKNQLAHMSSMERLPSTLGFIATMVGTIYVSMVLHSYILSVLFSVLQVLALVYYCISYFPGGSSGMRFLSSALTSSALRVFGR

SEQ ID NO: 19091 - protein, 1023 aa, Oryza sativa
MRLHYHHLAVVLLAAVAAAATAAAGGEADALLAVKAALDDPTGALASWTTNTTSSPCAWSGVACNARGAVVGLDVSGRNLTGGLPGAALSGLQHLARLDLAANALSGPIPAALSRLAPFLTHLNLSNNGLNGTFPPQLSRLRALRVLDLYNNNLTGALPLEVVSMAQLRHLHLGGNFFSGGIPPEYGRWGRLQYLAVSGNELSGKIPPELGNLTSLRELYIGYFNSYSGGIPPELGNMTDLVRLDAANCGLSGEIPPELGNLANLDTLFLQVNGLAGGIPRELGKLASLSSLDLSNNALAGEIPATFADLKNLTLLNLFRNKLRGDIPEFVGDLPSLEVLQLWENNFTGGIPRRLGRNGRFQLLDLSSNRLTGTLPPDLCAGGKLETLIALGNSLFGAIPASLGKCTSLTRVRLGDNYLNGSIPEGLFELPNLTQVELQDNLISGGFPAVSGTGAPNLGQISLSNNQLTGALPAFIGSFSGVQKLLLDQNAFTGEIPPEIGRLQQLSKADLSGNSFDGGVPPEIGKCRLLTYLDLSRNNLSGEIPPAISGMRILNYLNLSRNQLDGEIPATIAAMQSLTAVDFSYNNLSGLVPATGQFSYFNATSFVGNPGLCGPYLGPCHPGAPGTDHGGRSHGGLSNSFKLLIVLGLLALSIAFAAMAILKARSLKKASEARAWKLTAFQRLEFTCDDVLDSLKEENIIGKGGAGTVYKGTMPDGEHVAVKRLPAMSRGSSHDHGFSAEIQTLGRIRHRYIVRLLGFCSNNETNLLVYEYMPNGSLGELLHGKKGGHLHWDTRYKVAVEAAKGLCYLHHDCSPPILHRDVKSNNILLDSDFEAHVADFGLAKFLQDSGTSECMSAIAGSYGYIAPEYAYTLKVDEKSDVYSFGVVLLELITGKKPVGEFGDGVDIVQWVKTMTDSNKEHVIKILDPRLSTVPVHEVMHVFYVALLCVEEQSVQRPTMREVVQILSELPKPTSKQGEEPPSGEGAVSDLVVPAESAEANEAKEQQQQQLNSPSSPPPDLISI

SEQ ID NO: 19092 - protein, 419 aa, Chromobacterium violaceum [sequence omitted]

SEQ ID NO: 19093 - protein, 75 aa, Glycine max
  misc_feature (37)..(37): Xaa can be any naturally occurring amino acid
  misc_feature (57)..(57): Xaa can be any naturally occurring amino acid
IYRIESYDVTSIPACIPMYLMSRLIKSLAFNWLISIXGSDKIFGRCVCFLNAPLKEXFHQETCRMIKALHKYDCL

SEQ ID NO: 19094 - protein, 423 aa, Pseudomonas putida
MTESVLDYMTRLGRAAREASRVIGRASTAQKNRALQAAADALDAARAELTAANELDLAAGRANGLEPALLDRLALTPARIDGMITGLRQVASLPDPVGAIRDMSYRPSGIQVGKMRTPLGVIGIIYESRPNVTIDAASLCLKSGNATILRGGSEAIHSNRAIATCIQRGLAEAGLPAAVVQVVETTDREAVGALISMPQFVDVIVPRGGRGLIERISRDARVPVIKHLDGICHVYVSQHADLDKAWNVAFNAKTYRYGICGAMETLLVDQRVAERFLPEMARRFQEKGVELRGCERTRALVEAKPATEDDWHTEYLDAILSIRVVNGLDQAIEHINHYGSHHTDSIISEHQGEARQFMAEVDSASVMLNTPTCFADGFEYGLGAEIGISTDKLHARGPVGLEGLTCEKYVVIGDGQLRGQGTC

SEQ ID NO: 19095 - protein, 207 aa, Olimarabidopsis pumila
MATFEDGSDLEAIQKHLFEDLLVCDGFMGDFDFDASFVSGLWCIEPQVPKQEPDSPVLDPDSFVNEFLQVEAESSPSSPELNTSPLSTYETDQSVKKAERFEEEEEARHYRGVRRRPWGKFAAEIRDPAKKGSRIWLGTFESDVDAARAYDCAAFKLRGRKAVLNFPLDAGKYEAPANSGRKRKRSDVQEELQRTQSNSSSSSCDAF

SEQ ID NO: 19096 - protein, 104 aa, Cryptococcus neoformans
MVKAIESYDEWKTLTSGSDVVVVDYWATWCGPCKMISPHFAKLEGKFPNVKFAKVDVEEQEDIAKEAQIKAMPTFVAYKDGKVIETVTGAVPAKINALLDKVAA

SEQ ID NO: 19097 - protein, 173 aa, Pseudomonas syringae
MSLHELNTLPGVTADPEAATRQFVFNHTMLRVKDITKSLDFYTRVLGFSLVEKRDFPEAEFSLYFLALVDKAQIPEDDKARNEWMKSIPGILELTHNHGTESDATASYHNGNSDPRGFGHICVSVPDVKVACERFETLGVDFQKRLSDGRMNSLAFIKDPDGYWVEIIQPTPL

SEQ ID NO: 19098 - protein, 339 aa, Escherichia coli
MSTSDDIHNTTATGKCPFHQGGHDQSAGAGTTTRDWWPNQLRVDLLNQHSNRSNPLGEDFDYRKEFSKLDYYGLKKDLKALLTESQPWWPADWGSYAGLFIRMAWHGAGTYRSIDGRGGAGRGQQRFAPLNSWPDNVSLDKARRLLWPIKQKYGQKISWADLFILAGNVALENSGFRTFGFGAGREDVWEPDLDVNWGDEKAWLTHRHPEALAKAPLGATEMGLIYVNPEGPDHSGEPLSAAAAIRATFGNMGMNDEETVALIAGGHTLGKTHGAGPTSNVGPDPEAAPIEEQGLGWASTYGSGVGADAITSGLEVVWTQTPTQWSNYFFENLFKYEWV

SEQ ID NO: 19099 - protein, 324 aa, Solanum tuberosum
MVFSSFPVYLDHPNLHQLQQPDGHQQGNTGLENPTLQPPPMQVGASPGSIRPGSMVDRARLAKIPLPEAGLKCPRCDSTNTKFCYFNNYNLSQPRHFCKTCRRYWTRGGALRSVPVGGGCRRNKRSKSNNNNNSSKTAGSNVNTNTIASGTSTSASPSSCSTEIMNGRHHFSHEQPPQLTPLMAAFQNLNHHYGGFQPPPLVSTHHGNGTGALGHHHEMGFQIGSSTNTNNLPVPPGGGSDHQWRLPSLAANTNLYPFQHGTDQGIHESSSVNNNNINAHDDQGLNSTKQFLGTMENNTNQYWGGNAWTGFSGLNSSSSASHLL

SEQ ID NO: 19100 - protein, 589 aa, Citrus sinensis
MDTANAMGSTGQPGSAPAPVRGGASVGTLGRHLARRLVEIGAKDVFSVPGDFNLTLLDHLIAEPELNLVGCCNELNAGYAADGYARSRGVGACVVTFTVGGLSVLNAIAGAYSENLPVICIVGGPNSNDYGTNRILHHTIGLPDFTQELRCFQAITCSQAVVNNLGDAHELIDTAISTALKESKPVYISISCNLPGIPHPTFARDPVPFFLAPKVSNQLGLEAAVEATADFLNKAVKPVLVGGPNIRVAKAQKAFIELADATGYPIAIMPSGKGLVPEHHPHFIGTYWGAVSSSFCGEIVESADAYVFVGPIFNDYSSVGYSLLIKKEKAIIVQPHRVTVGNGPSLGWVFMADFLSALAKKLRKNTTALENYRRIYVPPGIPVKRAQNEPLRVNVLFKHIQDMLSGDTAVIAETGDSWFNCQKLRLPENCGYEFQMQYGSIGWSVGATLGYAQAAKDKRVIACIGDGSFQVTAQEISTMIRCGQRSIIFLINNGGYTIEVEIHDGPYNVIKNWDYTGLVNAIHNGEGKCWTAKVRSEDELTEAMKAATGEQKDSLCFIEVFVHKDDTSKELLEWGSRVSAANSRPPNPQ

SEQ ID NO: 19101 - protein, 197 aa, Poa pratensis
MTRFPPACERFVDVLGLKTAFSAFMGKIPVNKKIKNESSQEDLEKRVISLIASLFGGITKGSRRIRLLGKFVENECEKIDRLMELYTRYSDRVKAETERFESLDLDDLEMNDDERYNRKLEAGLYTLQLVALILGHIWLSGNSQMRTRIELLLRQNKLTKDDVKDILQEYHDNIGDLDGPEEKEKAQGRTKEIIAAL

SEQ ID NO: 19102 - protein, 156 aa, Solanum chacoense
MADVQRRGRPLPPPPPRGPLGPPPQRIAPRPVPVDREKTCPLLLRVFTKVGGHHNVNEFAVRGKEPKDEVQIYTWMDATLRELTDLVKEVAPEARRRDAILSFAFVYPDKRGRFVVREVGTTFSYPNMRRPDNGSKTLSELKFQIGDYLDVAIMFQ

SEQ ID NO: 19103 - protein, 157 aa, Apium graveolens
ILGFWILDVANNMMQGPCRALLADMSGHNHKKTRTANSYYSFFMAVGNVLGYAAGSYTDLYKVFPFTKTKACDVYCVNLKTCFIFAIILLLVLTTAAMTLVKERPLVLSHQSNADQDEEDEEEVSMPFFGQILSALGNLSRSMWMLIVVTSLNWIAW

SEQ ID NO: 19104 - protein, 234 aa, Pinus thunbergii
MSRRYWNIDLEEMMEARVHLGHKTRKWNPKMAPYIFTERKDTHIINLAKTARSLSEACDLLFDIAGRGKQFLIVGTKYQATDLVASAATEARCHYVNRKWLGGMLTNWSTTETRLQKFKDLKKEQDTGRFNQLPKKEAAMLKRQLDQLQKYLGGIRYMTSLPDIAIITNQREESIALGECRTLGIPTICLVDTDCDPDLVDIPIPANDDGIASIQLILNRLTSAICEGRALRSL

SEQ ID NO: 19105 - protein, 220 aa, Galdieria sulphuraria
  misc_feature (111)..(111): Xaa can be any naturally occurring amino acid
MMMTFVQPCRLFTGRWNPLIKVRSNSCCVATNLYFLRASASLPQKSKAIPFLDRPPALDGSMVGDVGFDPLNISSYLDLRWLRESELKHCRIAMLAVVGWFVQEVFHLPNXIYSASDPTEAFWKTLATGPMGQIVLWTSFFEIISTPAVIQMLQGSGREPGYFGFDPLGLGKNPQLYKRFQLSELKNGRLAMIAIGGLIHQSFLTHMGAIQQLQQHKWFP

SEQ ID NO: 19106 - protein, 695 aa, Blastopirellula marina
MLMVYPHPELQFTHILPYGAVLHERGVQFVVFSRNATAMRLLMYKSVDDTEPSEIIDFDRDTDRWGDIWSIFVPGVSAGQLYHFQAEGPYDPSRGMLFDGRARLIDPYAKALAGTFQPAFDGIVRPPKCVVVDDQFNWEGDRHLRRDLSESIIYEMHVKGFTASETSGVKNPGTYAGVVEKIPYLKSLGVTAVELMPVHEFPIMDMMTGEKPTRNNYWGYDSMAFFAPHRGYAASKEPGGQVREFKEMVKALHQAGIEVILDVVYNHTCEGNEMGPILGFKGLENQVYYMMANGGSHYKNYSGCGNTVNGNHPIVREMIFHSLRHWVHNYHIDGFRFDLASILSRDRNGNLVPNPPLVEAIAEDPLLADTKIIAEAWDAAGAYQVGSFANMRWAEWNGRYRDDLRSFWRGDPGKLGALATRLAGSSDLYQPGGRQPYHSINFITSHDGFPMNDMVSYNDKHNDANGENNRDGDNHNISYNYGVEGPTRRRSIEKTRQRQIKNMMTTLLLSQGVPMILMGDECRRTQGGNNNAYCQDNEISYMNWKLVEKNADLRRFVKALVAFRRDQPTVRQKHFLSGKPTGRRGLFDVNWYSALGTAVTWDAAEGTLTCVLAAPEPFNDPHGVGRDVLLIMNSSAAPAQFILPPVAKATSWRMFVDTAAEPPADVYPDLNGPRPPASGKFVMPERSMRVYVAAR

SEQ ID NO: 19107 - protein, 499 aa, Oryza sativa
MALLRCLFLLAVLLPHRNAAVVAAASPHHGPAPHDYRDALTKSILFFEGQRSGKLPPSQRVSWRGDSGLSDGSSIKVDLVGGYYDAGDNMKFGFPLAFSMTMLAWSVVEFGGLMKGELQHARDAVRWGSDYLLKATAHPDTVYVQVGDANRDHACWERPEDMDTPRTVYKVDPSTPGTDVAAETAAALAAASLVFRKSDPAYASRLVARAKRVFEFADKHRGTYSTRLSPYVCPYYCSYSGYQDELLWGAAWLHRATKNPTYLSYIQMNGQVLGADEQDNTFGWDNKHAGARILIAKAFLVQKVAALHEYKGHADSFICSMVPGTPTDQTQYTRGGLLFKLSDSNMQYVTSSSFLLLTYAKYLAFSKTTVSCGGAAVTPARLRAIARQQVDYLLGSNPMGMSYMVGYGAKYPRRIHHRASSLPSVAAHPARIGCSQGFTALYSGVANPNVLVGAVVGGPNLQDQFPDQRSDHEHSEPATYINAPLVGALAYLAHSYGQL

SEQ ID NO: 19108 - protein, 525 aa, Cucumis melo
MVAMDSCFVSLKSNTQLMKGNWGGLDRCENGFMVEKVRGGFNENVWIKSLKYEKKALKLTPNVAYAVTPNVSKQPMTIQVPTVPKVKANPKNVASIILGGGAGTHLFPLTKRSATPAVPAGGCYRLIDIPMSNCINSGINKIFVLTQFNSASLNRHISRTYFGNGVTFKEGFVEVLAATQTSGESGMYWFQGTADAVRQFIWVFEDAKNRNVENILILAGDHMYRMGYMDFVQNHIDRNADISISCAAVDDSRASDYGLVKLDSRGRIIQFSEKPKGANLNRMRVDTTSFGLSREESLKSPYIGSMGVYVFKTDVLLNLLKWRYPSSNDFGSEIIPAAIKDHNVQAFMFRDYWEDIGTIKTFYDANLALHGNVSKFEFYDPKTPFYTSPRFLPPTKIDRCQIVDAIISHGCFLRECSIQHSIVGERSRLDYGVELKDTIMMGADNYQTESEITGLLAEGKVPVGIGPNTKIRKCIIDKNAKIGKDVIIMNKDGVQEADRPEQGFYIRSGITIVMEKATIEDGTVI

SEQ ID NO: 19109 - protein, 429 aa, Clarkia delicata
AAHLKQKIDRMNNGDHINSTENRSVLHVALRAPRNSVICSDGKNVVPDVWNVLDKIKDFSERVRNGSWVGATGKELKDVIAVGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYSFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLGIYEHRVAVQG

SEQ ID NO: 19110 - protein, 267 aa, Triticum aestivum
MAAPVSAIGFEGYEKRLEITFSEASIFADPHGRGLRALSRAQIDSVLDLARCTIVSELSNKDFDSYVLSESSLFIYSQKIVIKTCGTTMLLLTIPRILELAEELCMPLAAVKYSRGMFIFPGAQPAPHRSFSEEVDVLNRYFGHLKSGGNAYVIGDPAKPGQKWHIYYATEQPEQPMVTLEMCMTGLDKKKASVFFKTQADGHVSCAKEMTKLSGISDIIPEMGGFVTFDFEPCGYSMNAINGSAFFTIHVTPEDGFSYATYEVQGM

SEQ ID NO: 19111 - protein, 452 aa, Erwinia carotovora
MDNQQTDGTLKRGLKNRHIQLIALGGAVGTGLFLGIAQTIKMAGPSVLLGYAIGGLIAFLIMRQLGEMVVEEPVAGSFSHFAYKYWGDFAGFASGWNYWVLYVLVAMAELSAVGIYVQYWWPDIPTWVSAAVFFLLINAINLANVKVYGEMEFWFAIIKVAAIIGMIAFGGWLLISGTGGPEATVTNLWAQGGFFPNGGLGLVMAMAVIMFSFGGLELVGITAAEADDPEKSIPRATNQVIYRILIFYIGSLAILLSLYPWGKVVEGGSPFVMIFHELNSNVVATILNVVVLTAALSVYNSCVYCNSRMLFGLAKQGNGPKVLETIDSRGVPVVAIGISALATALCVLINYLIPGKAFELLMALVVSALVINWAMISLAHLKFRAQKDKEGTVTKFKALLYPLGNYICLLFLAGILVIMFLTPGIQISVMLIPVWLIILGVGYFIKKKNQAK

SEQ ID NO: 19112 - protein, 128 aa, Bacillus subtilis
MSIEVGSKLQGKITGITNFGAFVELPGGSTGLVHISEVADNYVKDINDHLKVGDQVEVKVINVEKDGKIGLSIKKAKDRPQARPRNDFRPKESFEQKMNKFLKDSEDRLSSLKRNTESKRGGRGARRG

SEQ ID NO: 19113 - protein, 1192 aa, Solanum lycopersicum
MSHKRCHEYFSLNGVLKNVVFMIILLSSSFLVVVSNARKLAENDQVGRLLAFKKSSVESDPNGFLNEWTLSSSSPCTWNGISCSNGQVVELNLSSVGLSGLLHLTDLMALPTLLRVNFSGNHFYGNLSSIASSCSFEFLDLSANNFSEVLVLEPLLKSCDNIKYLNVSGNSIKGVVLKFGPSLLQLDLSSNTISDFGILSYALSNCQNLNLLNFSSNKIAGKLKSSISSCKSLSVLDLSRNNLTGELNDLDLGTCQNLTVLNLSFNNLTSVEFPPSLANCQSLNTLNIAHNSIRMEIPVELLVKLKSLKRLVLAHNQFFDKIPSELGQSCSTLEELDLSGNRLTGELPSTFKLCSSLFSLNLGNNELSGDFLNTVISSLTNLRYLYLPFNNITGYVPKSLVNCTKLQVLDLSSNAFIGNVPSEFCFAASGFPLETMLLASNYLTGTVPKQLGHCRNLRKIDLSFNNLVGSIPLEIWNLPNLSELVMWANNLTGEIPEGICINGGNLQTLILNNNFISGTLPQSISKCTNLVWVSLSSNRLSGEIPQGIGNLANLAILQLGNNSLTGPIPRGLGSCRNLIWLDLNSNALTGSIPLELADQAGHVNPGMASGKQFAFVRNEGGTECRGAGGLVEFEGIREERLAILPMVHFCPSTRIYSGRTMYTFTSNGSMIYLDLSYNSLSGTIPDNLGSLSFLQVLNLGHNNFTGTIPFNFGGLKIVGVLDLSHNSLQGFIPPSLGGLSFLSDLDVSNNNLSGTIPSGGQLTTFPASRYENNSGLCGVPLPPCGSGNGHHSSSIYHHGNKKPTTIGMVVGIMVSFICIILLVIALYKIKKTQNEEEKRDKYIDSLPTSGSSSWKLSTVPEPLSINVATFEKPLRKLTFGHLLEATNGFSSESMIGSGGFGEVYKAQLRDGSTVAIKKLVHVTGQGDREFMAEMETIGKIKHRNLVPLLGYCKIGEERLLVYEYMKWGSLESVLHDGGKGGMFLDWPARKKIAIGSARGLAFLHHSCIPHIIHRDMKSSNVLLDENFEARVSDFGMARLVNALDTHLSVSTLAGTPGYVPPEYYQSFRCTAKGDVYSYGVILLELLSGKRPIDPRVFGDDNNLVGWAKQLHNDKQSHEILDPELITNLSGDAELYHYLKVAFECLDEKSYKRPTMIQVMTKFKEVQTDSESDILDGISVKGSILEESQEREP

SEQ ID NO: 19114 - protein, 1007 aa, Medicago truncatula
MIPLTLTVFTLFSVLFSSVSASSLLSDFHALVTLRQGFQFPNPVINTWNTSNFSSVCSWVGIQCHQGRVVSLDLTDLNLFGSVSPSISSLDRLSHLSLAGNNFTGTIHITNLTNLQFLNISNNQFSGHMDWNYSTMENLQVVDVYNNNFTSLLPLGILSLKNKLKHLDLGGNFFFGEIPKSYGKLVSLEYLSLAGNDISGKIPGELGNLSNLREIYLGYYNTYEGGIPMEFGRLTKLVHMDISSCDLDGSIPRELGNLKELNTLYLHINQLSGSIPKQLGNLTNLLYLDLSSNALTGEIPIEFINLNRLTLLNLFLNRLHGSIPDYIADFPDLDTLGLWMNNFTGEIPYKLGLNGKLQILDLSSNKLTGIIPPHLCSSSQLKILILLNNFLFGPIPQGLGTCYSLTRVRLGENYLNGSIPNGFLYLPKLNLAELKNNYLSGTLSENGNSSSKPVSLEQLDLSNNALSGPLPYSLSNFTSLQILLLSGNQFSGPIPPSIGGLNQVLKLDLTRNSLSGDIPPEIGYCVHLTYLDMSQNNLSGSIPPLISNIRILNYLNLSRNHLNQSIPRSIGTMKSLTVADFSFNEFSGKLPESGQFSFFNATSFAGNPKLCGSLLNNPCKLTRMKSTPGKNNSDFKLIFALGLLMCSLVFAVAAIIKAKSFKKKGPGSWKMTAFKKLEFTVSDILECVKDGNVIGRGGAGIVYHGKMPNGMEIAVKKLLGFGANNHDHGFRAEIQTLGNIRHRNIVRLLAFCSNKETNLLVYEYMRNGSLGETLHGKKGAFLSWNFRYKISIDSAKGLCYLHHDCSPLILHRDVKSNNILLSSNFEAHVADFGLAKFLVDGAAAECMSSIAGSYGYIAPEYAYTLRVDEKSDVYSFGVVLLELLTGRKPVGDFGEGVDLVQWCKKATNGRREEVVNIIDSRLMVVPKEEAMHMFFIAMLCLEENSVQRPTMREVVQMLSEFPRQSTSSSSSSSSSSSSNSSSNPPIKKLIQNHKLPCPPTFKQDLLV

SEQ ID NO: 19115 - protein, 942 aa, Haemophilus somnus
MKRMLINATQKEELRVALVDGQRLFDLDIENPGHEQKKANIYKGRITRVEPSLEAAFVDYGVERHGFLPLKEIAREYFPDDYVYQGRPNIRDILSEGQEVIVQVNKEERGNKGAALTTFVSLAGSYLVIMPNNPRAGGISRRIEGDERLELKEALSSLDVPEGVGLIVRTAGVGKSPEELQWDLKVLLHHWEAIKQASQSRPAPFLIHQESDVIVRAIRDYLRRDIGEILIDSPKVYEKAKAHIKLVRPDFINRVKLYQGEVPLFSHYQIESQIESAFQREVRLPSGGSIVIDATEALTAIDINSARSTRGGDIEETALNTNLEAADEIARQLRLRDLGGLIVIDFIDMTPVRHQREVENRMREAVRQDRARIQISRISRFGLLEMSRQRLSPSLGESSHHVCPRCQGTGKIRDNESLSLSILRLLEEEALKENTKQVHTIVPVQIASYLLNEKRKAIHSIEKRHNVDIVVAPNEAMETPHFSVFRVREGEEINELSYNLAKLHEMNDETYVVEDAFISRHLENSAATVESAVENAAVSLAIETPAPMPQERKQERESLLRRIIEGIKNLFADNSSKNKKNKNTRQNKNARHNRRNQDRRSSRRIRQEHEIKSDENNKLDTQHSHYTERYSKHAKKGVDDPQIQTKKAGELEIHTKDDETIETIQPRRQRRDLRKKVRVEENLVDTPNLGSTEEHVENEKTTEPVTSLEQAVLQTENEKTHERQDNNYRHRRLPRHLRVNNQRRRRNVELKSAMPLFAAVASPELASGKVWVDVNVVNSKNNNFLSVDELLKQQYQQEEIEVVIPASEILMDTQSDDIKPLSNFVSQPANEAVEKKVQETLQRLTQEVVDESSTIERTEVDTNISVPEFVREYQFNGRLGTISAVMHTKAEMTLAKSSDEPMQPFSIVEWQDSRYYFYGRGAAGHHCAISHVYSEPANTKIE

SEQ ID NO: 19116 - protein, 180 aa, Bacillus subtilis
MMKHDIEKVLISEEEIQKKVKELGAELTSEYQDTFPLAIGVLKGALPFMADLIKHIDTYLEMDFMDVSSYGNSTVSSGEVKIIKDLDTSVEGRDILIIEDIIDSGLTLSYLVELFRYRKAKSIKIVTLLDKPSGRKADIKADFVGFEVPDAFVVGYGLDYAERYRNLPYIGVLKPAVYES

SEQ ID NO: 19117 - protein, 629 aa, Aspergillus nidulans
MSAAKIEPGSFNIPVGTFPATCKTPQESINAHALATSILSRLNTALSTSKISDIAALFLEQGSFWRDHLCLSWNFHTAKGREGIASLLSQVEKEKLNHLKLEIDISTPFRSPQISAIDAFGEVIGVQFFITVSTAIGSGRGVVRLAEGDEGEWYIYTLYTVLQELTGHEEQVSSRRPFGAVHGEISGRPRLNWQDRRKAETNLDENKEPAVLIVGAGQAGLSVAARLRMLGVDALIIDQEDRVGDNWRRRYHQLVLHDPVWFDHMPYLPFPSNWPVFTPKDKLAEFFECYVKLLELNVWTRTTVKEAKWHADGKEWSVEVIRRTDSGEVKRVLHPRHIIQATGHSGEKNLPEFKGIESFKGSRICHSSEFEGATDADPRKGQQKAVVVGSCNSAHDIAQDYYEKGYDVTMVQRSSTCVISSDAIVNIGLKGLYEENGPPVHDSDVFLYSIPSEQFKAQQVRITAVQNEHDKVLLEGLEKAGFKVDKGPDDAGLLMKYWQRGGGYTIEVGAGRLIADGKIKVKQGEEIAEILPQGLRFADGSELEADEIVFATGYKNMREQTRLIFGDMVANSVNSVWGLDSEGEMRTIWRKTGHPGFWFMGGNLAMCRYYSLLLALQILGIERGLNEVQ

SEQ ID NO: 19118 - protein, 228 aa, Triticum aestivum
  misc_feature (100)..(100): Xaa can be any naturally occurring amino acid
  misc_feature (164)..(164): Xaa can be any naturally occurring amino acid
  misc_feature (177)..(177): Xaa can be any naturally occurring amino acid
MGTPETSREPCPDRILDDVGGAFGMGAVGGSVFHFLKGTYNSPNGERLLGGAQQVRLNAPRVGGSFAVWGGLFSAFDCTMVFVRQKEDPWNSIIAGAATXGGFLSMRQGPGAAGRSALMGGCLLALIEGAGLMLNRVLAAPQNLPPLPTDDPNLAAAMAGGGVXGFPGMPQPPVPPXRVGSSGGGGSWFGGLFGKKEEEKKPSGSGGKSEILESFDTPSPPIPSFDYK

SEQ ID NO: 19119 - protein, 253 aa, Pinus echinata
CGIGSCAFAGGQISSLKPHTNQLLGVGAGVHGEARVTMRKATTKKVSVSASTSPWYGPDRVLYLGPFSGEPPSYLTGEFPGDYGWDTAGLSADPETFAKNRELEVIHCRWAMLGALGCVFPELLARNGVKFGEAVWFKAGAQIFSEGGLDYLGNPSLVHAQSILAIWACQVILMGAVEGYRIAGGPLGEVTDPIYPGGSFDPLGLADDPDAFAELKVKEIKNGRLAMFSMFGFFVQAIVTGKGPIENLADHLA

SEQ ID NO: 19120 - protein, 209 aa, Haemophilus somnus
MGKKKRSASSSRWLNEHFKDPFVQKAHKQKLRSRAYFKLDEIQQSDRLFKHGMTVVDLGAAPGGWSQYAIRQIGDLGRVIACDILEMDPIVGVDFLQGDFRDENVLQALLERVGEKKVDVVMSDMAPNFSGMPAVDIPRAMYLVELALDMCKQVLATNGCFVVKVFQGEGFDDYLKEIRSLFNTVKVRKPEASRGRSREVYIVAMGYMG

SEQ ID NO: 19121 - protein, 510 aa, Streptococcus pyogenes
MALSPDIKEQLAQYLTLLEADLVLQVSLGDNEQSQKVKDFVEEIAAMSERISIENITLDRQPSFKVAKKGHDSGVVFAGLPLGHELTSFILALLQVSGRAPKVDQDVIDRIKAIDRPLHFETYVSLTCHNCPDVVQALNIMSVLNDKISHTMVEGGMFQDEVKAKGIMSVPTVFLDGEEFTSGRATIEQLLEQIAGPLSEEAFADKGLYDVLVIGGGPAGNSAAIYAARKGLKTGLLAETFGGQVMETVGIENMIGTLYTEGPKLMAEVEAHTKSYDVDIIKAQLATSIEKKENIEVTLANGAVLQAKTAILALGAKWRNINVPGEDEFRNKGVTYCPHCDGPLFEGKDVAVIGGGNSGLEAALDLAGLAKHVYVLEFLPELKADKVLQDRAADTANMTIIKNVATKDIVGDDHVTGLNYTERDSGEDKHLDLEGVFVQIGLVPNTAWLKDSGVNLTDRGEIIVDKHGSTNIPGIFAAGDCTDSAYKQIIISMGSGATAAIGAFDYLIRQ

SEQ ID NO: 19122 - protein, 686 aa, Prochlorococcus marinus
MGKVKVGSAWPLGSSVTLDGVNFSIAAPHATNLELLIFQNEDDEYAKETISLDQKNRSGDYWHVEIEGLAEGTLYGYKVSIDGQKAAEDHLVLDPCARAITGWKNYIRNHKEKVNRGYAHCLKGVVTKRDYFDFKSHPRPKHSWNKTIIYELHVGGFTKSNDSSVSERKKGTFLGLIEKIPYLKSLGITTIELLPVFAFDSNDAPEGLVNYWGYSPINWFTPHQDFVDSCNPLEARRQFKKLVEVCHDNELEVLIDVVYNHTTEGNQNGPNISWKNFGPKTYYHQDDKENYQDVSGCGNSIAANRPLVRKLILESLRCWAIELGVDGFRFDLGIALSRGENLIPLDKPPLFEEIEADPKLSDVKLISEPWDCGGLYKLGDFPAKQFRTWNGHFRDDIRRFWKGDKGTIWPLKDRLIGSKSLYKDNNLANIFSINFITSHDGFTLKDLVSFNKKHNLANGENNRDGENNNNSYNYGVEGPTTDKEINNLRQKQQRNLLATLLLSPGVPMILMGDELGRSQGGNNNTWCQDNPLGWMDWNHNNWDHDLKEFVLKLISLRKQLSEFFSPDSIYDCQKDNTKVKTSYFWIQWHGIKVNKPDWGDWSHTLGFSINKNNDGSAIWLGFNAYKESMLFDLPTPISPWKKYIDTSILKTKNVSKKTLANQSNVRIESNSLVLMVSSEYSKKIKL

SEQ ID NO: 19123 - protein, 473 aa, Citrus sinensis
MAGLTLVYDLVLYISISTVIFFIIKRSRSRRLRLPPGSLGLPFLGETLQLIAAYKTENPEPFIDVRVKRFGSIFTTHIFGEPTVFSADPETNRFILQNEGKSFECSYPGSVSNLLGKHSLLLMKGSLHKRMHSLTMTFANSSIIRDHLLVVIDRLVRLHMDSWTDRVLLMEEAKKITFELTVKQLMSFDPNEWTESLRKEYVLVIEGFFTVPLPIFSTTYRRAIQARTKVAEALSLVVRQRRKESEPGERKNDMLEALLAGDDGFSDEEIVDFLVALLVAGYETTSTIMTLAVKFLTETPLALAQLKEEHDEIRAKKSKQEPLEWNDYKSMPFTQCVVNETLRVANIISGVFRRAMTDINIKGYTIPKGWRVFASFRAVHLDHDHFKDARSFNPWRWQNNSGATSPVNVSTSFGGGPRLCPGYELARVELSVFLHHLVTRFSWVPAEQDKLVFFPTTRTQKRNPIIVQRRNEN

SEQ ID NO: 19124 - protein, 573 aa, Alteromonadales bacterium
MSSTTQSPSKSRLLGHDILLITVMAVLAGCGLIYEYLLSHYAGRVLGSVESAIYAMIGTMIVAMGLGAFLARWFKDAFTAFAWLESIIALIGMGCILAIASVIAVSYSLPHLFSSIFNLPPDVVLNGYVFQKLQEWSRFLPYVFGLVLGLFIGMEIPLIARIRQHVYGRFLENNAGTIYGADYIGAGIGAAIWVSIMLAMPIMQAAAWTALFNIIAGLAFLWRYHAHVRFAKALLVCHILLLVLFGFILVLGSSWMNSLSNVLYKDKVIYSQATKYQHVVLTERLSKNQPQPITDLYLNGRLQFSSVDEQIYHSMLVYPAMLASNRHDKVLIIGGGDGLALRDVLKWSVNEVTLIDLDGQLLNLFGHEDDKFTPPKAITQRLINLNNDSMKDPKANIIVGDAFLEVEKLLDQNKQFDTVIIDLPDPNHPDLNKLYSDYFYNHVRQLLAPDGAMAVQSTSPYHAKKAFLSIAKTVKAAGFDYVEQYQQNIPSFGQWGWTIATKMGQPASARISNIGEMPVSSRWISKKYLLASFVFPNQYFEQINDIEVNRLGSGQLYDYYRSAWQIESELYKN

SEQ ID NO: 19125 - protein, 895 aa, Candida glabrata
MEQQGVLAPPSINERNRSLSFSKLLSRSWRKNSTSAVASDNSTDTENNAANPNMIALQKKILSSKTDSWSEAVDDEPVPSGGSQSRFTKLKNIFNNNNSNHNTSNSTRSGSSCASTVSGKSSFEKLPKDISQVRSNSIPSPQKSPYSDKKGHNATSDVEIGLVSPVSDKMNIDLPQVPTSVHASTLTGEHLKELHEYEIAKPKQEAYALNSGKNANRRRSPSTPIKPSPSLVSSQSANGQFSSTNPFNTGTGYANYKERGTVQTTNSYFNYQGLPPHARNENDSNLNAFQNGSKYAAVQEMLSLPTTPSSMNTSLTTHNKEGRNLSNVSLNEIKENEEVSEFYGMDEVPNLDSMGNKKMASSSPLRARSGSPKASNVMDSAQPFPSIVVGYDDADAETDEQSANPSRGSHISSEQKGKPELNPPKNAKFPLRRAASETDAIDLNILKSVKAASGDLSDTTDQHTKLEEIKEPRRSSRLRNKSFSNKFQDITVGPQSFEKIRLLGQGDVGKVYLVKEKRTNRLYALKIFSKSEMIKRKKIKRILAEQEILATSNHPFVVTLYHSFQSEDYLYLCMEYCMGGEFFRALQTRKSKCISEEDAKFYASEVTAALEYLHLLGFIYRDLKPENILLHQSGHIMLSDFDLSIQAKDAKVPVVKGNAQSTVVDTKICSDGFRTNSFVGTEEYIAPEVIRGNGHTAAVDWWTLGILIYEMLFGFTPFKGENTNETFSNILKKDVTFPNNNEVSRNCKDLIKKLLIKNESKRLGSKMGAADIKKHPFFKKVNWTLLRNQEPPLIPVLTENGYDFTKLSSNKNKNRANGTEKDSIDEQERIMFEERVEYDDEVSEDDPFHDFNSMSLMKQDNNSLIYGDNNSYGKIAYTPNANRSRSNSHRAFFKR

SEQ ID NO: 19126 - protein, 572 aa, Oryza sativa
MDELNLLRQHQHQHQHHLVVRGLGEEIDLEIGPGDDPSFPGAALVGVTPGAHDPADDHKSLLIPCSQPVAEGQPQPTPPQVEEHDGLLRLPGQTKKKKKVVKKWREEWADTYKWAYVAVHDNTSRIFCTVCKEYGRKHRRNPYGNEGSRNMQMSALEEHNNSLLHKEALRLQTASKENAQPPEIERPVYVKDMSKFWSVCWNLRDALSSECHGLMIETLKNALSQYKLGGAAGGSDFDPKGKSESEIMRFCQSFMDELYRYLGPDQDFPAEDVGVGPREMGYLFGQYRRLSGHFQGNFTGPKIFWSGSSFRTEATGYGLVFFARVVLADMNKELKGLRCVISGSGKIAMHVLEKLLSCEAIPVTVSDSKGYLLDTEGFDYMKYSVLRNIKAQQRSLKEYLKSYPNAKYIDDAKPWSEKCDVAFPCASQNEIDQAEALAIINSGCRVLIECSNMPCTAQAVDILRTAKVVVAPAKATAAGGVAVGELELNPEFSLMQWSVEDFENKIQDAVKQTYDRSIKAAQDYGIMKENPELVFFLCSEDVFLCFRLVSTQKLIDLSMQVVGAWCKHMCVS

SEQ ID NO: 19127 - protein, 605 aa, Oryza rufipogon
MSALTTSQLATSATGFGIADRSAPSSLLRHGFQGLKPRSPAGGDATSLSVTTSARATPKQQRSVQRGSRRFPSVVVYATGAGMNVVFVGAEMAPWSKTGGLGDVLGGLPPAMAANGHRVMVISPRYDQYKDAWDTSVVAEIKVADRYERVRFFHCYKRGVDRVFVDHPSFLEKVWGKTGEKIYGPDTGVDYKDNQMRFSLLCQAPRILNLNNNPYFKGTYGEDVVFVCNDWHTGPLASYLKNNYQPNGIYRNAKVAFCIHNISYQGRFAFEDYPELNLSERFRSSFDFIDGYDTPVEGRKINWMKAGILEADRVLTVSPYYAEELISGIARGCELDNIMRLTGITGIVNGMDVSEWDPSKDKYITAKYDATTAIEAKALNKEALQAEAGLPVDRKIPLIAFIGRLEEQKGPDVMAAAIPELMQEDVQIVLLGTGKKKFEKLLKSMEEKYPGKVRAVVKFNAPLAHLIMAGADVLAVPSRFEPCGLIQLQGMRYGTPCACASTGGLVDTVIEGKTGFHMGRLSVDCKVVEPSDVKKVAATLKRAIKVVGTPAYEEMVRNCMNQDLSWKGPAKNWENVLLGLGVAGSAPGIEGDEIAPLAKENVAAP

SEQ ID NO: 19128 - protein, 181 aa, Zea mays
MAYSMLSSAAVVTSPAQATMVAPFTGLKSSSAFPVTRKANNDITSIVSNGGRVSCMQVWPPIGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 19129 - protein, 1004 aa, Oryza sativa
MVEEGRSLAETPTWSVATVTTLMVAACFLVERGISRFAKWLRKTKRKAMLAALEKIREVLLLARCLIVFLTKGNPCLIAELMLLGVISLLLSQTARWISEICVPSSLFTSRFYICSETDYEDLVVGGKRSTMEMNQTVVPNGLFGIQSQNVCSEGHEPFVSYEGLEQLHRFLFILGITHVLYTFVTVVLSMIKIYSWRKFETQACQLPTEQLQARRTKVMQRQSTFVFHHTSHPWSKNKILIWMYHKLPHSYNFHKYMVRSMEDDYNGSVGISWPLWAYAIICIFVNIHGLNIYFWISFAPAILVLLVGTELQHVIAQLALEVVGATAPYVGTQLKLRDDLFWFGKPRVLWWLIQFISFQLELSAQSCFMKNHYMIVLRLTSGILVQFWCSYNTLPLNVIITQMGSKFKKSLVSESVRESLHSWCKRVKDKNRHNLASRSVCSLDTTYEETDHETATVGTLSRTVSATSLDEELTVPFLLLFNGESFTTPSVSQWGEPDFLGSAKLEFLIWGLFTGGDRVAVWDGCSRLLRAEVGCCGHSPGAAAAAARVVKAIANPDPAVELPLTAENVEIVLDEVRPYLMADGGNVALHEIDGNVVRLKLQGACGSCPASVTTMKMGIERRLMEKIPEIVAVEPIADEETGLELNQENIEKVLDEIRPYLSGTGGGELEFVAIEEPIVKVRLTGPAAGVMTVRVALTQKLREKIPKIAAVQLLSRKKRNAGATNGIGRETARVLARRGAEVIIPARTMESGNAVKQSIAEEVPGSRLHVMEMDLASLDSVRRFATAFDSSHTHLNILINNAGIMGCPFKLSKDGIELQFATNHVGHFLLTNLLLDKMKSTARKTGVQGRIVNVSSIAHKRSDGSCFDLNKLNDKSRYKPLIAYAHSKLANILHANELAKRFQLLLPVPTSKSHILSEYFAGVMVSILSVGNLFLKNTQQGAATTCYLALHPELKDVSGKYFADCKEATPRPAARDAELAKRLWDFSEQLVDTNRRGEFNRQK

SEQ ID NO: 19130 - protein, 72 aa, Sinorhizobium meliloti
MAKEEVLEFPGVVTELLPNATFRVKLENEHEIIAHTAGRMRKNRIRVLAGDKVLVEMTPYDLTKGRITYRFK

SEQ ID NO: 19131 - protein, 670 aa, Unknown
  Candidatus Protochlamydia amoebophila UWE25
MNIQITPGSPFPFGANIQEGKVNFALYAKNIEKISLCLFNENDPLNPFKEIELEPSLNKTGNVWHIAIESLPPYTLYAFRVPVENSNYLLIDPYAKSIYSSPDWGNAKPYSPLGRIIPLTTFDWEGIPSPKLPSKDLIIYEMHIRGLTQDQSSQVSHPGTYLGVIEKIPYLKELGINAVELMPIYEFNESEALQINPKTQQKLVNYFGYSTVNFFSPMNRYASEIQENKTLVEFKTMVKELHRHGIEVILDVVYNHTFEGNQMGPIQSFRGLDKHAYYMIDEQGNYLNFSGCGNTFNANHPIVKEFIIQSLRYWVTEMRVDGFRFDLASILCRSENGTPLNPSPLIEAISHDPILSQTKLIAEAWDAGGLYQVGGFYPGQRWAEWNGHYRDIVRRFIKGTSGHKTAFATALSGSQDLYGWRGTPCCSINFITAHDGFSLADLVTYNDKHNLDNGEENRDGFDHNDSWNCGIEGHSNNKKIVALRERQIRNFLLALLVSQGIPMILMGDEYAHTRDGNNNTWCQDNKLNWFLWDKLLEKQSVFRFFKSLITFRKNYPLLKRDTFLEETDVTWHGQVPFNPDWENDNKFIAFSLNIPHEGPDLYVAFNASHVVLTVTIPPARQGMHWVWLVNTHNVAPGDFFEESCRKRVNSNTLKIPSYTSIALKAEVDRS

SEQ ID NO: 19132 - protein, 138 aa, Arabidopsis thaliana
  misc_feature (2)..(3): Xaa can be any naturally occurring amino acid
  misc_feature (12)..(13): Xaa can be any naturally occurring amino acid
  misc_feature (51)..(51): Xaa can be any naturally occurring amino acid
  misc_feature (63)..(63): Xaa can be any naturally occurring amino acid
  misc_feature (67)..(67): Xaa can be any naturally occurring amino acid
  misc_feature (78)..(80): Xaa can be any naturally occurring amino acid
  misc_feature (82)..(83): Xaa can be any naturally occurring amino acid
  misc_feature (85)..(85): Xaa can be any naturally occurring amino acid
  misc_feature (90)..(91): Xaa can be any naturally occurring amino acid
  misc_feature (93)..(94): Xaa can be any naturally occurring amino acid
  misc_feature (100)..(101): Xaa can be any naturally occurring amino acid
  misc_feature (104)..(105): Xaa can be any naturally occurring amino acid
MXXSMVSSAAVXXSPAQATMVAPFTGLKSSAAFPVTRKTNKDITSIASNGXRVSCMKVWPPIXKKKXETLSYLPDLSXXXLXXEXDYLLXXKXXPCVEFXXQHXXALLTPPYCPLMIPFLCPSFVITLPQCISSPPSP

SEQ ID NO: 19133 - protein, 471 aa, Glycine max
  misc_feature (175)..(175): Xaa can be any naturally occurring amino acid
  misc_feature (203)..(203): Xaa can be any naturally occurring amino acid
MKKQVQGPIPNACLSESSRGARWSLNGMTALVTGGTRGIGHAIVNDLAAFGAAVHTCSRNQTELKKCLQEWQTQGFQATGSVNNVGTNFRKPTVEYSAEEYSELMTVNLDSGYHLCQLVYPLLKASVKGSIVFISSVAGVLSKNLACEWANDNIRSNCVVPWATRTPLVEHVICXQNQKFVEDILSRTPLKSIAEAEEVSSLXRSSINRGARWSLNGTTALVTGGTRGIGHAIVSDLAAFGAAVHTCSRTQTELNKCLQEWQSLGFQVTGSVCDVSSPSQREKLIEEVTSILNGKLNIYVNNVGTNFRKPTIEYTAEEYSQLMTVNLDSSFHLCQLAYPLLKASENGSIVFISSVAGVVSLGTGAVYAASKAAINQLTKNLACEWAKDNIRSNCVVPWATRTPLVEHLLRDQKFVDDIMSRTPIKRIAEPEEVSSLVTFLCLPAASYITGQVICVDGGLTVNGFQPSMRIT

SEQ ID NO: 19134 - protein, 646 aa, Oryza sativa
MAAERSGRPLVNPAVPRAGCSNSSQKLNKLKHRGPDWSGLYQCEGNFLAQQRLAIVSPLSGDQPLYNADRTIVVVVRELTHPSIHRQFVTCDKSCHVYLVCCLLNLLCWVGIELKANGEIYNHKKIRKQFASKHTFSTGSDCEVIIPLYEEYGEDFVDMLDGVFAFVLYDTRTKTYMAARDAIGVNPLYIGRGSDGAVWISSEMKALNEDCVEFEIFPPGHLYSSAAGGLRRWYKPQWFAENVPATPYQPLLLREAFEKAVIKRLMTDVPFGVLLSGGLDSSLVAAVTKRHLIKTEAAEKFGAELHSFVVGLEGSPDLIAAREVADHLGTIHHEFHFTVQDGIDAIEEVIYHDETYDVTTIRASTPMFLMARKIKALGVKMVLSGEGSDELLGGYLYFHFAPNKEEFHKETCRKVKALHQYDCLRANKATSAWGLEVRVPFLDKEFINVAMSMDPEWKMYNADLGRIEKWVMRKAFDDEEHPYLPKHILYRQKEQFSDGVGYNWIDGLKAFTEQQVSDEMMKNAAKVYPHNTPVNKEAYYYRMIFERLFPQESARETVPWGPSIACSTPAAIEWVEQWKASHDPSGRLIASHNSASASANHTNHANANANGNSNGKANGNCAMAANGTNGVGLVVANGTANGKMEA

SEQ ID NO: 19135 - protein, 58 aa, Santalum album
KKKGKLPENAKTTLLDWWSTHYRWPYPTEEEKMKLSEITGLDPRQINNWFINQRKGSR

SEQ ID NO: 19136 - protein, 324 aa, Pseudomonas aeruginosa
MSRIFADNAQSIGNTPLVQINRIAPRGVTILAKIEGRNPGYSVKCRIGANMIWDAEASGRLKSGMTLVEPTSGNTGIGLAFVAAARGYKLILTMPASMSLERRKVLKALGAELVLTEPAKGMKGAIQKAEELVAGDPGKYFMPQQFDNPANPAIHEKTTGPEIWNDTEGAVDVLVSGVGTGGTLTGVSRYIKNTRGKPILAVAVEPVTSPVISQTLAGEEVKPAPHKIQGIGAGFVPKNLDLSLVDRVEKIGDDEAKNMALRLMQEEGILCGISSGAAMAAAVRLAEEPNMQGKTIVVILPDSGERYLSSMLFDGLFSEQELTQ

SEQ ID NO: 19137 - protein, 795 aa, Candida albicans
MVQLALFTNNNHNNNSNSNTPNTLNDDTQYDSTTMNTEDTPIIPDKTDKLNGSDSRSSSRNRTRSISFTRFLFNSNNNNNNNKDHTEQSRCPSNETSDNSVGSPEQQNSGFNKLKKMFKTNSSLTQEDGKNSGRTRSASTPLTPPKVKKETSVPVITTTKAPNKEETTTTKIHSPPESPVVQSNPYFQYQGVPAHTNTSQNPQIETAPGRSDMSVALRHNDSVFSLNENGVLEPPEIHYSELSSSSEDNSDPSSPALPKTPMRDLVEKDELHLKPIEDERDLAIPASPFQRALRRVASAPLVHRLLNEKSPEDANNNNNNNNTGNNLGGPFSTSTQTSPKKDEPFDINKHIGEVKITGRPRTYTQDRTYSNAATRIVDVQVGPNSFEKVRLLGKGDVGKVFLVREKSSNKLYAMKILNKKEMIERNKIKRALAEQEILATSNHPFIVTLYHSFQSKDHLYLCMEYCMGGEFFRALQTRDTKTICEADAKFYAAEVTAALEYLHLMGFIYRDLKPENILLHQSGHIMLSDFDLSKQSERAKNPEISFHKSGMHLSSAGSSNHHNGPAIDTKACIDGFRTNSFVGTEEYIAPEVIRGKGHTSAVDWWTLGIFLYEMLFGTTPFKGQDRKKTFANVLKKDVKFSDTQQSISSNCRNLIKKLLIKDEEKRLGSKTGASEIKNHAFFKDTQWALLRHQKPPMIPVLTKSTSTSNSNKKYEKPMEDTEEIDDVTSISKSINEQIDDPFSQFNSVTLRYGGEFEDLNQSPMYNPDSSAYTSVAYTMTSNNENSFRQKSFLKR

SEQ ID NO: 19138 - protein, 527 aa, Clarkia delicata
VEFDNIFLDYSRQQASPDTISKLYKLADAAHLKQKIDRMYNGDHINTTENRSVLHVALRAPRNSSICSDGKNVVPDVWNVLDKIKDFSDRVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEELKKENVSEHLIPHKTFTGNRPSLSILLPTLDAYRIGQLLAIYEHRVAVQGFVWGINSFDQWGVELGKSLATQVRKQLHASRVKGEPVEEGFNFSTKTLLTRYLQATSDVPADPSTLLPNI

SEQ ID NO: 19139 - protein, 246 aa, Cenarchaeum symbiosum
MKGKVYLVGAGPGDPRLLTLRADELIQKADVVLYDRLVTKRIMSRVPRGTPKVYVGRSIGDHTSHQDSTNHHMLEQAKKHKTVVRLKGGDPIIFGRGGEEAEYLKENGIKYEIVPGVTSGIGSATYAGIPLTHRKFASSVVFAAGHEDPGKESDGVDWKAMAGSVDTIVIMMGVTRIGTICSELIEGGADRGTPVAVIENGTTPQERMITGKLHNIEQLIKSSDIRPPAVIIIGGVVGLSEKIKWR

SEQ ID NO: 19140 - protein, 535 aa, Oryza sativa
MDIAFKAAQTLLLPATLVAFNQVPMSIWFQFHPSGTCPSPAGDLAALPRRLLGRRLRGNRWVERHLPRLRLQRWIGRSSCERSGFSSALLHQVDRGMGMRGCWFWSSVWGFGGSLCQFATSMAVDQLFLLVGPHMTFSGMDIALKASTHSSTSQQHWLHSTRTDGGSLSADKWNGYVNKDDRALLKASAPGLNDVIRQIVFTLEIYGVKNIVGIQFGYRGFFEKGLKEMPLSRKVVENINLSGGSFLGVSRGGAKTSEIVDSIQARRIDMLFVIGGNGSHAGANAIHEECRKRKLKVSVVAVPKTIDNDILFMDKTFGFDTAVEEAQRAINSAYIEARSAYHGIGLVKLMGRSSGFIAMQASLSSGQIDVCLIPEVSFTLDGEHGVMRHLEHLLEKKGFCVVCVAEGAGQDLLQKSNATDASGNVILSDFGVHMQQKIKSHFKDIGVPADVKYIDPTYMVRACRANASDAILCTVLGQNAVHGAFAGFSGITSGICNTHYAFLPITEVITKPKRVNPNSRMWHRCLTSTGQPDFH

SEQ ID NO: 19141 - protein, 464 aa, Streptomyces avermitilis
MQFHDSMISLVGNTPLVRLNSVTAGIQATVLAKVEYFNPGGSVKDRIALRMIEAAEESGALQPGGTIVEPTSGNTGVGLAIVAQQKGYKCIFVCPDKVSTDKINVLRAYGAEVVVCPTAVDPEHPDSYYNVSDRLVRETPGAWKPDQYSNPNNPLSHYHSTGPELWEQTEGKITHFVAGVGTGGTISGTGRYLKDASEGRVQVVGADPEGSVYSGGSGRPYLVEGVGEDFWPTAYDRTVADEIVAVSDKDSFQMTRRLAKEEGLLVGGSCGMAVVAALRVAERLGPDDVVVVLLPDSGRGYLSKIFNDEWMADYGFLEDSGPSARVADVLSDKAGGSIPSLVHMHPDETVGEAIEVLREYGVSQMPIVKPGAGHPDVMAAEVVGSVVERELLDALFTQRASLQDPLEKHMSAPLPQVGSGEPVGDLMSVLGTADAAIVLVEGKPTGVVSRQDLLSFLAKGGGKQ

SEQ ID NO: 19142 - protein, 308 aa, Bacillus subtilis
MVRVANSITELIGNTPIVKLNRLADENSADVYLKLEYMNPGSSVKDRIGLAMIEAAEKEGKLKAGNTIIEPTSGNTGIGLAMVAAAKGLKAILVMPDTMSMERRNLLRAYGAELVLTPGAEGMKGAIKKAEELAEKHGYFVPQQFNNPSNPEIHRQTTGKEIVEQFGDDQLDAFVAGIGTGGTITGAGEVLKEAYPSIKIYAVEPSDSPVLSGGKPGPHKIQGIGAGFVPDILNTEVYDEIFPVKNEEAFEYARRAAREEGILGGISSGAAIYAALQVAKKLGKGKKVLAIIPSNGERYLSTPLYQFD

SEQ ID NO: 19143 - protein, 526 aa, Clarkia delicata
VEFDNIFLDYSRQQASPDTISKLYKLADAAHLKQKIDCMYNGDHINSTENRSVLHVALRAPRNSAICSDGKNVVPDVWNVLDKIKDFSDRVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVMKSQQPVYLKGEVVNNHDELMSNFFAQPDALAYGKTPEQLKKENVSEHLIPHKTFTGNRPSISILLPTLDAYRIGQLLAIYEHRVAVQGFVWGINSFDQWGVELGKSLATQVRKQLHGSRVKAKPVEGFNFSTKTLLIRYLEATSDVPADPSTLLPNI

SEQ ID NO: 19144 - protein, 301 aa, Unknown
  Dehalococcoides sp. CBDB1
MVAKVIVNPVAGARSTEQKWPHISRLMRDMGFSYDFQYTESQGHAIEIARTAALNGYPYLVAVGGDGTINEVVNGILTASQDQKTLMGVVDTGTGNDFVRSLGLDGNYLHSCQHLLSPKHTQVDAGLVIFQKDGRKVSRFFVNGAGVGFDAEVAAATEHMPKALGGTIPFVMALAKTLVGYRNKTIDIRLDTDDYTRRVLSVIVANGSYFGGGMKIAPSALITDSRFDVITLGDVNKLEILQTFPKIYKGTHITHPKVKTEHAHFVSITSGEGLYLQADGELLGKTPATFEVLPQALTMVF

SEQ ID NO: 19145 - protein, 104 aa, Zea mays
  misc_feature (49)..(49): Xaa can be any naturally occurring amino acid
  misc_feature (94)..(94): Xaa can be any naturally occurring amino acid
MVTSTTAAAVLSPPSEAGLRLAPSPRERVTIRREREQRSKETRAEIEPXLMISLETGVSLFLRRFVYLNFQSENVTKQAQEENVKTHLETGNEXNKEYSELLKS

SEQ ID NO: 19146 - protein, 207 aa, Arabidopsis arenosa
MASFQESSDLEAIQSHLFEDLLVCDGFMGDFDFDASFVSGLWCIEPQVPKQEPDSPVLDPDSFVNEFLQVEGESSSSSPELNSSSSSTYETDQSVKKAERFEEEEEARHYRGVRRRPWGKFAAEIRDPAKKGSRIWLGTFESDVDAARAYDCAAFKLRGRKAVLNFPLDAGKYEAPANSGRKRKRSDVQEELQRTQSNSSSSSCDAF

SEQ ID NO: 19147 - protein, 383 aa, Coprinopsis cinerea
MSFNLLRASVRNANPIRRAAAGKAPRNLPSVVRAAPRGRQYSTAPPPPEAKSSSSGLLWGLGAAGAAGVAYFFFQGDAENVVKGGVQSAKAATHFTPSKEDYQKVYNRIADLVADAGDYDDGSYGPVLLRLAWHSSGTYDKESNTGGSNYATMRFEPESLHGANAGLNVARELMEKVKQEFPWISYGDLWTLAGVAAIQEMGGPKIPWRPGRIDGVASQATPDGRLPDASQGADHLRQIFYRMGFNDQEIVALSGAHALGRAHRDRSGYDGPWTFSPTTVTNDFFKLLFDEKWVWKKWEGPKQYEDKKTKSLMMLPTDYVLTQDKSFKKHAKAYAEDQDLWFKDFSKAVSRLFELGVPTSQFVTSEPWIMANVDEQPAPEEKK

SEQ ID NO: 19148 - protein, 453 aa, Staphylococcus epidermidis
MNDTDRTHKENKLEQDITLPYLKKAVIFSITFGFFGVNMAFALQSAMMGRIFQTLGANPNNLGWFFILPPLVGMIVQPLIGYYSDRTWTRFGRRMPYLLIAGPIGAIVLVLLPNAGSFNFGYASLMALSFGAVMTLLMDLTSNACMQPYKMIIGDMVNEKQRDMAWSWQQIFSNLGGIIATVLPFLLTMLGMSNVAPKGEVPMTVKLAYYIAAAVLLIASIWTVISVREYEPKTYNYYHGINEKNRNNKLNLLQLLKKAPKQFWQISVVQFFNWFALMYLWTYSTGAIAKNVWNVTDPSSAGYQAAGNWYGVLYCIQFLSSVIFGFVIARSKPSQRKFWYSFGLLFGGIGLISIFFIHNQWLLIFSFILIGINNLTMNTQPFTLLTEAIDGENSGAYLGLFNTSICLPQIVASIVSFGLYPLLGSSMPAMLLLAGIMMLLGAVSVKFINAKFE

SEQ ID NO: 19149 - protein, 190 aa, Brassica napus
PETVGSTAVVALVCSSHIIVSNCGDSRAVLLRGKEAMPLSVDHKPDREDEYARIERAGGKVIQWQGARVSGVLAMSRSIGDQYLEPYVIPEPEVTFMPRAREDECLILASDGLWDVMSNQDACEFARRRILWWHKRNGALPLAERGVGEDQACQAAADYLSKLALQKGSRDNISVIVVDLKAQRKLKIRS

SEQ ID NO: 19150 - protein, 605 aa, Oryza rufipogon
  misc_feature (3)..(3): Xaa can be any naturally occurring amino acid
  misc_feature (8)..(8): Xaa can be any naturally occurring amino acid
  misc_feature (19)..(20): Xaa can be any naturally occurring amino acid
  misc_feature (22)..(23): Xaa can be any naturally occurring amino acid
  misc_feature (29)..(29): Xaa can be any naturally occurring amino acid
  misc_feature (37)..(39): Xaa can be any naturally occurring amino acid
  misc_feature (41)..(41): Xaa can be any naturally occurring amino acid
  misc_feature (44)..(45): Xaa can be any naturally occurring amino acid
MSXLTTSXLATSATGFGIXXRXXPSSLLXHGFQGLKXXXPXGGXXTSLSVTTSARATPKQQRSVQRGSRRFPSVVVYATGAGMNVVFVGAEMAPWSKTGGLGDVLGGLPPAMAANGHRVMVISPRYDQYKDAWDTSVVAEIKVADRYERVRFFHCYKRGVDRVFIDHPSFLEKVWGKTGEKIYGPDTGVDYKDNQMRFSLLCQAPRILNLNNNPYFKGTSGEDVVFVCNDWHTGPLASYLKNNYQPNGIYRNAKVAFCIHNISYQGRFAFEDYPELNLSERFRSSFDFIDGYDTPVEGRKINWMKAGILEADRVLTVSPYYAEELISGIARGCELDNIMRLTGITGIVNGMDVSEWDPSKDKYITAKYDATTAIEAKALNKEALQAEAGLPVDRKIPLIAFIGRLEEQKGPDVMAAAIPELMQEDVQIVLLGTGKKKFEKLLKSMEEKYPGKVRAVVKFNAPLAHLIMAGADVLAVPSRFEPCGLIQLQGMRYGTPCACASTGGLVDTVIEGKTGFHMGRLSVDCKVVEPSDVKKVAATLKRAIKVVGTPAYEEMVRNCMNQDLSWKGPAKNWENVLLGLGVAGSAPGIEGDEIAPLAKENVAAP

SEQ ID NO: 19151 - protein, 485 aa, Fusobacterium nucleatum
MKKGKAYIIGAGPRDFELLTLKAKRIIENADCIVYDRLISEDILRFAKKDAELIYFGKENTEGGLIQDEINQTLVKKCLEGKNVARVKGGDPFVFGRGGEEIEALFKNKIEFEVIPGITSSISVPAYAGIPITHRGLARSFHIFTGHTMENGKWHNFENIAKLEGTLIFLMGVKNLDLIVNDLIKHGKDSKTPIAIVEKGATKNQRVTVGNLENILELVEKNKITPPAITVIGEVVNLRETFKWFESENLAKKILVTRDKKQAVEMSENISKRGGIPVELPFIEIENLTIDLKDLEKYKAILFNSPNGVKAFFENIKDIRCLANIKIGTVGVKTKEILEKYKIVPDFVPNEYLVDKLAEEVVKYTNENDNILIVTSDISPCDTDKYNSLYKRNYQKVVAYSTKKLKVDREKVLETLKDVDIITFLSSSTVEAFYENLDGNFFILGDKKIASIGPMTSETIRRLGMKVDYEAEKYTADGLLDVIFK

SEQ ID NO: 19152 - protein, 327 aa, Ehrlichia ruminantium
MKISILGAGSFGTAIAIALSAHGISVNLWGRDHRNITHINTYRKNLKYLPTYHLPDNIYATSNIDEVLSDNNTCIILTIPTQQLRTICTQIQHKQHMCKNTPILICSKGIEITSLKFPSEIAEEILQYNPIFILSGPSFAKEIAEHLPCSIVLAGDNKELGESLIETISNDVLKIIYHQDIIGVQIGAALKNIIAIACGIIAGKNLGNNAVATVITKGMNEIKTLYIAKNHSIDLHTLIGPSCLGDLILTCTTEHSRNMAFGLEIGKGRNINTLIDHNLKLVEGTSTVKPLISLAKKLNVELPICISIYNLLHENISLDKAISNILS

SEQ ID NO: 19153 - protein, 488 aa, Lactobacillus acidophilus
MKTLEKVNYKGFIWPLAVGIVLWLITPWRPGGLSVQAWEMFAIFVATIVGCITKPLPIGGTTLLGMVVTVLVGLAPVKDVVNSKGVVIQTGILSSFGNSAAWLIAMAFIMAHGISKTGLGNRVAYVMIEKFGKRSIGIGYAITGLELMMGALIPSNSARTGGVTWPVVESISKSYDSKPNDPSRKKIGAYLDFMAFHANILSTALFITGAAPNLVAQQMAAQKGYQMSWVSWFWAALVPVLVATVIIPLVIYKMYPPEVKETPNAKNWADDKLKEMGPISKPEKIMATVFCLAILLWVLSGFFKIPQLDSAFVAFLAVTLLLITGVLSMEDALHETGAWNILIWLSILIFMAGKLISYGFIAWFAKFIQSEVHGINWGLVLVVLILLMFYTHYFFASGTAHMTALYLPFLTVATAMGAPLGLSAMLLAFTGVINASTTHYANGPASILATTGYVKQSEWWKMNFILGLIYMVIFGIVGTIWMKIIGIW

SEQ ID NO: 19154 - protein, 542 aa, Streptococcus pyogenes
MTIDKKKVVYQIYPKSYKDTTGNGVGDLRGIIDKLPYLQELGIDMIWLNPFYLSPQRDNGYDVSDYTAVNPDFGTMADFENLVKAAKEHQIELMLDMVLNHCSTDHEWFQKALAGDPYYQDFFILRDQPTDWVSKFGGNAWAPFGDTGKYYLHLFDVTQADLNWRNPHVREELAKVVNFWRDKGVKGFRFDVINLIGKDEELADCPVNDGKPAYTDRPITHTYLHDLNQASFGQDDSFMTVGEMSATTIDNCLLYTAPEREELSMAFNFHHLKVDYENGQKWTIMAFDFAALRDLFHAWGEGMSQGNGWNALFYNNHDQPRALNRFVDVTHFRNEGATMLAASIHLSRGTPYIYMGEEIGMLDPDFDSMDDYVDVESLNAYSSLLVSGKSAKEAFAIIKAKSRDNARTPMQWDASEHAGFTTGKPWLEVGKSYRDINVETEKEGRIFPFYQRLIALRKELPIIAEGDYRAAFKDSQAVYAFERHLGDQCLLVLNHFYADEVELELPLRYQHGQVLISNYEKVSICEKVMLKPYQTLAILADN

SEQ ID NO: 19155 - protein, 605 aa, Oryza rufipogon
  misc_feature (436)..(436): Xaa can be any naturally occurring amino acid
  misc_feature (439)..(439): Xaa can be any naturally occurring amino acid
  misc_feature (447)..(448): Xaa can be any naturally occurring amino acid
MSALTTSQLATSATGFGIADRSAPSSLLRHGFQGLKPRSPAGGDATSLSVTTSARATPKQQRSVQRGSRRFPSVVVYATGAGMNVVFVGAEMAPWSKTGGLGDVLGGLPPAMAANGHRVMVISPRYDQYKDAWDTSVVAEIKVADRYERVRFFHCYKRGVDRVFIDHPSFLEKVWGKTGEKIYGPDTGVDYKDNQMRFSLLCQAPRILNLNNNPYFKGTYGEDVVFVCNDWHTGPLASYLKNNYQPNGIYRNAKVAFCIHNISYQGRFAFEDYPELNLSERFRSSFDFIDGYDTPVEGRKINWMKAGILEADRVLTVSPYYAEELISGIARGCELDNIMRLTGITGIVNGMDVSEWDPSKDKYITAKYDATTAIEAKALNKEALQAEAGLPVDRKIPLIAFIGRLEEQKGPDVMAAAIPELMQEDVQIVLLGTGKXKFXKLLKSMEXXYPGKVRAVVKFNAPLAHLIMAGADVLAVPSRFEPCGLIQLQGMRYGTPCACASTGGLVDTVIEGKTGFHMGRLSVDCKVVEPSDVKKVAATLKRAIKVVGTPAYEEMVRNCMNQDLSWKGPAKNWENVLLGLGVAGSAPGIEGDEIAPLAKENVAAP

SEQ ID NO: 19156 - protein, 83 aa, Arabidopsis thaliana
  misc_feature (2)..(2): Xaa can be any naturally occurring amino acid
  misc_feature (21)..(21): Xaa can be any naturally occurring amino acid
  misc_feature (28)..(28): Xaa can be any naturally occurring amino acid
  misc_feature (32)..(32): Xaa can be any naturally occurring amino acid
  misc_feature (55)..(55): Xaa can be any naturally occurring amino acid
  misc_feature (67)..(67): Xaa can be any naturally occurring amino acid
  misc_feature (69)..(69): Xaa can be any naturally occurring amino acid
  misc_feature (76)..(76): Xaa can be any naturally occurring amino acid
MXSSMFSSAVVVTSPVQATMXAPFTGLXSSAXFPVTRKTNKDITSIASNGGRVSXMKVWPPIGKKKXEXSILPPLXLSDVRIG

SEQ ID NO: 19157 - protein, 545 aa, Zea mays
MASSISAPAPPAAPATAPASGRPKKPSQFNPSTGKTRTPVPARPMRAAPTPARHEAAAKWNPLQRLAAAALDALEEGLVAGVLERAHPLPRTADPAVQIAGNYAPVGERPPTGELPVSGRVPAVPRRRSYACRFTETARLRQERALGRAVFPKAIGELHGHSGVARLLLFGARSLCGVLDASQGIGVANAGLVYHNNRLLAMSEDDLPYHVRVTADGDLETAGRYDFGGQLDAAMIAHPKLDPATGELFALSYNVVSRPFLKYFYFTADGRKSPDVEIPVDAPTMMHDFAVTENHAIIPDQQIVFKLQEMVLGGSPVVYDRNKTARFGVLPKRATDASRLRWVDVPDCFCFHLWNAWEDEATGEVVVIGSCMTPADAVFNESAAGEESFRSVLSEIRLDPRTGTSSRRAVLSDADQVNLEAGMVNRQLLGRRTRYAYLAIAEPWPKVSGFAKVDLEAGTVDKFIYGDGRYGGEPCFVPRPDAPAGAAEDDGYVLCYVHDEARGASEMLVVNARDMRAEAAVKLPGRVPYGLHGTFIAGKELQRQA

SEQ ID NO: 19158 - protein, 118 aa, Nostoc punctiforme; identical to SEQ ID NO: 378

SEQ ID NO: 19159 - protein, 605 aa, Oryza barthii
MSALTTSQLATSATGFGIADRSAPSSLLRHGFQGLKPRSPAGGDATSLSVTTSARATPKQQRSVQRGSRRFPSVVVYATGAGMNVVFVGAEMAPWSKTGGLGDVLGGLPPAMAANGHRVMVISPRYDQYKDAWDTSVVAEIKVADRYERVRFFHCYKRGVDRVFIDHPSFLEKVWGKTGEKIYGPDTGVDYKDNQMRFSLLCQAPRILNLNNNPYFKGTYGEDVVFVCNDWHTGPLASYLKNNYQPNGIYRNAKVAFCIHNISYQGRFAFEDYPELNLSERFRSSFDFIDGYDTPVEGRKINWMKAGILEADRVLTVSPYYAEELISGIARGCELDNIMRLTGITGIVNGMDVSEWDPSKDKYITAKYDATTAIEAKALNKEALQAEAGLPVDRKIPLIAFIGRLEEQKGPDVMAAAIPELMQEDVQIVLLGTGKKKFEKLLKSMEEKYPGKVRAVVKFNAPLAHLIMAGADVLAVPSRFEPCGLIQLQGMRYGTPCACASTGGLVDTVIEGKTGFHMGRLSVNCKVVEPSDVKKVAATLKRAIKVVGTPAYEEMVRNCMNQDLSWKGPAKNWENVLLGLGVAGSAPGIEGDEIAPLAKENVAAP

SEQ ID NO: 19160 - protein, 212 aa, Ehrlichia chaffeensis
MSSTRWLHRQLNDPYVSLAKKQGYRSRATFKLIEMDSKFSIFKKGQYVLDLGSSPGGWSQFAAQRVSHNNNNPVFAVDIQNMDAIPNVIFIQCDIINDIELLSDKFHNKKFDVILSDMAPKACGNKQVDHANIINLCEISLDIVVRFTRENGVFITKILQGEYEKEFYQSMKTYFQSVKYFKPKASRKDSSEMYLVGLGFKKDSQDIKTIES

SEQ ID NO: 19161 - protein, 176 aa, Caulobacter crescentus
MNDLPKPEVLISEAEIAERVQKLAEQIAPRIDDDTVVVCLLTGGLWFAADLTRALWKAGRDVRFDALWLASYHDERKSSGRCEVRADLQRPLVGRRALVVDDVFDTGLSLSEAARLVKDAGASEVLTAVFARKPWPKDRGMEPDFVAWEAPARYLVGYGLDDEGKSRGLPYIGAMD

SEQ ID NO: 19162 - protein, 103 aa, Volvox carteri
MSGRGKGGKGLGKGGAKRHRKVLRDNIQGITKPAIRRLARRGGVKRISGLIYEETRTVLKNFLENVIRDSVTYTEHARRKTVTAMDVVYALKRQGRTLYGFGG

SEQ ID NO: 19163 - protein, 552 aa, Escherichia coli
MIMFCVQCEQTIRTPAGNGCSYAQGMCGKTAETSDLQDLLIAALQGLSAWAVKAREYGIINHDVDSFAPRAFFSTLTNVNFDSPRIVGYAREAIALREALKAQCLAVDANARVDNPMADLQLVSDDLGELQRQAAEFTPNKDKAAIGENILGLRLLCLYGLKGAAAYMEHAHVLGQYDNDIYAQYHKIMAWLGTWPADMNALLECSMEIGQMNFKVMSILDAGETGKYGHPTPTQVNVKATAGKCILISGHDLKDLYNLLEQTEGTGVNVYTHGEMLPAHGYPELRKFKHLVGNYGSGWQNQQVEFARFPGPIVMTSNCIIDPTVGAYDDRIWTRSIVGWPGVRHLDGEDFSAVIAQAQQMAGFPYSEIPHLITVGFGRQTLLGAADTLIDLVSREKLRHIFLLGGCDGARGERHYFTDFATSVPDDCLILTLACGKYRFNKLEFGDIEGLPRLVDAGQCNDAYSAIILAVTLAEKLGCGVNDLPLSLVLSWFEQKAIVILLTLLSLGVKNIVTGPTAPGFLTPDLLAVLNEKFGLRSITTVEEDMKQLLSA

SEQ ID NO: 19164 - protein, 284 aa, Unknown
  marine gamma proteobacterium HTCC2207
MTNIVNLFASPESPKQESPKAHSIGEVFLVGAGPGDPELITVKAMRLLQEADAIVYDRLANPLLLDYARKHCDLIYVGKKKDQHSLPQDQICALLAALAGCGKKVVRLKGGDPFIFGRGGEEVDHLAEQGIACTIVPGITAAIGCAATTRIPLTHRDHAHAVTFITGHRQHGKMYINWDLALQKDSTVVFYMGLSNLKEITSELIARGCPEDKPFAVVAQGTAETQQVLVGTVSDIAEKLAAHPLPSPALLMMGDVINANGYAQHLADLTSAAQPFSEERLEVI

SEQ ID NO: 19165 - protein, 93 aa, Zea mays
MSSRRSSSSSSHGNISEDEMNELVSKLQALLPSSRRRRGSGQASTAKLLKETCSYIKSLQREVDDLSDRLSDLLSTMDHNSPAAEIIRSILRS

SEQ ID NO: 19166 - protein, 897 aa, Unknown
  marine gamma proteobacterium HTCC2207
MSHATETRDSCTVKTTCPYCGVGCGVSAEIKNDQLIAVSGDTEHPANLGKLCVKGAALDQTMGNHGRLLQPSIEGHPVSWDRAIEEVACRLNQVREKYGPEAIAFYLSGQLLTEDYYVANKLAKGFIGTGHVDTNSRLCMSSAVAGYKRAFGADAVPCNYEDLEHCELLVLTGSNAAWTHPVLYRRIAAAKQKNPAMRVVVIDPRRTASCDLADLHLAVAPGADAFIFNGLLAFLDRADQLDRHYIEQHTEGFAAALETASAISQAELEQQTGISREELATFYQWFVETEKSITFYSMGINQSATGTDKCNAIINCHLATGRIGKLGAGPFSITGQPNAMGGREVGGLANMLAAHMDYTTENVATVSAFWNSDKVSKKAGLKAVDLFDAVADGSIKAIWIMGTNPVVSMPNADRVKAALEHCETVIVSDCIAETDTTATANILLPAAGWGEKSGTVTNSERRISRQRALVSAAGEARADWWILAQVAKAMGFSDGFNYQSPRDVFVEHAQLSDYQNQGQRLFNIGALSQLSETHYDSLQPIQWPVTTNRPQGTTRLFEDGQFVTPSGRARFIAITPRLPAKRKSQRRYPLALNSGRIRDQWHTMTRTGRAASLLDHTDQPFVAMHPDTAAAADLQNGDLAEVSTPQGVIQVISLIDLGVKPEQLFVPIHWSNQNAHSARVATLFEAIIDPVSGQPESKFSRAALKKIESPCWATLVSRTALDCSEFINWTSAALPRQLGFIYQVAVSAEFNWQHYASKVTGATAYAQFSDAANFDQRLIGYSDQQMEIALFSHRQKPSLPNKAWMQDLLNNRAPENYWRLLSGPDLSLADSGGKLICSCFKVSEEHIISAIETGADSTEQLGKQLQCGTNCGSCIPELSSLIKQVQTSSQFLAKQIG

SEQ ID NO: 19167 - protein, 114 aa, Vibrio parahaemolyticus
MNMKKIEAIIKPFKLDDVREALAEVGITGMTVSEVKGFGRQKGHTELYRGAEYMVDFLPKVKLEIVVTEDVADKCVETIIETAQTGKIGDGKIFVTDVERVVRIRTGEEDEDAI

SEQ ID NO: 19168 - protein, 167 aa, Arabidopsis thaliana; identical to SEQ ID NO: 494

SEQ ID NO: 19169 - protein, 175 aa, Rubrobacter xylanophilus
MMPEIGPVLVPAGEIQRKVRELGERITRDYAGQNLLLVGILRGAFVVLSDLIRQIEIPCEVDFMEVSSYGAGTTSSGVVRILKDLEEDISGRHVLIVEDIIDTGLTLSYLRRSLLARKPASLEICALLSKPARRQVDIQVRYQGFEVPDVFVVGYGIDYAGFYRNLRDIYALKQP

SEQ ID NO: 19170 - protein, 527 aa, Clarkia delicata
VEFDNIFLDYSRQQASPDTINKLYKLADEAHLKQKIDRMYNGDHINITENRSVLHVALRAPRNSAICSDGKNVVPDVWNVLDKIKDFSERVRNGSWVGATGKELKDVIAVGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRNSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLRKENVSEHLIPHKTFTGNRPSLSILLPTLDAYRIGQLLAIYEHRVAVQGFVWGINSFDQWGVELGKSLATQVRKQLHASRVNGEPVEEGFNFSTKTLLTRYLKATSDVPADPSTLLPKI

SEQ ID NO: 19171 - protein, 386 aa, Citrus sinensis
WIPRAAGIRLRVPLLHLSNFQINDWPELSTKRYALMVLMLPSDSARQWHVHELELVEVVADQVAVALSHAAILEESMRARDLLMQQNIALDSARREAETAIRARNDFLAVMNHEMRTPMHAIIALSSLLQETELTPEQRLMVETILKSSNLLATLINDVLDLSRLEDGSLQLQIGTFNLHAVFREVLNLIKPIASVKKLLVALNLAPDLPEYAVGDEKRLMQTLLNVVGNAVKFTKEGNISITGFVAKSESLRDSRAPEFFPVPIENHFYLRVQVRDSGSGISPQDIPNLFTKFAQNQAIALRNSSGSGLGLAICKRFVNLMEGHIWIESEGLGKGCTAIFIVKLGIPEHSNDSNLSFIPKMPVHGQTNFPGLKVLVMDENGVSRQ

SEQ ID NO: 19172 - protein, 247 aa, Pseudomonas putida
MADLTSGHRGAPKGGQKNRARLIYSACAVVWSFWTLVHKCLICDERMRTFARFSKMHPPESAMSADLEHIRQVMREADCLYTEAEVEAAIANVGEQICKDLHDKNPVVFCVMNGGLIFSGKLLTHLQFPLEASYLHATRYRNQTSGGELFWKAKPEVSFIDRDVLIVDDILDEGHTLSAIIEFCKHAGARSVYTAVLIDKDHDRKASPDLKANYVGLPCVDRYIFGYGMDYKGYWRNANGIFAVKGL

SEQ ID NO: 19173 - protein, 307 aa, Clarkia epilobioides
  misc_feature (77)..(87): Xaa can be any naturally occurring amino acid
AAHLKQKIDRMNNGDHINSTENRSVLHVALRAPRNSVICSDGKNVVPDVWNVLDKIKDFSERVRNGSWVGATGKELXXXXXXXXXXXFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYSFAVVEKFLQGAHSIDQHFSSAPFEKNIPVLLGLLSVWNVSFLGYPARAILPYSQALEKLAPHIQQVSMESNGKGVSIDGLPLPFES

SEQ ID NO: 19174 - protein, 559 aa, Unknown
  Oceanospirillum sp. MED92
MSESFADLFEESLQSLDMTPGKLVIGEVVDIDSDWVTVHAGLKSEAIIPRSQFLNDANELEIQIGDEVKVALEAVEDGFGETRLSREKAKRAEAWEVLQTKFEAEETVKGCISGKVKGGFTVSINNIQGFLPGSLVDVRPVRDVDHLEGKELEFKLIKLDPKRNNIVVSRRAVLQEANSAQRDELLATLDEGQEVKGFVKNLTNYGAFIDLGGVDGLLHITDMAWKRISHPSEMLNPGDEITVKIIKFDKESGRISLGLKQLSSDPWSLIKERYPAGAKCQARITNLTDYGCFASIEDGVEGLVHVSEMSWTNKNIHPSKVVQIGDEVEVMILDVDEERRRISLGIKQCTANPWVTFAEQFAAGDKVTGTIKTITDFGIFVGLQEELDGLVHMSDITWEADAEAALRQFKKGEEVEAVILSIDAEKERISLGIKQLESDPFAEFASANDKGAIVTGKVTSVDAKGAVVELAEGIEGTLKVSEISVDRVEDASSVLNVGDEVEAKIVTLDRRNRVINLSIKAKEQAEEKAAISAVRNAEVEVSGPTTIGDLIKAQLDNQK

SEQ ID NO: 19175 - protein, 749 aa, Glycine max
MENTDPCRHFLKDVKRIIIKVGTAVVTRQDGRLAVGKLGALCEQIKELNSLGYEIILVSSGAVGLGRQRLRYRKLINSSFADLQKPQVELDGKACAAVGQNSLMALYDVLFSQLDVTSAQLLVTDNDFRDKDFRMQLSETMKSLLALKVIPIFNENDAVSTRKAPYEDSSGIFWDNDSLSALLALELKADLLILLSDVEGLYSGPPSDPRSKLIHTYIKEKHQSEITFGDKSRVGRGGMTAKVKASIHAAEAGIPVIITSGYAAENIIKVLQGQRIGTLFHKDAHKWAPVKEVDAREMAVAARDCSRRLQALSSEERKQILLKIADALEAHQNEIRIENEADVADAKEAGYEKSLVARLLASLANNIRIIANMEDPIGRVLKRTEGLILEKTSSSLGVLLIVFESRPDALVQIASLAIRSGNGLLLKGGKEAKRSNAILHKVITEAIPDIVGSKLIGLVTSRAEIPELLKLDDVIDLVIPRGSNKLVTQIKSSTKIPVLGHADGICHVYVDKSADLEMARRIVLDAKIDYPAGCNAMETLLVHKDLVEKGWLNSIIIDLRTEGVTLYGGPKASPLLNIPMARMLHHEYNSLACTVEIVDDVYAAIDHINLYGRHATLYFLIIAHTDSVVAEDHEVANVFLRQVDSAAVFHNASTRFSDGARFGLGAEVGISTSRIHARGPVGVDGLLTTRWILKGSGQIVDGDKASGAKVVQFSGGGIFMLSGAAAFTFKMLYKGIAILPNVRKLMFIV

SEQ ID NO: 19176 - protein, 620 aa, Glycine max
  misc_feature (279)..(279): Xaa can be any naturally occurring amino acid
  misc_feature (534)..(534): Xaa can be any naturally occurring amino acid
MASLSGICSSSPTLKKFPNQSPSLTDPLRKDHVSFPARLADRTLSLAPLRAVAREVSDGALAAAVKKGLEKDPRALWRRYVGWLYQHKELGIYLDVSRVGFSDEFVKEMEPRFQAAFRAMEELEKGAIANPDESRMVGHYWLRDPKRAPNSFLKTQIENTLDAVCKFANDVVSGKIKPPSSPEGRFTQILSVGIGGSALGPQFVAEALAPDNPPLKIRFVDNTDPAGIDHQIAQLGPELASTLVIVISKSGGTPETRNGLLEVQKAFREAGLDFPKQVXSQGVAITQENSLLDNTARIEGWLARFPMFDWVGGRTSEMSAVGLLPAALQGIDIREMLAGASLMDEANRSTVLRNNPAALLALCWYWATDGVGSKDMVILPYKDSLLLFSRYLQQLVMESLGKEFDLDGNRVNQGISVYGNKGSTDQHAYIQQLREGVHNFFVTFIEVLRDRPPGHDWELEPGVTCGDYLFGMLQGTRSALYANNRESITVTVQEVTPRTVGALIALYERAVGIYASLVNINAYHQPGVEAGKKXAAGEVLALQKRVLAVLNEASCKEPVEPLTLEEVADRCHAPEDIEMIYKIIAHMAANDRALIVEGSCGSPRSIKVFLGECNIDGLYA

SEQ ID NO: 19177 - protein, 166 aa, Oryza sativa
MALVEDNNAVAVSFSEEQEALVLKSWAILKKDSANIALRFFLKIFEVAPSASQMFSFLRNSDVPLEKNPKLKTHAMSVFVMTCEAAAQLRKAGKVTVRDTTLKRLGATHLKYGVGDAHFEVVKFALLDTIKEEVPADMWSPAMKSAWSEAYDHLVAAIKQEMKPAE

SEQ ID NO: 19178 - protein, 482 aa, Pseudomonas syringae
MQLIWLRSDLRVHDNTALTAAMQRGPTLAVYLLSPTQWRNHDDADCKVDFWLRNLVELEKALGKLNVPLLIREADTWDQAPEVLATLCKQFKVEGLHLNEEYGINETRRDQAVQQSMQADGVHFTSHLDQLLFKPGSILTKTGNYFQVFTQFKKVCYTRLHQAMPRTVHTPEAQQPLSIKSDAIPDQVKGFSTPSKTLRDLWPAGEVEASRRIEAFAGEQISYYKDERDFPARPGTSQLSAYLAAGVISPRQCLHAALASNQGEFETGDVGTVTWINELLWREFYKHTLVGYPRVSRHRAFRPETEALKWRDAPEELLAWQEARTGLPIIDAAMRQLLETGWMHNRLRMVVAMFLTKNLLIDWREGERFFMRHLIDGDLAANNGGWQWSSSTGTDSAPYFRIFNPLSQSERFDPEGVFIKRWLPELADLNKKQIHDPASVGGLFGVADYPKPIVDLSKSRARALAAFKALPTRQPAAGADNG

SEQ ID NO: 19179 - protein, 630 aa, Ipomoea purpurea
MARGEGFAENLREKLALAIRSIEWSYAIFWTISSAQPGVLEWGDGYYNGDIKTRKTVQAAETSTDQLGLQRTEHLRELYGSLLAGETNLHAKIPSAALSPEDLTDTEWYFLVCMSFVFNIGQGLPGKALAKNQTVWLCNAPQADGRVFTRTLLAKSACIQTVVCFPHLGGVIELGVTELVKEDRGLVQHLKTSYLDIPCPIVPGVPNYISTDDGNDRDIVNSKPNQDTLEASPKEENIDSPDNSSNGLEADEQAGDEFKVKGATAEASQPPNYQIVEDDISNCIHNSTNSSDCISQNYENPEEKVSDFLNDEEMVEHSPPENQECNQESLVPLDNRGQGHDVHYQTILSSVLKSSHQFILGPYFRNGNRESSFVGWKKEISSNIQMLRVETSQRLLKKVLSGVERMVCIPDTRKEGDGKNDPRRLETDESDRSRVVSERRRREKINERFMILSSLVPSSGKADKVSILDETIEYLKDLKTRVWEAESEKEGFELNARMGRNCKDCDDAERTSDNCGTNRINNNKKPSSKKRKASETEGASKSIAKNGSARDVAVSVTDEDVTIEIGCQWSEGVLIKIIQALNNLHLDCETIQSSNGDDGTLSVSVKCKMKASKLTSPSAALIRQALKRVI

SEQ ID NO: 19180 - protein, 841 aa, Unknown
  marine gamma proteobacterium HTCC2207
MLKVVVVGNGMVGHHYVEQLVASDVEAQITVIGGETRPAYDRVHLSEFFAGRSPEDLALTTRDHYRELGVEAHFGDMVASIDRDTKTLTTESGKQFAYDKLVLATGSYPFVPPVKGNDLEPCTVYRTIDDLGTIQAQATGGKIGVVVGGGLLGLECANAVKNLGLETHVVEFAPGLMGVQLDGGGSAMLRRKIEALGVTVHTSKATKVIEPDAEGEARLRMQFADGSSLATDMIVFSAGIRPYDQLAKDCGLTVGERGGIEIDYHCKTSDSDIFAIGECALFGGRIYGLVAPGYRMAEAAVSQLTNEVVPFQGADMSTKLKLLGVDVGSIGDAHGKEAGSVAYTFSDERIDVYKRLIVSADGKKLLGAVLVGDCSDYDTLLQYFLNGIALPADPQTLILPYNAGAAPALGAAALPATATICSCHNVSKGDIVNAMDAGFCSLAEVKSETAASSGCGGCAALLKSVVDDELASRGLEVNKAMCEHFNLTRQEMFHIVKVESIKSFEELISKHGSGRGCDICKPTAGSILASLWNDYVLEEKHVGLQDTNDTFLANMQKNGTYSVVPRIAGGEITPDKLITIGQVAKKYNLYTKITGGQRIDLFGARVQHLPGIWEELIAAGFETGHAYGKALRTVKSCVGSTWCRYGVQDSVAMALYIENRYKGLRSPHKLKSAVSGCTRECAEAQSKDFGVIATENGWNLFVGGNGGMKPRHADLFATDLDDETLIKYIDRFLMFYVRTADRLQRTSVWMGTLEGGLDYLKQVVIEDSLGIAGELEEQMESIVGSYQCEWKTTVEDPEKLKRFRQFVNSKAEDREIIFVEERGQPRPATDAERKQLLAESA

SEQ ID NO: 19181 - protein, 1352 aa, Streptomyces avermitilis
MTTTPEAERTRTAEQVRTVCSYCGVGCGIVLDVGTGPDGRRTVLKASGDKEHPANRGRLCTKGATTADMLAAPGRLTSALVRDDRGAEPVPAPVDEAVRETARRLRAIVDEHGPDAVAFYVSGQMSLEAQYLANKLAKGFVRTNQIESNSRLCMASAGTGYKLSLGADGPPGSYDDLDKADVFLVIGSNMADCHPILFLRLLERVKAGAKLIVVDPRRTATAAKADLFLQVRPGTDLALLNGLLHLLYENGHTDAEFIARHTEGWEAMPDFLADYPPATVSEITGIPEDDIRAAARLIGEAGEWTSCWTMGLNQSTHGTWNTNALVNLHLATGAICRPGSGPLSLTGQPNAMGGREMGYMGPGLPGQRSVLVDEERAFVEELWELAPGTIRADGVGRGTVEMFRKMADGDIKACWIICTNPVASVANRKTVIEGLEAAEFVVTQDVFADTETNAYADVVLPGALWTESPGVLVNSERVLTLARPVVEPPGEATADWRLIAAVAREMGYTEGFAYESAEQVFEEIKRAWNPKTGWDLRGVTYERLRSTPVQWPAARADGPARNPVRYVADGLVFPTASGRAVFHARPHLPAAELPDDDFPFVLNTGRVQHQWHTLTKTGKVAKLNKLNPGPFVEVHPRDAAALGVVDGDSVEVASRRGRAVLPAVVTDRVQPGCCFAPFHWNDLFGEYLSINAVTSDAVDPLSFQPEFKVCAVALARVASPPSALPVRSLDAAPPAPDGGLTASSAPAGQAEIFGLTPGPPPVLTARERQYLTGFLAGLGSGAPGVPVLPAEAPFSAEHALWVNGVLAGMYSRAATAEAPAKPPGREVVVLWASQTGNAEEFAAATAERLTATGHRATLVGMDDTDVAQLPRTADLLLITSTFGDGDAPDNGSGFWDALSAEAAPRLDGVRYAVLAFGDSSYDDFCGHGRRLDTRLDELGAVRLAPRTDCEPDYEPYAGAWLDQVLGALGTKTDAPKPARPRKPEPAIARLTGNRLLSLPGAGKEVRRFTFDTSGTGLTYEAGDALGVRPVNSPDLVDEWLSVTGLDHSTPVAVEGVGEVPFAQALHRHLDITHITPDLLRFVSEHAHDNRELKKLLRPDNKDGLAQWSWGRQAVDVVAEHPVRATAEEWAEVFKRLQPRLYSISSSPLVDPHLVSLTVSVVRYEDRLGRPRGGVCSPFLADAEHHTPVPVFVQRSPHFRPPADSSTPMVMVGPGTGVAPFMGFLQERRALGHRAPNWLFFGEQHRATDFYYEEELTALLADGTLTRLDTAFSRDQRAKVYVQDRIREHGPELWHWLQNGARFYVCGDASRMAKDVDRALRDIAVTHGGLTEAEATAYVKQLAAEKRYVRDVY

SEQ ID NO: 19182 - protein, 755 aa, Oryza sativa
MASVDPSRSFVRDVKRVIIKIIRSGALLGLFCGLLDVTAYVEVANLSTLVGTAVVSRQDGRLALGRVGALCEQVPNQRKVAMQVKELNSLGYEVILVTSGAVGVGRQRLRYRKLVNSSFADLQKPQMELDGKACAAVGQSGLMALYDMLFNQLDVSSSQLLVTDSDFENPKFREQLTETVESLLDLKVIPIFNENDAISTRKAPYEDSSGIFWDNDSLAGLLALELKADLLILLSDVDGLYSGPPSEPSSKIIHTYIKEKHQQEITFGDKSRVGRGGMTAKVKAAVLASNSGTPVVITSGFENRSILKVLHGEKIGTLFHKNANLWESSKDVSTREMAVAARDCSRHLQNLSSEERKKILLDVADALEANEDLIRSENEADVAAAQVAGYEKPLVARLTIKPGKIASLAKSIRTLANMEDPINQILKKTEVADDLVLEKTSCPLGVLLIVFESRPDALVQIASLAIRSGNGLLLKGGKEAIRSNTILHKVITDAIPRNVGEKLIGLVTTRDEIADLLKLDDVIDLVIPRGSNKLVSQIKASTKIPVLGHADGICHVYIDKSADMDMAKHIVMDAKIDYPAACNAMETLLVHKDLMKSPGLDDILVALKTEGVNIYGGPIAHKALGFPKAVSFHHEYSSMACTVEFVDDVQSAIDHIHRYGSAHTDCIVTTDDKVAETFLRRVDSAAVFHNASTRFSDGARFGLGAEVGISTGRIHARGPVGVEGLLTTRWILRGRGQVVNGDKDVVYTHKSLPLQ

SEQ ID NO: 19183 - protein, 280 aa, Hyphomonas neptunium
MTRTITLAAIQFTPTDDVQENIDRVAGFVREAAAKGADVILPPELFCGYYFCKTQEEEHFARAFEWQDHPAVHQLSDLAAELGVVIPVSIYEKEGPHYFNSIVVIDADGAPLGVYRKSHIPDGPGYQEKYYFRPGDTGFRVWNTMKGRIGVGICWDQWFPEAARSMALMGADVLLYPTAIGAEPQDASLDTAARWRRGMQGHAVANVIPVVAANRVGDEQGQVFYGTSFITDETGEIAADLDRKEEGVIVATFDLEHIDRARAAWGFFRDRRTDLYEILV

SEQ ID NO: 19184 - protein, 127 aa, Brassica oleracea
MNLEEKPTMASRALPQAENLYYVRCSICNTILAVGIPMKRMLDTVTVKCGHCGNLSFLTTTPPLQGHVSLTLQMQSFDGSEYKKGSSSSSSSSTSSDQPPSPRPPFVVKPPEKKQRLPSAYNRFMRD

SEQ ID NO: 19185 - protein, 181 aa, Mangifera indica
MAVSSYSASEKLSRAAMLLLFGLLMSHIQTSGAIGVCYGRNGNNLPPQAEVVTLYKDNNIGQMRIYDPDQATLQALRGSNIELILDVPKDKLQDLTDSAKAGDWVQTNVLAYSADVKFRYIAVGNEIRPGDAEAQYVLPAMRNVYNAIAAANLQGQIKVSTAIDTTLLGSSPPPVRGGFQF

SEQ ID NO: 19186 - protein, 333 aa, Oryza sativa
MESKSAYGGAIGVWTPMRESWGSASAVTSARPFVTNNVIPAIWSRIAPSLPPSPLPRRPRSALAHCRASPASILQQLHRSTSLEMDPHSHKKAHEGLIGDNPDAYAVTTYQPVLMVEPSAAAAFPPAPQVAPAYPVNPMQLPEHQQHAIQQVQQLQQQQKEQLQAFWADQMAEVEQMTEFKLPNLPLARIKKIMKADEDVKMIAGEAPALFAKACEMFILDMTLRSWQHTEEGRRRTLQRSDVEAVIKKTDIFDFLVDIITDDKMKDDGMGSQAASMVSPYTSGGMGFSFDLYPNQHHLAYMWPPQEQQEQWPPQEQQEQKQKQDSDGGGQDE

SEQ ID NO: 19187 - protein, 475 aa, Pseudomonas putida
MHLTWLRSDLRIDDNTALSAATERGPTIALWLVSPGQWQAHDDAACKVDFWLRNLRALRQSLEGLNIPLLIRKIDTWDQAPQAVLDVCRQHQVQSVHWNEEYGINEQQRDDATRALLEKSSIQACSHLDQLLFRPGTILTRSGDYFQVFSQFKKTCLEHLHRSLPALARRVERQAPLQIQSDPIPQHVDGFETPTRALREHWPAGEAEAQARLSRFLDETIDEYQQLRDLPAKHGTSQLSTYLAAGVISPRQCLHGALASNRGEFDSGSTGVQTWINELLWREFYKHILNGYPQVSRHRAFRAHTEALPWRDAPADLEAWKQGRTGFPIIDAAMRQLLHTGWMHNRLRMVVAMFLSKNLLIDWRKGERHFMRHLIDGDLAANNGGWQWSASTGTDAVPYFRIFNPVSQSQRFDPQGRFIRHWLPELRDMDEKTIHEPMKSDDLFANNSYHRPMVILGSSRQRALEAFKGLPRRQD

SEQ ID NO: 19188 - protein, 419 aa, Unknown
  Bradyrhizobium sp. BTAi1
MTVYAGPVFEMAANQFNVIADHLGIPADERDRLLLPKRAITVSCPIHKDDGTIAVYEGYRVQHLLTMGPTKGGTRFAPTVDIGEVAALAIWMSWKCALVGLPYGGAKGGVTVDLSKLSRRELESLSRRYMQEMIPFVGPHTDVMAPDMGTNEQVMAWFMDTYSMYQGQTVTEIVTGKPVFSGGTLGRREATGRGVAHVSRRVMDVLGIDPAKSTVVVQGFGNVGSYAALGFHQMGMKVIAVSDHTGALHDARGLDIPALMAHASKHGSIAGFSTELAFDPKEILTLACDILVPAAVERVIDAKVAANLKCRVIAEAANGPTTPDADLVLDQRRKEIFLIPDILCNSGGVIVSYFEWVQDLQQLFWEEEEVMRREYQILDRAFERMVTRAKADDISHRTAAMAIGVEKVRNAKNTRGLFP

SEQ ID NO: 19189 - protein, 367 aa, Shigella flexneri
MSDSQTLVVKLGTSVLTGGSRRLNRAHIVELVRQCAQLHAAGHRIVIVTSGAIAAGREHLGYPELPATIASKQLLAAVGQSRLIQLWEQLFSIYGIHVGQMLLTRADMEDRERFLNARDTLRALLDNNIVPVINENDAVATAEIKVGDNDNLSALAAILAGADKLLLLTDQKGLYTADPRRNPQAELIKDVYGIDDALRAIAGDSVSGLGTGGMSTKLQAADVACRAGIDTIIAAGSKPGVIGDVMEGISVGTLFHAQATPLENRKRWIFGAPPAGEITVDEGATAAILERGSSLLPKGIKSVTGNFSRGEVIRICNLEGRDIAHGVSRYNSDALRRIAGHHSQEIDAILGYEYGPVAVHRDDMITR

SEQ ID NO: 19190 - protein, 367 aa, Unknown
  uncultured bacterium 583
MAQRDYYEVLGVKKGANEAEIKKAYKRLAMKYHPDRNAGDKASAEKKFKEVRKAYDVISDPQKRSAYDQFGHAGVEQQGAGGFGGGNPFGAGGFGDIFGDIFGGGNTKPDNRGPDLRYDLEIDLRQAAEGDTVKIRVPKNDTCDTCSGTGAKPGTSVKTCGNCHGSGQVQMQQGFFAIQRPCNQCHGTGEKIDSPCRTCSGQGIVRKQKTLSVKIPAGVDTGNRIRLSNEGEAGLRSGPSGDLYVQIHVKDHQIFQREGNDLYCEVPIDFATATLGGSIEVPTLDGKLKINIPSGTQTSKLFRLRGKGMPAMRYNGSGDLLCQVKLETPVNLNSKQKQLLKDFSSSCNAKQYPESNSFFGKMKSFFE

SEQ ID NO: 19191 - protein, 165 aa, Alteromonadales bacterium
MQKFHQLSATSLQGQPISFDDFEGKVVLIVNTASKCGFTYQYASLQALHEKYASQGLVIIGFPCNQFGQQEPGDASQIEQGCLINYGVSFLITDKVDVNGKNAHPVFRFLKSALPGFLTRKIKWNFTKFLIAADGIPIKRYAPFTKPEKIELTIQKALSKAKSTQ

SEQ ID NO: 19192 - protein, 415 aa, Unknown
  Dehalococcoides sp. CBDB1
MSFLKTSDPAVYNAIMQETTRLKETIDLIASENYTSKAVLEAQGSVFTNKYAEGYPGKRYYAGCEYADAVEELAIDRAKTLFHAEHANVQPHSGAQANMAAYFAMVKPGDTIMGLTLSHGGHLTHGSKVNFTGKLYHVIEYGLNAETERIDYDNLEKLAMEHRPRMIVTGASAYPRILDFERFRAICDKVDAKLMVDIAHIAGLVAAGLHPSPVPYADVVTSTSHKTLRGPRGGFILCKEQYAKAIDQAVFPVMQGGPLMQVVAAKAVAFQEAMQPGFVTYQKKTLENTQVMAEELRKLGLRLVSGGTDNHLVLVDLSPIGVNGYDAQLALRRAGIVINRNTVPFAENQTANVPAGIRLGCPAATSRGFGPAEIRQTVGWIGKVLKNIGNEDVEKQVLAEVIHLCRKFPVPGIDI

SEQ ID NO: 19193 - protein, 688 aa, Methylobacillus flagellatus
MSTLKEGRPYPRGAHFDGKGTNFALFSDHASSVTLCLFDAQGESETERVTLKECTNGVWHGYLEGIKPGQLYGYRVDGVWAPAEGLRFNHNKLLLDPYARKLSGQIKWDNALFGYTISDDPDADLHMDERDSAKFMPKAIVVKPDVLTKSPKPDIRWPKTIIYEAHVRGLTMQHPLIPNDIRGTFAALSDSAIISHLQRIGVTAIELMPIHAFAQDRHLLDRNLSNYWGYNTLAYFAPEPSYLGSGALEEIAKTVDALHDAGIEVILDVVYNHTCEGNHLGPTLCWKGIDNLSYYKELPGNPRYYDNLTGCGNALNTSHPKVMQMIMDSLRLWASVYGVDGFRFDLALTLGRNENGFNRDHALFHAMLQDPILTRCKLIAEPWDVGPGGFQLGSFPPGFSEWNGDYRDVTRQFWAGKEGMLSRFASRFAASSDLFNDQHRRPWSSVNFITAHDGFTLHDLVSYNEKHNEANGENNQDGANDNHSWNCGHEGETDQEDILALRAQQKRNFLTTLFLSQGIPMLLAGDELNNSQQGNNNAYCQDNEIGWVNWENADDALIDFVGELARLRKEHNAISRAEFVTGKLNEHGNSDVAWFNVNGEPMSNEDWNDPCNKAMAVKFVPPDKTGHAILVMLNASHVTVPARIPYCDSYDWKLLLDTPLKPIPNQQGEELVLEPRSIYVYEGRLISR

SEQ ID NO: 19194 - protein, 163 aa, Thermobifida fusca
MPTPPFVLRLREQVGHALLPLVGVTAVVIDPAGRILLHRRADDGRWCTPGGLVEPGEQPAATLVRELEEETGLRVHPETLVSAVMEAPYTYPNGDQVQILDLTFRCRPLSGEARVNDDESLDVRWFDYAALPPMPGRIMRRINHALEGRVGWFDRRNGPWSET

SEQ ID NO: 19195 - protein, 381 aa, Streptococcus mutans
MHMKNEMLALILAGGQGTRLGKLTQSIAKPAVQFGGRYRIIDFALSNCANSGINNVGIITQYQPLALNSHIGNGSSWGLDGINSGATILQPYSATEGNRWFQGTSHAIYQNIDYIDSINPEYVLILSGDHIYKMDYDDMLQTHKDNMASLTVAVIDVPLKEASRFGIMNTDSNDRIVEFEEKPEQPKSTKASMGIYIFNWDRLRTMLVDAEKNNIDMSDFGKNVIPAYLESGERVYTYNFNGYWKDVGTIESLWEANMEYIGEDNDLHSRDRSWKIYSKNLIAPPNFITEEAHVKDSLVVDGCFVSGKVEHSILSTNVQVKEGAQIKDSFIMSGAVIGEGAKITRAIVGEGAKIGEDVEIDGTEEVQVIGYNEVVGVPNED

SEQ ID NO: 19196 - protein, 210 aa, Thermobifida fusca
MTLPNSLCRIACATILGPRGSEHGTVRHAARQDSPVGSSDGQGAEARLRDMKIYQSELRTLEGEPFRLPQTQLLLIVNVASKCGLTPQYSGLERLQEAYAYRGFSVIGVPCNQFGGQEPGDAQEIRLFCATTYGISFPILEKMEVNGPNRHPLYVELTKARDSQGLAGDVQWNFEKFLVAPGGRVLYRFRPQVEPEDPEIIRAIEENLPN

SEQ ID NO: 19197 - protein, 99 aa, Prochlorococcus marinus
MTSFQITFINELSGLKEIIDIPDDKYILDAACEQNIELPASCREGTCSTCVAKLEKGNVDQQDQSFLDDDQIEKGYILICKAYPLSDCIIRTHAEDQLY

SEQ ID NO: 19198 - protein, 467 aa, Haemophilus somnus
MTKIASVANILKGKITVGETVTVRGWIRTRRDSKAGLSFLAIYDGSCFDPIQAIVNNDIENYETEILRLTTGCSVVVTGKIAESPAEGQAVELQANKIEVSGWVDDPETYPMSAKRHSIEYLREVAHLRPRTNIIGAVARVRHCLAQAIHRFFHEQGFYWVATPLITASDTEGAGEMFRVSTLDLENLPRTDKGAVDFSQDFFGKESFLTVSGQLNGESYACALSKIYTFGPTFRAENSNTTRHLAEFWMVEPEIAFATLADNAKLAEDMLKYVFRAVLNEREDDLKFFEKHVDKNVITRLKDFINSDFAQIDYTDAIDILLKSGKAFEFPVSWGIDLSSEHERYLAEEYFKSPVVVKNYPKDIKAFYMRLNDDGKTVAAMDVLAPGIGEIIGGSQREERLEVLDKRIAEMGLKAEDYWWYRDLRRYGTVPHAGFGLGFERLIVYVTGVQNIRDVIPFPRTPRNANF

SEQ ID NO: 19199 - protein, 743 aa, Streptococcus mutans
MGRDASFSRFDNFGIVGNLVYESDTFQSQVYLIVKNADWSVRTPDFSINCNPGLSKSEVWIVQGDDTLYYSWQAAVASHAYNQRQPHAFDMAVNSKRFDYEWGFQGWLGFSYQEDKTEFRLWAPTARRVELIIYSSTGEKSSVLKVLKMKRGENRTPDDHTKNTHGVWKRTVEGDLNYHAYRYRVYYRRRIFRDTRDPYSIAVTADGKRSVVIADTDLIPEGFKVKHRQEASWRLSNPNQAVIAEMHIRDFSKSETSGVRHENRGKFLGAFETGTKNLYGDQTSFDYLKSLGINYVQLQPVFDHHQTFNEDGSYAYNWGYDPENYNVPEASFASNPHAPTARILELKQLVQAYHDAGIGVIMDVVYNHTYSSTDSAFQLAVPDYYYRMNHDGSLQNGSGCGNETASEKEMFRKYMIDSILYWIQAYNIDGFRFDLMGLHDVETMNAIRQAVDAIDPNILLYGEGWDMGIGLMPEDKAKKDNAYQMPRIGFFNDDVRNAIKGAEVYGDFKRGFVSGEPTENKIAKGMLGSDELSSYLVPNQVLNYVEAHDNYNLNDLLMELHPEDDKTTHIKRVELANSLGILMQGMAFIELGQEFLRTKLFPTGPDGELTHADKERAMNSYNAPDEVNQIDWNNVTLYKSTVNFVKELIRLKTQEEAFSYQTYEDIRKHVYVESAEYGSGLVIVSISSHDKIFKLIFNVSEKNAKIDMTQDEKYDIILTNIKRFHKLSGQLENLTATVFELKK

SEQ ID NO: 19200 - protein, 185 aa, Pseudomonas syringae
MSADIEHIRQIMREADCLYTEAEVDAAIARVGAQINAELADRNPVVFCVMNGGLIFSGKLLTHLNFPLEASYLHATRYRNETTGGDLFWKAKPEVSFIDRDVLIIDDILDEGHTLGAIIDFCKHAGARAVHTAVLIDKDHDRKARPDLKADYVGLPCIDRYIFGFGMDYKGYWRNAAGIYAVKGM

SEQ ID NO: 19201 - protein, 349 aa, Arabidopsis thaliana
MEDLDPTYIQAPEHRSDSNFIPNQPEEIPVIDLSRLDDPEDVQNVISEIGDACEKWGFFQVLNHGVPSDARQRVEKTVKMFFDLPMEEKIKVKRDDVNPVGYHDGEHTKNVKDWKEVFDIYFKDPMVIPSTTDPEDEGLRLVYNKWPQSPSDFREACEVYARHAEKLAFKLLELISLSLGLPKERFHDYFKEQMSFFRINRYPPCPRPDLALGVGHHKDADVISLLAQDDVGGLQVSRRSDGVWFPIRPVPNALVINIGNCMEIWTNDKYWSAEHRVVVNTTRERYSIPFFLLPSHDVEVKPLEELVSPENPPRYKGYKWGKFYVSRNRSDFRKLEIENIQIDDFKVKT

SEQ ID NO: 19202 - protein, 518 aa, Methylobacillus flagellatus
MLDANIKTQLQAYFDKLTQPIEITASVDGSDKSRELLELLDDLKSLSSRITVQQSDDDTQRKPSFSLNSPGKNLSIRFAGLPMGHEFTSLVLALLQVGGHPPKAEPEVIEQIRNLEGEFNFETYISLSCHNCPEVVQALNLMAAINPNIRHVMIDGALFQKEVDERKIMAVPTIFLNGQEFGHGRMGVQEILNKIDTGAVKKEAEKLSAKEPFDVLIVGGGPAGASAAIYSARKGIRTGIVAERFGGQVMDTMAIENFISVKETDGPKLAAALEEHVKSYDVDIMHLQRAAALVPAHENGGLAEVRLESGATLKAKAVIIATGARWREINVPGEKEYRGRGVAYCPHCDGPLFKGRSVAVIGGGNSGVEAAIDLAGIVKDVTLIEFNNELRADAVLQKKLFSLPNVTVITGAQTTEINGDGEKVNGLTYIDRQTGESHRIDLAAVFIQIGLVPNTDWIKDTITLNKFGEIEVDDKGQTSEPGIFAAGDVTTVPFKQIIIAMGEGSKAALGAFEHLIRH

SEQ ID NO: 19203 - protein, 147 aa, Medicago sativa
MSFTDKQEALVNSSWEAFKQNLPRYSVFFYTVILEKAPAAKGLFSFLKNSAEVQDSPQLQAHAEKVFGLVRDSAVQLRATGGVVLGDATLGAIHVRKGVVDPHFVVVKEALLKTIKEAAGDKWSEELNTAWEVAYDALATAIKKAMS

SEQ ID NO: 19204 - protein, 435 aa, Hyphomonas neptunium
MADSAHVPETLAGGFFSVGLAERDPELAAAINQEATRQQHQIELIASENIVSRAVLEAQGSILTNKYAEGYPGKRYYGGCEFVDIAEELAIERAKKLFNCGFANVQPNSGSQANQGVFQAVLKPGDTILGMSLAAGGHLTHGAKPNQSGKWFNAVQYGVRPEDHLIDFDEVERLARAHRPQMIIAGGSAYPRQIDFKRFREIADDVGAIFLVDMAHFAGLVAGGAHPNPLDHCHIATTTTHKTLRGPRGGMILTNDEALAKKINSAIFPGIQGGPLMHVIAGKAVAFGEALMPEFKTYVEQVVSNARAMAAACRTAGLDVVSDGTDTHLALIDLRPKGVTGRDAEAALERAYITCNKNGIPFDPAPPTVTSGIRVGSPAGTTRGFREEEFIQIGTWIGEIVDALANGNSDAVEARVREEVKALTARFPIYEGLGG

SEQ ID NO: 19205 - protein, 331 aa, Bacillus cereus
MNLAKFPRKKYTESYTPIEKLNNFSEALGGPTIYFKRDDLLGLTAGGNKTRKLEFLVADAQAKGADTLITAGGIQSNHCRLTLAAAVKEKMKCILVLEEGLEPEEKPDFNGNYFLYHLLGAENVIVVRNGADLMEEMHKVAKEVSEKGNTPYVIPVGGSNPTGAMGYIACAQEIMAQSFDQGIDFSSVVCVSGSGGMHAGLITGFAGTQSHIPVIGINVSRGKAEQEEKVAKLVDETSAHVGIPNFIPREAVTCFDEYVGPGYALPTPEMVEAVQLLAKTEGILLDPVYTGKAVAGLIDLIKKGTFKKEDNILFVHSGGSPALYANTSLFA

SEQ ID NO: 19206 - protein, 416 aa, Unknown
  Bradyrhizobium sp. BTAi1
MDDDRMGQGTVTNGPVVIVGAGHAGFQLATSLRQAGFADPIHLINDEAHLPYQRPPLSKAYLKGTGGPETLMFRPQKFYADQTIDLVHDRVVSVQRDQRKVLLASGKALGYGHLVFATGARNRLLDIPNANLPAVRYLRILDDSEALRGLLGEAKRVVVIGAGFIGLEFAATARIKGLEVDVLELGARVMARAVTAEISDYFQKQHAEAGVRIHLGVQATSIEADGNKVTGVSLSDGRHIPADLVVVGVGVLPNIELAADAGLAVASGIVVDEYLLTSDPHISAIGDCALFASPRFGGTLRLESVQNATDHARCVAARLTGDVKPYDGQPWFWSDQGNDKLQIAGLTTGYDQVVLRGDPAQKAFSAFCYKEGRLVGIESVNRAGDHMFGRKLLAAGGTVDAAKAADPSFDLKSALV

SEQ ID NO: 19207 - protein, 244 aa, Archaeoglobus fulgidus
MVGKVYIVGAGPGKKDLLTLRAYELIKRADVILHDELIGEVAELLKESRAEIVDVGKRSGRHKKRQEEINKLLVEYARQGKTVVRLKGGDPCVFGRGGEEAEFLAKHGIPFEFVPGVTSAIAVPEAVGIPVTHRRYDPALVFITGRESRERLNWKALAELNATIVILMGVSRIPEIAKNLLEHGKDPETEVAIIESGFSDRERVILTTLGKMAERAEKERVKPPAIIVIGKVVELYGVLSRWLG

SEQ ID NO: 19208 - protein, 315 aa, Arthrobacter crystallopoietes
MAKNLMLAVAQVGGIDSSESRPEVVARLIALLEEAASQGAELVVFPELTLTTFFPRTWFEEGDFEEYFDKSMPNDDVAPLFERAKDLGVGFYLGYAELTSDEKRYNTSILVNKHGDIVGKYRKMHLPGHADNREGLPNQHLEKKYFREGDLGFGVFDFHGVQVGMCLCNDRRWPEVYRSLALQGAELVVLGYNTPDFVPGWQEEPHAKMFTHLLSLQAGAYQNSVFVAAAGKSGFEDGHHMIGGSAVAAPSGEILAKAAGEGDEVVVVKADIDMGKPYKESVFDFAAHRRPDAYGIIAERKGRGAPLPVPFNVND

SEQ ID NO: 19209 - protein, 204 aa, Viburnum acerifolium
YDKPVKGRKINWMKAGILESNQILTVSPYYAKELVSGEDKGVELDNILRKTGILGIVNGMDVQEWNPFTDKYTGIKYDATTVMNAKPLIKEALQAEVGLPVDKDIPVIGFIGRLEEQKGSDILVEAISQFIGENVQIIVLGTGKKAMEKQLEQLEIEYPDKARGVAKFNVPLAHMIIAGADFILVPSRFEPCGLIQLHAMRYGT

SEQ ID NO: 19210 - protein, 561 aa, Oryza sativa
MASAPPVQEEALQPGTNHFRSLLAAAVRSISWSYAIFWSISNSCPGVLTWNDGFYNGVVKTRKISNSADLTAGQLVVQRSEQLRELYYSLLSGECDHRARRPIAALSPEDLADTEWYYVVCMTYSFQPGQGLPGKSYASNASVWLRNAQSADSKTFLRSLLAKTIICIPFTSGVLELGTTDPNFIIAYACHNMEQVLEDPNLVNRIVAYFQELQFPICLEVLMSTSPSPNETEDADIVSEGLITHNAIEEGQMVVSDECVSNANRDPITMEIDELYSIYEDLDLDTVRFLEDNGWPVNPSSFQLVSASSTEAVAAAAAANDVDGVANSQVSCFMAWKSAKSNEMAVPVVTGIESQKLLKKVVDCGARMSTGRGSRAALTQESGIKNHVISERRRREKLNEMFLILKSIVPSIHKVDKASILEETIAYLKVLEKRVKELESSSEPSHQRATETGQQRRCEITGKELVSEIGVSGGGDAGREHHHVNVTVTDKVVLLEVQCRWKELVMTRVFDAIKSLCLDVLSVQASAPDGLLGLKIQAKFACSGSVAPGMISEALQKAIGG

SEQ ID NO: 19211 - protein, 468 aa, Staphylococcus aureus
MTQQIGVIGLAVMGKNLAWNIESRGYSVSVFNRSSEKTDLMVEESKGKNIHPTYSLEEFVNSLEKPRKILLMVQAGKATDATIDSLLPLLDDGDILIDGGNTNYQDTIRRNKALAQSAINFIGMGVSGGEIGALTGPSLMPGGQEEAYNKVADILDAIAAKAKDGASCVTYIGPNGAGHYVKMVHNGIEYADMQLIAESYAMMKELLGMSHEDIAQTFKDWNAGELESYLIEITGDIFMKLDENKEALVEKILDTAGQKGTGKWTSINALELGIPLTIITESVFARFISSIKEERVNASKELNGPKASFDGDKKDFLEKIRKALYMSKICSYAQGFAQMRKASEDNEWNLKLGDLAMIWREGCIIRAQFLQKIKDAYDNNPGLQNLLLDPYFKNIVTEYQDALRDVVATGVQNGVPTPGFSSSINYYDSYRAADLPANLIQAQRDYFGAHTYERKDKEGVFHTQWIEE

SEQ ID NO: 19212 - protein, 204 aa, Viburnum carlesii
YDKPVKGRKINWMKAGILESDQILTVSPYYAEELVSGEDKGVELDNILRKTGILGIVNGMDVQEWNPLTDKYTGIKYDSTTVMNAKPLIKEALQAEVGLPVDKDIPVIGFIGRLEEQKGSDILVEAISQFIGENVQIIVLGTGKKAMEKQLEQLEREYPDKARGVAKFNVPLAHMIIAGADFILVPSRFEPCGLIQLHAMRYGT

SEQ ID NO: 19213 - protein, 449 aa, Oryza sativa
MASAPPVQEEALQPGTNHFRSRLAAAVRSISWSYTIFWSTSTSLPGVLTWNDGFYNGEVKTRKISNLEDHTADQLVLRRSEQLRELYYSLLSGECDHRARKPVAALSPEDIADTEWYYVVCMTYAFRPGQGLPGRSYASNRSVWLCNAQSADSKTFLRALLAKTIVCIPFMSGVLELGTTDPVSNTSKVSEDPNLVNRIVAYLKELQFPICLEVPSSTPSLDETEDADTVFDGLIEEHQMVILQGEDELGDVVVAECETNGANPETITMETDEFYSLCEELDLDLGSYQLVPTSARETVAAAANDVDGVAYSHASCFVSWKRANPAEKVVAVPMTAGIESQKLLKKAVGGGTAWMSNIDDRGSVAITTTPGSNIKSHVMSERRRREKLNEMFLILKSLLPSVRKVDKASILAETITYLKVLEKRVKELESSSREPSRWRPTEIGQGKAP

SEQ ID NO: 19214 - protein, 426 aa, Oryza sativa
MVLHADLPTSQSASIKTIVCVPFIMHGVLELGTTDPISEDPALVDRIAASFWDTPPRAAFSSEAGDADIVVFEDLDHGNAAVEATTTTVPGEPHAVAGGEVAECEPNADNDLEQITMDDIGELYSLCEELDVVRPLDDDSSSWAVADPWSSFQLVPTSSPAPDQAPAAEATDVDDVVVAALDGSSIDGSCRPSPSSFVAWKRTADSDEVQAVPLISGEPPQKLLKKAVAGAGAWMNNGDSSAAAMTTQGSSIKNHVMSERRRREKLNEMFLILKSVVPSIHKVDKASILAETIAYLKELEKRVEELESSSQPSPCPLETRSRRKCREITGKKVSAGAKRKAPAPEVASDDDTDGERRHCVSNVNVTIMDNKEVLLELQCQWKELLMTRVFDAIKGVSLDVLSVQASTSDGLLGLKIQAKVVISAAK

SEQ ID NO: 19215 - protein, 204 aa, Viburnum clemensae
YDKPVNGRKINWMKAGILESDQMLTVSPYYAEELVSGEEKGVELDSILHKTGILGIVNGMDVEEWNPLTDKYTGIKYDATTVMNAKPLIKEVLQAEVGLPVDKDIPLVGFIARLEEQKGSDILLEAISQFICENVQILVLGTGEKAMEKQLEQLEIEYPDKARGVAKFNVPLAHMIIAGADFRLVPSRFEPCGLIQLHAMRYGT

SEQ ID NO: 19216 - protein, 242 aa, Vibrio parahaemolyticus
MATVSMRDMLKAGVHFGHQTRYWNPKMKPFIFGARNRVHIINLEKTVPMFNEALAELAKVGEKKGKVLFVGTKRAASEAVKEAAIASNQFYVNNRWLGGMLTNYKTVRQSIKRLKELEIQSQDGTFDKLTKKEALMRTREMEKLEKSLGGIKDMGGLPDALFVIDADHEHIAIKEANNLGIPVYAVVDTNSNPDGVDYIIPGNDDAIRAVQLYLNAAASAVTEGRNKDVAVVAEKDGFVEAE

SEQ ID NO: 19217 - protein, 411 aa, Oceanobacillus iheyensis
MEFVKQADTEVFEAMQAEKNRQQDKIELIASENFVTKAVMDAMGSILTNKYAEGYPGKRYYGGCEHVDVVENLARDRAKELFGADHANVQPHSGAQANMAVYSAVLEPGDTVLGMNLNHGGHLTHGSPVNFSGQLYNFVDYGVDKETEQLDYDAVLEKAKEVKPKLIVAGASAYSRSINFAKFREIADAVDAYLMVDMAHIAGLVATGEHENPVPHADFVTTTTHKTLRGPRGGMILCKEEFAKKVDKAIFPGIQGGPLMHVIAAKAVSFKEALSDDFKAYSKQIVANAKLLGEALNKEGIRIVSGGTDNHLLLLDVTPLQLTGKVAEKALDDIGITTNKNTIPFDQESPFVTSGIRIGTAAVTTRGFGEEEMKEIASIISLTLKHHEDEAKLKEAAQRVQALTEKFTLYA

SEQ ID NO: 19218 - protein, 129 aa, Brassica napus
  misc_feature (21)..(21): Xaa can be any naturally occurring amino acid
  misc_feature (110)..(110): Xaa can be any naturally occurring amino acid
MESAALSRIGLACLAVMGQNXVALNIADKGFPISVYNRTTSKVDETLDRASEEGKLPVSGQYSPRDFVLSIQRPKSVIILVKAGAPVDQTISVLSEYMEPRDCIIGGGYXWFQNTERPIREAYKKGLLY

SEQ ID NO: 19219 - protein, 204 aa, Viburnum cylindricum
YDKPVKGRKINWMKAGILESDQILTVSPYYAKELVSGEDKGVELDNILRKTGILGIVNGMDVQEWNPLTDKYTGIKYDATTVMNAKPLIKEALQAEVGLPVDKDIPVIGFIGRLEEQKGSDILVEAISQFISENVQIIVLGTGKKTMEKQLEQLEIEYPDKASGVAKFNVPLAHMIIAGADFILVPSRFEPCGLIQLHAMRYGT

SEQ ID NO: 19220 - protein, 375 aa, Xanthomonas axonopodis
MTPILFVDRDGTLIVEPADYQIDAYEKLRLVDHVIPAMLKLRDAGYQFVIVSNQDGLGSESYPRASFDGPNNLMLQIFASQGIEFREVLIDCSWPADNAPTRKPGIGLMVPYLQDRTIDWARSAMVGDRITDIQFAQNLNIRGFQLRTDEFGGEWDWSGIAHELADAPRRALVQRNTKETRIRVELDLDRVAEPKTATGLPFFDHMLEQIGKHGGFALEIRAEGDLHIDEHHTIEDTGLALGQALREALGDKRGIGRYGFDPESSPWRVAGDTPQHGFTLPMDETIASAALDFSGRPYFVFEGEFKRERVGDMPTELVPHFFRSICDASGLNLHLTVRGENDHHKVEACFKALARALRQAIRREGTALPTTKGTL

SEQ ID NO: 19221 - protein, 508 aa, Zea mays
MESLVAALPAGGAAAAAAFGGLVAAAALAGKVGLVGSKKHLNAPPAVSGLPLIGNLHQLKEKKPHQTFTKWAEIYGPIYTIRTGSSTVVVLNSAQVAKEAMIAKFSSISTRKLSKALSALTRDKTMVATSDYGDFHKMIKRYIMTFMLGTSGQKQFRDTRNMMVDNMLNTFHTLLMDDPNSPLNFREVFKNELFRLSLVQALGEDVSSIYVEEYGKVISKEEIYKATVVDMMMCAIEVDWRDFFPYLSWIPNRTFETRVLTTEARRTTVMQALIKQQKERIARGETRISYLDFLLAENTLTDEQLLMLVWEAVIEAADTTLVTTEWAMYEIAKHPEKQEYLYQEIQKVCGNKTVTEDHLPELPYLNAVFHETMRRHSPVPLVPPRLVHENTNLAGYEVPAGTEIIINLYGCNMNKNDWAEPEEWKPERFLDGRFEAVDMHKTMAFGAGRRACAGSMQAMNISCTAIGRFVQEFAWRLEEGDEDKVDTIQLTTNRLYPLHVYLAPRGRK

SEQ ID NO: 19222 - protein, 576 aa, Vibrio angustum
MAQPNQNQEKLVWWKEATAYQIYPRSFYDSNADGIGDIPGIIKKLDYLADLGIDLVWICPFYQSPNDDNGYDISDYQAIHPDFGCLDDVDRLIREAHKRGIKIIIDLVINHTSDEHPWFIESRQNRNSAKRDWYIWRDGSEAITEKPTNEPNNWESIFHGSAWQYDAETAQYYLHLFSSKQPDLNWENPEVKAALFSMIHWWLERGIDGFRVDAISHIKKQANLPSLPNPNGDNYVSSFKYHMNVKGIEEHLHELRDKAFSPFDIVTVGEANGVAAEDALTWVAEETATNKAGVFNMIFQFEHMNLWSEDSNQSSFNLVKFKQILTRWQNALEGMGWNALYLENHDQARSINTFGNPNYRYASATALATCYFLMKGTPFIYQGQELGLVNFHFTSLDQFDDISARNLINKLKHQGKSDQYILSLLNRVSRDHSRLPMPWNSEENGGFSTVTPWITVNPNYERINVSEQLNNQNSVLQFYKQLIELRKQHKSLIIGRYKLILADDPNVYAYQRVSDDCTWTIITNLSDNVAKVNIDCSALGDLILDNQTKNNEIAKTNFEKTGLASAYGAYVFMTKH

SEQ ID NO: 19223 - protein, 549 aa, Arthrospira platensis
MFCEQCEQTASGQGCHQWGACGKGPDVNAVQDLLIYCLRGIAPVALKAKELGIDTHAVDVFCCESMFATMTNVNFNRKRFYSYIREAIAQREKLKTEIQQMSDRPISWSVAATYQPDWTDSLVAQGEEVSRNFIADSSQDIDIFSLKLTVLYGLKGLVSYSFHAQELGQEDDRIYSFCHQALAALEEPSLGLEDWVNLAMKVGEMNLLAMELLDAGHTNHYGHPIPTVVPLNAKAGKAILVSGHDIKQLEAILQQTANTGINVYTHGELLPAHGYPVLKQKYPHLYGHYGTAWQNQTKDFAKFPGAIVITTNCLMPPHEHYEDKLFTLGPVGYPDINYLEDRANLTPDFSPAIHKALALAGFAEDEPPRQVKTGFARNAVLNVSDQVIEAVKQGKIRHFFLVGGCDGAKPDRNYYTEFVDQVPSDCVVLTLACGKFRFFDKEMGEIGNIPRLMDVGQCNDAYSAIQIALGLAQAFDIGVNELPLSMILSWYEQKAVAVLLTLLYLGIKDIRLGPTLPAFISPNVFAILSAKYNLQAITTPEADLAACLN

SEQ ID NO: 19224 - protein, 408 aa, Flavobacteria bacterium
MKELLKRYENAEPEIVFHWNDPETEAQGWTVINSLRGGAAGGGTRMRAGLDKNEVLSLAKTMEIKFTVSGPAIGGAKSGINFDPRDPRKKGVLERWYKAVSPLLKSYYGTGGDLNVDEIHEVIPITEDCGVWHPQEGVFAGHFSPTEADKINRIGQLRQGVIKVIENPIYSPDVSRKYTVADMITGYGVAEAVKHFYDIYGGDVKGKRAVVQGFGNVGSAAAYYLSQMGAKVVGIIDRVGGLINEDGFSFEEIKEMFLNKDGNALRSSELIPFEEVNEKIWSLKTEIFAPCAASKLVSQDQIDQMIASGLEVISCGANVPFADKEIFFGSIMEHTDEKVSLIPDFISNCGMARVFAYFMERRVQMTDEAIFNDTSMTIRNAIQNTYNNNSSRTQISSTAFEIALKQLV

SEQ ID NO: 19225 - protein, 544 aa, Aspergillus nidulans
MASAARSASRAFLRSSLRPAVRSSRFALPTQGLRVASRRGYSSEASSGKSSNTLLWAGVALAGGAGAYFYLQGGDVGASTKVFTPTKEDYQKVYNAIAERLANETDYDDGSYGPVLVRLAWHASGTYDAETGTGGSNGATMRFAPESDHGANAGLKYARDFLEPIKAKFPWITYSDLWTLAGACAIQELGGPDIPWRPGRQDKDVSGCTPDGRLPDATKNQDHIRAIFGRMGFDDREMVALIGAHALGRAHTDRSGFDGPWNFSPTVFTNEFFRLLVEEKWQPRKWNGPKQFTDNTTKTLMMFPTDLALVQDKGFRKHVERYAKDSDAFFKEFSEVFVKLLELGVPFNSKVEDRYVFKRIISAPTTTPSFYEILNLPFPSTGLSKQQLKIAYHKALLKHHPDKAVAVAKENLPSSNHGPAQPPSNQKITIDAITTAYKTLSDPVQRAEYDRVLRLDRNRVNGAGDKNGNGTVFHTGLEVVDLEDLDCDEGGDEAMWYMACRCGDERGFSLSESDLEREADSGEIVVGCRGCSLYTKVLFAVQDD

SEQ ID NO: 19226 - protein, 952 aa, Vibrio angustum
MKLTKRSDKVSKVENQLGISRRSFIRNTSLAAAGGVAGASMFAPGMMKKAEAASEDVYDAPKVVKRTICSHCSVGCGIYAETQDGVWTHQEPAFDHPFNAGGHCAKGAALREHGHGARRVKYPMKLVNGKWKKLSWEQALDEVSQQVLKIREESGPDSVYFLGSAKHNNEQAYMFRKMVSMWGSNNVDHQARICHSTTVAGVANTWGYGAMTNSLNDMHNCKSMLFIGSNPAEAHPVAMQHILIAKETNSCKIVVVDPRRTRTAAKADHYVSLRPGTDVAFVWGVLYHIFNNGWEDKEFIRQRVYGMDEVREEVAKWNPKEVERVTGVPEDQVYQTAKMLSENRPGCVVWCMGGTQHTTGNNNTRAYCILELALGNMGKSGGGANIFRGHDNVQGATDFGVLSDNLPGYYGLSEGAWKHWAQVWDVDYSWLQGRFDQNTYNGKKPMNSAGIPVSRWIDGVLENKDKIEQRDNIRAMFYWGHAVNSQTRGPEMKTAMEKLDMMVIVDPYPGVAAVMNGRTDNVYLFPATTQFETYGSVTATNRSIQWRDQVIEPLFEAKPDHEIMYLLSKRLGFADQLFKNIKVENNRPHIEDITREFNKGMWTIGYTGQSPERLKEHQQNWHTFNRTSLEAIGGPANGETYGLPWPCWGTPEMKHPGTHILYDTSKTVAQGGGNFRARFGVEHNGVSLLADDSYSLGCELEDGYPEFTAKMLKQLGWWDDLTAEEKVAAEGKNWKTDLSGGIQRVAIKHGCIPYGNAKARTVVWTFPDAVPIHREPLYTPRRDLLPEYQTWDDKAHLFRLPTLYKSIQDKDMSKEYPIILTSGRLVEYEGGGEETRSNPWLAELQQEMFVELNLKDANDRGIKDGEMVWVEGAEKGRIKVKAMVTPRVREGLAFLPFHFGGEFEGESLRSHYPEGCAPYVSGEAANTATTYGYDPVTQMQETKVTLCNITKA

SEQ ID NO: 19227 - protein, 419 aa, Oryza sativa
MVLQHSDRMDSLFSPQTSWVSGPIIVGAGPSGLAVAASLREQGVPFTMLERADCIASLWQKRTYDRLKLHLPKQFCELPRMAFPAHYPEYPTRRQFIDYLEDYAAAFDINPLFGHTVLSARYDETSGLWRVRASSSAGAEMEYIGSWLVVATGENAESVVPDIPGIDGFGGEVVHVADYKSGEAYRGKRVLVVGCGNSGMEVSLDLCDHGARPAMVVRDAVHVLPREVLGKSTFELAVLLMAWLPLWLVDKILVLLAWLVLGNLAKLGIRRPATGPLELKNTTGRTPVLDYGALARIRSGEITVVPGVARFGKGFAELADGRVIALDAVVLATGYRSNVPQWLQGNDFFNKDGYPKTAFPNGWKGESGLYAVGFTRRGLSGASADAMRAAKDLARVWKEATKPTKKSTACHRRCISVIF

SEQ ID NO: 19228 - protein, 648 aa, Cryptococcus neoformans
MAPIAIQNPLEDAQVAPPPPLKSSKASMGSIKKELPKHPDAVPHDYMYKFKYNHELPLHGKEGIEIPQNVNPKDVADEIASLLSQATSKGDPKAFSELFLEHGVWRDRVALTWDYRTFNWRSAILKAATDLLPENPISKVTVIDPPPTVERPYEDLSFVQAHIGFQTNKVGATALCNIVLTKDGYKIWTFNSAIESLHGFREVPERDGHMTGPHSWTQQREIDISMEDSEPEVLIVGGGQNGLMLGARLKALGVNALIVERNKRIGDNWRGRYEALSLHLPHWADHFAYMPYPEQHWPTFCPAAKLGDWFEWYASAMELNTWTDSSVTGAKQDPDGKWTVEVNRGGQGKRVFHPKQLVMATSLIGIPHVPKVPGDDIFKGTIRHSSQHDSSREWVGKKVLVVGTSSSGFDTAYDFARRGVDVTLLQRSPTYIMSLTHCIPRLLGVYKPDDNGKRPDIDIADRIAHGMPVGPGEELGRRLGQELTELDHDLLQALEDKGFKTWRGQRNTSTQTLGYTKAGGFYFDAGACTQIIEGKIKVEQGYIDHFTEDKVVLNGDREKTYDLVVLATGFSNTIDSVRRTLGDDVADRCKPVWGMDEEGELNSAWRDTGVPNLWVMVGTLQAARYHSKKVALNIKARLEGICKEPYLE

SEQ ID NO: 19229 - protein, 873 aa, Zea mays
MDTAIGSVPAASDAARHPAPSASAPRDATLGRHLARRLAEVGARDVFTVPGDFNLTLLDELEAEPGGVRLVGCCNELNAAYAADGYARARAGGVGACAVTFTVGGLSAINGVAGAFSENLPVVCIVGGPNSNDYGSNRILHHTIGLPDFTQELRCFQNVTCYQVGAVVNNLEDAHEQIDTAISTAIKESKPVYISISCNLPSIPHPTFSRHPVPFFLSPRLSNQMNLEAAVEAAAAFLNKAVKPVLVGGPKMRVSKAWEALAELADACGYPVAVMPSAKGLVPVHHSRFIGTYWGAVSTPFCAEIVESADAYLFAGPVFNDYSSVGYSLLLKKEKAIIVQPERVVVGHGPAFGCVLMKDFLHALATRLKKNTVAYENYRRIYVPPGEPLSSEPGEPLRVNVLFKHIQAMLSGDMAVIAETGDSWFNCQKLKLPEGCGHLLLSPITRYEFQMQYGSIGWSVGATLGYAQAAKDKRVIACIGDGSFQVTAQEVSTMLRWGQNSIIFLINNGGYTIEVEIHDGPYNVIKNWNYTGLVEAFHNGEGACYTAKVRTEEELTEALEAALGPKKDCLCFIEVIVHKDDTSKALLEWGSRLVTPISTKLQRPDGAACAAPTAEPLDRVRLTATKSSPRRHGKLRSARPQGSDSGSAPEDDELRSARPQGSDSGSAPEDDELRSARPQGRTRAPPRKTTNSAPPDPRARTRAQPRKTTNSAPPDPRARTRAQPREDDELRFARPQASDSGSAPEDDELRSAQPQGSDSGSAPEDDELRFARPQGSDSGSAPKDDELRFARPQGSDSALASADGLRLARPRGSDSTSALEDRLDLDLGGASTSPNPGHGPTTSTGGAIITLPQADSGYGEQDRRPIWLAPLYE

SEQ ID NO: 19230 - protein, 188 aa, Glycine max
MFLNCRLPGDYGFDPLGLGKDPAFLKWYREAELIHGRWAMAAVLGIFVGQAWSGVPWFEAGADPNAIAPFSFGTLLGTQLILMGWVESKRWVDFFNPDSQSVEWATPWSRTSENFANATGEQGYPGGKFFDPLSLAGTIKDGVYIPDTEKLERLKLAEIKHARIAMLAMLIFYFEAGQGKTPLGALGL

SEQ ID NO: 19231 - protein, 444 aa, Thermus thermophilus
MTATSLWELAERARKRLSEIAKGNRDRALLAMADLLEARWEEVLRANREDLEEAERTGLPKAKLDRLALKEKDLKTLTEGLRQIARLPDPLGRIEGLAKRPNGLRVGRMRVPLGLIGFIYEARPGATVEAVSVALKAGNAMLLRGGKEAFRSNRALVALWHEALEEAGLPEEAVTLVPTTDREAVLEMCRLELLDLLIPRGGEELIRLVQQEARVPVLAHAKGVNHLYVDEKADLSMALRLALNGKTQRPAVCNALEAVLVHEKVAEAFLPRLEKAMREKGVELRACPRALPLLKEAVPAREDEWDREYLDLVLRVKVVSGLEEALAHIARYGSRHTEAICTEDPKAAWRFLEEVDASLVLWNASTRFNDGFELGLGAEIGISTSKLHPTAPWGPWSSPPSSGWPWGRGRSAREAGRPRGPGLGPHGGRSLQGSGSPPPGGTFA

SEQ ID NO: 19232 - protein, 958 aa, Bordetella parapertussis
MLETVIKRDRDLGTPARESAQLVTLTIDGQPVSVPAGTSVMRAAAEAGINIPKLCATDSLEPFGSCRLCLVQIEGRRGYPASCTTPVEAGMVVQTENARLRDLRRGVMELYISDHPLDCLTCPANGDCELQDMAGVVGLREVRYGYDGENHLAEAKDESNPYFTYDPSKCIVCNRCVRACEETQGTFALTISGKGFASRVSPGQDQPFMDSECVSCGACVQACPTSTLQEKSIIMLGQAEHSVITTCAYCGVGCGFKAEMKGEEVVRMVPWKDGQANRGHSCVKGRFAWGYTTHKERVLKPMIRQRITDPWREVSWEEAIGHAASEFRRIQAAHGRDAIGGITSSRCTNEETWLVQKLVRAAFGTNNVDTCARVCHSPTGYGLKQTLGESAGTQTFDSVMHTDVVIVMGANPSSAHPVFASRLKRRLREGALLIVIDPRRIELVSAPHVKADFHLQVRPGTNVALLTAMAHVIVTEGLVAESFVAERCEAPSFDMWREFVARAENSPEAMQEVTGVPAQLVRGAARLYATGGNGSIYYGLGVTEHSQGSTTVMAIANLAMATGNIGREGVGVNPLRGQNNVQGSCDMGSFPHELPGYRHISDDAVRGEFERDWGVTLQPEPGLRIPNMFEAALGGSFLGLYCQGEDIVQSDPNTQHVAAALSAMECIVVQDLFLNETAKYAHVFLPGSSFLEKDGTFTNAERRISRVRKVMRPRNGMADWEITMALSNALDYPMHYAHPSEIMDEIARLTPTFAGVTYEKLDRLGSIQWPCNEDAPEGTPTMHIDEFVRGRGRFMLTKYVATDERSTRRYPLLLTTGRILSQYNVGAQTRRTPNVMWHGEDVLEIHPHDAQERGVADGDWVGIQSRAGETVLRATLTDRVQPGVVYTTFHFPESGANVVTTDNSDWATNCPEYKVTAVQVTRVSQPSEWQRQWSRFADVQQKLLHERARETEPALANK

SEQ ID NO: 19233 - protein, 582 aa, Coccidioides immitis
MTSIDELFKTPSLPSGQKRKFEPVRDPNEIYKSAKLDTNGAASGSRAATVDDAEDEDIAGPELPPDFGQEDVPDDEEGRFFGGGVTRDTTNALDFIEQQEKEGVRAGKIDSAWLKRTALNFEKRISKNAELRAKYESDPQKFMASEADLDVDIKGLSILSEHPQLYPEFAELGCVGSLVSLLAHENTDIAIDVIEILAELTDEDVEAESEQWESLVDAMLDADLIELLAQNLSRLDEDIESDRAGVYHILNVLENLSSQSSVAEKIGQESEIMPWLYARIQKGEKSVTQNKQYAAEVLAILLQSSQKNRERFVGLNGVDTLLQLLSVYRKRDPEKDSDEEEYVENLFDSLTCVVDGALGKEKFVEAEGVELAQIMLREGKMSKPRALRVLNHAVGGKDGARVCEQLVEAGLLRTVFGMFMKKQDNQTIEHLLGIFASLLRLLPGESAGRIRTLAKFVEKDYEKVSRLVQFRRGYASKLLPVDQAIVQERANLSKDEQDAMAVEWLSRRLDVGLFSLQIIDVILAWLVAEDDGAKARINSLLSEQDQDLSIIRATLEEQLSGLEGPEGEEEEKDMLTTLLEFI

SEQ ID NO: 19234 - protein, 154 aa, Glycine max
KDAREGDDNLSTVHHELHFTVQECIDALGEVIYHIETYDVTTIRASTPMFLMSRKIKSLGVKMVISGEGSDEIFGGYLYFHKAPNKKEFHEETCRKIKALHLYDCLRANKATSAWGVEARVPFLDKSFISVAMDIDPQWKMIKRDSVQIEKWVT

SEQ ID NO: 19235 - protein, 99 aa, Nostoc punctiforme
MATYQVRLINKKEDIDTTIEVDEETTILEAAEENGIELPFSCHAGSCSSCVGKVVEGEVNQEDQNFLDDDQVSKGYALLCVTYPRSNCTIKTHQEAYLV

SEQ ID NO: 19236 - protein, 389 aa, Oryza sativa
EAMLPAVKLSPGPVAFAGTNLRSRSASVSSVSSLKPSKFVVSPLRPLYLAPLDGPRAAGQKAQRQPLEFRCAASAADDKESKTEVVPVRSEAAQKLKISIYFATWWALNVIFNIYNKKVLNAFPYPWLTSTLSLACGSAMMLVSWATRLVEAPKTDLDFWKVLFPVAVAHTIGHVAATVSMSKVAVSFTHIIKSAEPAFSVLVSRFLLGETFPVPVYLSLLPIIGGCGLAAVTELNFNMVGFMGAMISNLAFVFRNIFSKRGMKGKSVSGMNYYACLSIMSLVILTPFAIAMEGPQMWAAGWQKALAEVGPNVVWWVAAQSVFYHLYNQVSYMSLDEISPLTFSIGNTMKRISVIVSSIIIFHTPVRPVNALGAAIAILGTFLYSQAKQ

SEQ ID NO: 19237 - protein, 693 aa, Oryza sativa
MGGGGGGDAGGRTVVWFRRDLRVEDNPALAAAARAGGEVVPAYVWAPEEDGPYYPGRVSRWWLSQSLKHLDASLRRLGAGKLVTRRSADAVVALLQLVRDTGATRLFFNHLYDPISLVRDHRLKEMMAAEGIIVQSFNADLLYEPWEVVDDEGQSFTMFAPFWNRCLSMPYDPAAPLLPPKRINSGDLSMCPSDDLIFEDDSERGSNALLARAWSPGWQNADKALTAFLNGPLIHYSVNRKKADSASTSLLSPYLHFGELSVRKVFHLVRMKQLVWSNEGNRAAEESCTLFLRSIGLREYSRYLSFNHPCSHEKPLLAHLRFFPWVINECYFKIWRQGRTGYPLVDAGMRELWATGWLHDRIRVVVSSFFVKVLQLPWRWGMKYFWDTLLDADLESDALGWQYISGSLPDGRELDRIDNPQLEGYKFDPHGEYVRRWLPELARLPTEWIHHPWDAPASVLQAAGVELGSNYPLPIVGLDAANARLQEALSEMWQLEAASRAAMDNGMEEGLGDSSEVPPIEFPRELQMEVDREPARVTANVLTTARRREDQMVPTMTSSLNRAETEISADFMNSVDSRAEVPTRVNFEPRTEREENFRTTAGNVARTNGIHEHNNFQQPQHRMRNVLAPSVSEASSGWTGREGGVVPVWSPPAASDHSETFASDEADISSRSYLDRHPQSHRLMNWSQLSQSL

SEQ ID NO: 19238 - protein, 453 aa, Bartonella henselae
MSDLSSNRLPNRASRVTNQALSAIERFLHIEALSGVVLLLAAAAALMFANSEYASLYESFWHTPLGFNFGHFTLSWDLHFWVNDALMAVFFLVAGMEIRREIHEGALADFKQAILPIVAAIGGVCLPAIIYFSFNFNSGQIHGWAVPTATDIAFALGILALLGKKIPSNLHIILLSLAIIDDIIAVLIIAFFYSTNIDPSGLVIAIAGIALVLFFQWIGFASAWLYILPGAIIWWGLMVTGIHPSLAGVILGMMTPVLPTRTLIAPLTILSNAMQILQEKNTKTDLHHISTALKKMRKGQRDIIAPVTRIQKALHPWVAYGVMPIFAFANAGVSFANFDLSSDKSFLIVLGVVIGLFIGKPLGIITASYLAVKSGLCRLPPQMTWAGILLIGFLAGIGFTMSIFVSMLAFKDIVLLDSAKIGVLCGSGLSALIGLGYGLIYIKRNKKASHSSQ

SEQ ID NO: 19239 - protein, 312 aa, Phaseolus vulgaris
KRLEISFSQPGLFADPEGRGLRVLTKSQLDEILTPAACTIVSSLSNDDVDSYVLSESSLFVYAYKIIIKTCGTTKLLLSIPPILKFADMLSLKVKSVTYTRGSFIFPGAQPHPHRCFTEEVAILNDYFGKLGSGSMAFIMGSPDKKQKWHIYSASADPLISSDTNVCTLEMCMTGLDREKAQIFYREQSASAAIMTVNSGIRKILPMSDICDFDFEPCGYSMNSVEGDAVSTIHITPEDGFSYASFETVGYDFKVLNLNALVDRVLSCFLPDEFSVAVRVDGASKPSEQMCFVDVKGYCREEWIHEGLGMGG

SEQ ID NO: 19240 - protein, 204 aa, Viburnum dilatatum
YDKPVKGRKINWMKAGILESDQILTVSPYYAKELVSGEEKGVELDNILRKTGILGIVNGMDIQEWNPLTDKYTGIKYDATTVMNAKPLIKEALQAEVGLPVDKDIPVIGFIGRLEEQKGSDILVEAISQFIGENVQIIVLGTGKKAMEKQLEQLEIEYPDKARGVAKFNVPLAHMIIAGADFILVPSRFEPCGLIQLHAMRYGT

SEQ ID NO: 19241 - protein, 186 aa, Triticum aestivum
  misc_feature (115)..(115): Xaa can be any naturally occurring amino acid
VTLQNKFVQKSRLLPVRNSRDIVDPRVRAPQPPPAAVAAASQQTAAQQQQQLQVFWAEQYREIEATTDFKNHNLPLARIKKIMKADEDVRMIAAEAPVVFARACEMFILELTHRXGWAHAEENKRRTLQKSDIAAAIARTEVFDFLVDIVPRDEAKDAEAAVAAGMPHPAAGMPAADMGYYYVPQQ

SEQ ID NO: 19242 - protein, 989 aa, Bordetella bronchiseptica
MLLTKKTSGAAAGASESHFIQSLRRGMAQALPTMDRRTFLRRSGLGVGAGLAATQLALVKRAEAAEGDGKVAIGNTKIEVRRTVCTHCSVGCAVDAVVENGVWVRQEPVFDSPINLGAHCAKGASVREHGHGEHRLRYPMKLVNGKYQRISWDTAYEEITAKLMQLRKESGPDSVYWIGSSKHNNEQSYLLRKFVSFWGSNNCDHQARICHSTTVAGVANTWGYGAMTNSYNDMQNSKVALYIGSNAAEAHPVSMLHMLHAKETGCKMIVVDPRFTRTAAKADQYVRIRSGTDIPFLFGLLYHIFKNGWEDQAYIDARVYGMDEVKADILAKWSPDKVEEACGVDEATMYSVAKTMHENRPGTLVWCMGQTQHSIGNAMVRASCIVQLALGNVGKSGGGANIFRGHDNVQGATDVGPNPDSLPGYYGLAEGSWKHFANTWGVDYEWIKGRYASPAMMTKPGITVSRWIDGVLENPDLIDQDTNLRAVFYWGHAPNSQTRGLEMKRAMDKLDLLVVVDPYPSATAAMAAMPGKAEDLNPNRAVYLLPAATQFETNGSCTASNRSLQWREKVIDPLWESRTDHMIMHQLAEKLGFGKELSKNYKMQKVKGMDEPVVEDILREINASVWTIGYTGQSPERLKAHMRNMHVFDVKTLRAKGGKDAETGYDLTGDYFGLPWPCWGNPSLKHPGTANLYDTSLHVMDGGGNFRANFGVERNGVNLLAADGSHSKGADLTTGYPEFDHVLLKKLGWWEDLTPEEQKAAEGKNWKTDPSGGIIRVTMKVHGCHPFGNARARAVVWNFPDAIPQHREPIYGTRPDLVAKYPTHNDLKTFWRLPTLYTSLQQKNVAEKLYEKFPIILTSGRLVEYEGGGEETRSNPWLAELQQESFVELNPKAAADRGIRNGDRVWVLTPTGARLNVQALVTERVGPDTAFMPFHFSGHWQGVDMLASYPEGAAPIVRGEAVNTGTTYGYDSVTMMQETKTTICNIEKA

SEQ ID NO: 19243 - protein, 204 aa, Viburnum elatum
YDKPVKGRKINWMKAGILESDQILTVSPYYAEELVSGEDKGVELDNVLRKTGILGIVNGMDVQEWNPLTDKYTGIKYDATTVMNAKPLIKEALQAEVGLPVDKDIPVIGFIGRLEEQKGSDILVEAIPQFIGENVQIIVLGTGKKAMEKQLEQLEGEYPDKARGVAKFNVPLAHLIIAGADFMLVPSRFEPCGLIQLHAMRYGT

SEQ ID NO: 19244 - protein, 113 aa, Triticum aestivum
MTEKKNRREKKNPREAKVTFEGLVTEALPNGMFRVRLENDTIILGYISGKIRSSSIRILMGDRVKIEVSRYDSSKGRIIYRLPHKDSKRIEDSKDSEDLKDSEDLKDTKDSKD

SEQ ID NO: 19245 - protein, 72 aa, Geobacter metallireducens
MSKEEAIEVEGTVIEPLPNAMFRVELENGHVVLAHISGKMRKYFIKILPGDKVTVELSPYDLSRGRITYRAK

SEQ ID NO: 19246 - protein, 492 aa, Rhodopirellula baltica
MSGDCDFGLIGLAVMGENLALNVESRGYKVAVYNRTTSKVDALMEGRAKGKNFVGCHSIEEFVKSVKRPRRLMMLVKAGPAVDALIEQLLPHCEPGDIIIDGGNEYYVHTERRTKQVEEAGMLYVGCGVSGGEEGALKGPSLMPGGSAEAWPHIKEMFQSIAAKVGPNNDIPCCEWLGAGGAGNYVKMVHNGIEYGDMQLICEAYQLLKELGGLSNDELYDVFDEWNRGDLQSYLIEISRDIFSVKDDQGGDGYLVDKIMDVAGAKGTGKWMSQLALDLGVPSTLVTTAVFARGLSAQKEARTRASKTLNGPAESSNPEMRAIAQSLVGDRAEFVEAVRQALYASKIVSYAQGFVQLQAASAEHNWGLDYGAAALLWRGGCIIRAQFLDRIKEAFDADPNLENLLLAKYFEDAVENAQEKWRKVVAIASIMGIPVPAFSTALCYYDGYRMERLPANMLQAQRDYFGAHTYQRVDKEGTFHSEWIQLRKEPKA

SEQ ID NO: 19247 - protein, 204 aa, Viburnum ellipticum
YDKPVKGRKINWMKAGILESDQILTVSPYYAKELVSGEDKGVELDNILRKTGILGIVNGMDVQEWNPLTDKYTGIKYDATTVMNAKPLIKEALQAEVGLAVDKDIPVMGFIGRLEEQKGSDILVEAISQFIGENVQIIILGTGKKAMEKQLEQLEIEYPDKARGVAKFNVPLAHMIIAGADFILVPSRFEPCGLIQLHAMRYGT

SEQ ID NO: 19248 - protein, 396 aa, Arabidopsis thaliana
MAATSNSGEDPTLSYHHRSPFRFELLQSISSSDPRYSSLTPSSTNRPFSVSQSLPNSQLSPLISPHWDDSYSQITQKVQKSRKNHRIQLGSIANMSGGESIDIAKVIVKQESSPQNVKRVYNKSKGGTKLLKAGKRMANGEVQNGGLNGASINCRYDSSLGLLTKKFVKLIQEAEDGTLDLNYCAVVLEVQKRRIYDITNVLEGIGLIEKTTKNHIRWKGADNLGQKDLGDQISRLKSEVESMQSEESRLDDLIRERQEALRSLEEDDYCRRYMFMTEEDITSLPRFQNQTLLAIKAPTASYIEVPDPDEMSFPQQYRMVIRSRMGPIDVYLLSKYKGDSAETSDKLGNESDQKAPVGVDTPSLKIVTSDTDLKADYWFESDAEVSLTDLWSNFNS

SEQ ID NO: 19249 - protein, 197 aa, Rubrobacter xylanophilus
MLRAGAGTPAAWYPQRRMDGRLETATLGGGCFWCVEAVFDELRGVRRVEPGYSGGHVERPTYEQVCTGLTGHAEVVQVSFDPREISYRELLEVFFAVHDPTTKDRQGPDVGPQYRSVIFYHDEEQRRTAEEVISELEARGIWDGPIVTEVAPFTAFYPAEEYHRDYFRRNPDQPYCRVVIAPKVAKFRKEFLERLKA

SEQ ID NO: 19250 - protein, 833 aa, Oryza sativa
MPPWWGKSFSKDAKKTTKENLIDTFHRLISPNDQKGSTKSKRSCRRGNDSSVEKSCRSTTVSRPTSPSKEVSRCQSFSADRPHAHPLPIPGVRPPVTRTVSDITESKPILEKRGKPPLLLPLPKPNRPPRRHGNSEVVSEIVVASPSSNCSDSDDHGDSQLQSPVGNDAENATLVTLKNKSSNARKECPGPITAKNMKEIHRPANQVHGSHILSTSPRGVAADSYQSNLQNPRPLVLDSAPNSLMSSPSRSPRRICPDHIPTSAFWAVKPHTDVTFVGSGQCSSPGSGQTSGHNSVGGDMLAQLFWQPSRSSPECSPIPSPRMTSPGPSSRVHSGSVSPLHPRSGGMAPESPTNRHDDGKKKQTHKLPLPPLSISHSSFYPNNSTPTSPISVPRSPGRTENPPSPGSRWKKGKLIGRGTFGHVYVGFNSDSGEMCAMKEVTLFLDDPKSKESAKQLGQEISLLSRLQHPNIVQYYGSETVDDKLYIYLEYVSGGSIHKLLQEYGQLGEQAIRSYTQQILSGLAYLHAKNTVHRDIKGANILVDPSGRVKLADFGMAKHINGQQCPFSFKGSPYWMAPEVIKNSNGCNLAVDIWSLGCTVLEMATSKPPWSQYEGIAAMFKIGNSKELPPIPDHLSEPGKDFIRKCLQRDPSQRPTAMELLQHPFVQKAVSLEKSVLSEPLEHLAVISCRPSAKFSDGCAYKKYFLIGIGGSDNLPEKRCKIFFKTQQSTYSNEGFAIPSRSPDDLFASRPTDPDLGQFIRVHQISQGLQERVVSEADILSPQFGKRLGNVFDLRDKLSPSERFTHHAFVDHVKLNPSLDLTSGSPHLGLKHGN

SEQ ID NO: 19251 - protein, 685 aa, Arabidopsis thaliana
MDQQDHGQSGAMNYGTNPYQTNPMSTTAATVAGGAAQPGQLAFHQIHQQQQQQQLAQQLQAFWENQFKEIEKTTDFKNHSLPLARIKKIMKADEDVRMISAEAPVVFARACEMFILELTLRSWNHTEENKRRTLQKNDIAAAVTRTDIFDFLVDIVPREDLRDEVLGSIPRGTVPEAAAAGYPYGYLPAGTAPIGNPGMVMGNPGEESKVFMSIDPFLNEKFRDEPERRMYKLRVNNVIAFIYKKRYLVVIYLLRKGAASMATNNDFGAFIEKVTISPTSTSSSPPSLQGLTFAIKDIFDVEGRVTGFGNPDWLRTHSAATSTAPVVSSLLEAGATALGITIMDEMAYSINGENAHYGTPRNPIAFDRVPGGSSSGSAVAVAARLVDFSIGTDTGGSVRVPASYCGIFGFRPSHGAVSTVGLTPMAQSFDTVGWFARDTATLKRVGCVLLQQHHLNPIEPSQLIIADDCFKLCSVPHDLLVQPLVGSVEKSFGGNTVVKKVNLGEYIGQNVPSLKHFMTSDDVTTQQEFCIPSLMALSSSMRLLQRHEFKINHGAWISSVKPEFGPGISERIEEAIRTSDEKIDHCRSVKSELITALSTLLGEKGVLVIPTVPGPPPHLQANVAALESFRSRAFSLLSIAGVSGFCQVSIPLGLHENLPVSVSLVAKYGSDGFLLSLVDSLAAFI

SEQ ID NO: 19252 - protein, 204 aa, Viburnum erosum
YDKPVKGRKINWMKAGILESDQILTVSPYYAKELVSGEDKGVELDNILRKTGILGIVNGMDVQEWNPLTDKYTGIKYDATTVMNAKPLIKEALQAEVGLPVDKDIPVIGFIGRLEEQKGSDILVEAISQFIGENVQIIVLGTGKKAMEKQLEQLEIEYPDKARGVAKFNVPLAHMIIAGADFILVPSRFEPCGLIQLHAMRYGT

SEQ ID NO: 19253 - protein, 197 aa, Saccharophagus degradans
MADRKAQVSRDTLETQISVELNLDGTGTGKFNTGVPFLEHMMDQIARHGFIDLDVTCKGDTYIDDHHSVEDIGITIGQAMAKAVGDKRGIRRYGHAYVPLDEALSRVVIDFSGRPGLIMNIPFTQKRIGKFDTELFWEFFQGFVNHAGVTLHVDCLRGENAHHQIETVFKAFGRSLRMALERDERLGDAMPSTKGTL

SEQ ID NO: 19254 - protein, 607 aa, Campylobacter upsaliensis
MNKKGPLYFGIIVVIALIGGVLWLNNDVNQKQQESVGGIVSKNFVEMSDDNPTFDEWGKNFPDYLDMYLTVEKEKPFETDFGGNLAYSKLIRYPQLTVLWAGYPFSIDANEERGHFWIQVDQMDTARNNKDFLNAHGFAGFGGQPTACMNCHSGWTPWLLKNVAKDDWVAFNSTKYWTMIKNVPAVNGYKEGSVEHSGPHGGKRMGVTCADCHTPNNMSLRLTRPAAINALVARGYERDAEQGVKATREEMRTLVCSQCHVEYYFKPTGEKVKVMGESIANDTTKKWWNGTQKTYDEFDTWRDGNKPTEIEVAGIELVFPWSEWKKGEPFRIEMFDEYYEKVRKVFDKDWAHKISGAPMIKIQHPESELYSGGVHAANGVSCADCHMPYIRKGAKKMTQHNITSPLADINAACKTCHNQSEDYLKAQIKDIQNSTAHNLRTAEYAIVSLITDIKTMRDSLGALETYQSEGKADVKKINEELNEVLELHRKAQMRADFIGAENSTGFHNPRESSRMLLQAVDMARMGQTKLVEIANAKGIADFKTSNLGFEDMQKLNPGEIRYKVELNGHKEGERYYKHDNVNGSPSNALIEKDKNLKPYNYQVVDKQ

SEQ ID NO: 19255 - protein, 691 aa, Desulfovibrio desulfuricans
MYRHMCHRAAYGSSGRQPRRHIDFTGRCPHSAVMHTLFVPAHGPRRLPDGSWLFRLWTTRRKPAVLVIEAPCPQEIPMKACGGGWREARTAPMPAGALYRIRLGDELLADPASAHQPQGIDGPSMTDDPAAFIWTDSGFGAVAMPHAVIYEIHTGTFTPEGTLDAAAGRLPRIAELGVTAVELMPLTETTGRWNWGYDGVFPYSIHHRAGGPDALRRFVDTAHGLGLSVYGDVVLNHLGPEGNNLPKFGPYLSRRHHTPWGACPSFDGASAQAVRRYFLDCCLRLMAHFHMDGLRLDATPYVQDDSAEHILAALTRETQVLAAASGRRLHIMAESTRNEIHLTTPRSAGGYGMAAQWSDDFHHAVHARLTGESCGYYAAFHTAQNPAKPAQTPPAAGQQSKEAQKRCPPAAAVSPVDALAEIFVRGWFRQGQLCPWRKQPFGDQPRGLQPSQVIVYLQNHDVTGNRPSGERLHALTCPAARRMAAAALLLSPFVPLIFMGEEYDDPAPFHFFVDHSPELNRQVAQGRRREAAAFGWMPCATAPEPHSPAAFENSRLSWHLQDTRYHATVRDLYRRCIRLRQTLPSLDSPSFETLYVSRPHPQVICTGRTDPARIYSSWLLLNCGPQAATFSIDAATAPLARQQAWSQALCTADRRWHSPHTQEDEADLPHRFAAGTHIPVTLPPWCALLLA

SEQ ID NO: 19256 - protein, 204 aa, Viburnum farreri
YDKPVKGRKINWMKAGILESDQILTVSPYYAEELVSGADKGVELDNILRKTGILGIVNGMDIQEWNPLTDKYTGIKYDVTTVMNAKPLIKEALQAEVGLPVDKDIPVIGFIGRLEEQKGSDILVEAISQFIGENVQIIILGTGKKAMEKQLEQLEIEYPDKARGVAKFNVPLAHMIIAGADFILVPSRFEPCGLIQLHAMRYGT

SEQ ID NO: 19257 - protein, 167 aa, Desulfovibrio desulfuricans
METVTERAVLAGGCFWGMQELIRKLPGVLATRTGYTGGNVPNATYRNHHGHAEAVEIIFDPAVLSYRSLLEYFFRIHDPTTADRQGNDIGSSYRSAVFHTTQQQRETALATIRDINASGVWPAEVVTQVEPVSDFWEAEPEHQDYLQRVPGGYTCHYERRGWVLPPR

SEQ ID NO: 19258 - protein, 2638 aa, Clostridium perfringens
MLVLFTFLFSFLPHMPVMAEVENNNTKANEKTLVKNESEAFAVVVGDFLKESGNGSDWDPRNMNGVLKKYKNGLYEGALKLKAGNYNYKIAMNGTWDESYGNNGQNIALNLSKDSEVIFRLDYKNKKVDDSINNPDQFKTKAILAGNIKDIIDGASDWNPGNDTEKLDYIGGGMYKKTFPIKESARGKDISLEYKVSYNGEWNNGEVAENAKVVIPKGTKNITILSNYLDNYVKDSINNPSLSNTVSLIGTVREGNGDWDVNNKNFEMHNLDENRVLYSKVMKKGTYEYKGLVNHSWDNGGIPSQGNVTLNVPEDRNVIFVADLKNNKIYDSINNTKEINNTKEINEALGIKGDENTGEDNNDGNQGESENKPDSVKSPVVNEDGTVTFSAKFNGDSLYLIGSMVSWDTSKQIEMKKGEDGVFKVTIPLTGGVYEYKFKPNKDNWDNSFTDPSNKVMANGNSVLNMPGLEIGGESSVEVGSNTKLVAYIYDTEGNKKEANVNWSLEEPVSGVSIKENTLKVSKDVDSSKKIKIKATDGKYSVSKELAILSQMYTYTINYYRFDGNYDNWNLWLWQTGGEGKGYDFNKKDEAEKGFTRAVYKFPSDKLNFLIRKGNWEDKDVGHDRTIEVKNGNNVEVWLIQGDENIYYDKKDVDTSPKLISALMDSKTDLLVTSAGNIEDSELDSFKLIDKTDNKEIKTSAIKVSDNKVKLTLKKGFFSTPEIDLSHDYEVSSNSFRATKVTMRKILDDPEYFYNGDDLGVTYKKDSSTFKLWAPTAKEVSLVLYDNEGTYDENGKVTDNTGGREISMKKENKGVWSLKVDEDLEGKYYMYKVSFSDGKTNYAIDPYAKAVSANGQRGAIIDFSSTNPSEWGSVKKPPMLNPTDSILYEMHVRDFSISKDSGINNKGKFEGIAEEGTKVPGTDVKTGIDHLKELGITTVHLLPSFDYASVNEISNKPQFNWGYDPQNYNSLEGSYSTNAEDPKSRVREFKDMVQTLHKNGIRVVMDVVYNHTYGIGQNSPFDPVVPGYFYRTNDEGKYTNGSGCGNEVATERPMVRKYIKDSVKYLAKEYDVDGFRFDLMGLIDTKTMSELTTELRNEIDPSLIIYGEPWQAGGSALPQEQQTLKGSQKGKGFAVFNDNFRNAIKGDSDGAGQGFATGASGKEGAIVAGVKGSVDDFTDSPSETINYVTAHDNLNLWDKIIKAAGKEKAAGFLEMRDGVLTGEDANKYSSVQEAVNKKAKPYSVITETNPLDNEYVRRSILTTAITITSQGIPFFQAGDEFLRSKYGDHNSYKSPDAINKINWQNKEKFSGVFDYYQGLISLRKSHPAFRMDTKAAIESNLVVTKANDNIVVFQLKNFANGDSWKNIVVAYNGNNAEKEISLPHEGDWNVVVNEHKAGTSVLESLKGVNSVKVAPLSAKVLYDESVEGEAQTPTSIDVTPSSLKLDIGASNFLKAVIKDQNGRIIPNAEIKWNVSDDSVIKVDSNNGKVTALKEGKSIITLNSGSLTKDVEVEVVHLVPSSLELNGPNQVYTGKDIQLNGIVKDQFGQVISGANIEWFSSDESIAKVSTLGVVQGISEGKVKITAKSGKAKATKEIEVKKYTKKYIEFTYVRDDKNYDGWNIWTWQTGINDGQQNFTQIKDGKAISKFEIAPDVTQVGFVLRKGTGWDEKDPYESDRYIQIDPSMNVTKVTVKSGVGEFFQVPAIKNAEIQEGNINFKYRDEALYEESNQSSIDKVQVKVTSPGILFKDTKTYDMDYDSQNEFFAYSLKDIKPGTYEYSFLVTKDGKTVETEKQTIEYSPLKINGEVTFKNNQVNYDENALVNLKLSGSDAKKENIKEVYMDLTNVGGPNKVLMDLNLLKDNSLSQSIGINDNVVAGEKEIPVTIVDKNGENHKALGNLTVKSKVGVGPLDFGFDESRIYFTVTDRFFNGDKNNDDPHGNNYDKKNPYTYHGGDLKGLTDKIPYLKELGINTIWITPIVENTDFNQMFSQGKTQYSYHGYWAKDFEKLDPHLGTMDDLKTLIDTAHDSGIKIMVDVVLNHAGYGMKNKEANSGANNYPTEKDRAKFKGMFRENPGNDFITQESAGLPDFKTEDPEVREKLIEWQTGWIERLKTEKGNTIDYFRVDTVKHVDNTTWKAFKNKLTEINPSFKTIGEYFGADINNDGGQLQNGQMDALLDFGYKGKARDFVNGNIEGASAYLDDRASKISNINLMGQFLSSHDEDGFLKTVGDDLGKQMLAASLQITDKGIPVIYYGEELGMSGWNGFEQGDQNRYDMDFERLNDPKYKKVHDHYEKLLNIRKEYSKVFSKGNRKTIAGNNEEGYSVVLRSYNGKEITPMNLSENNEEKNITNGQNLFVVLNTKNEDKDISFKTNFKEGDKVKDLYSGNEYSIGKDGNVTVKAPSREDGGTAILALKNDSISPSVINNAPEINAKDVTLTVGDKFDPMEGVTAMDKEDGDITKDIKVIENNVDTEKSGDYKVIYKVTDSEGASKTKEINVKVNEKEATSPEEIKVTGVKLNKKDLNLKKGKKYTLKAEISPKDATNKDVTWISSNPKVVSVDENGNIEAKSSGEAEITVTTKDGGFKDTCKVKVKHSGFLPNTGSVGGRIVIVIIGVIAIGIGVAMIFYKRKVIRRNRQDK

SEQ ID NO: 19259 - protein, 379 aa, Ralstonia eutropha
MAKRDYYEVLGVGKNASDDEIKKAYRKLAMKYHPDRNPDSKESEEKFKEVKEAYEMLSDAEKKAAYDQYGHAGVDPNMAGGFGGGQGYGGFAEAFGDIFGDIFGQQAGGGRRGGGGPQAYRGADLRYSMEISLEQAAHGHEAQIRVPHWDDCDHCHGNGAEPGSSVETCPTCHGAGQVRVSQGFFSMQQTCPKCHGSGKFIPKPCTKCHGQGKLKSQKTLEVKIPAGIDEGMRIRSSGNGEPGINGGPPGDLYVEVHIKAHPVFERDGDDLHCQMPISFATAALGGDLEVPTLNGKATFPVPEATQSGKTFRLRGKGIKGVRSGYPGDLYVHVNVETPVKLTEAQKDMLRQFDRSVHEGGSRHSPQEQSWLDKVKSFFS

SEQ ID NO: 19260 - protein, 156 aa, Unknown
  Frankia sp. CcI3
MPRVDYLNDPEAPAANSIVPAVSAIVPDSEGRILLIRRTDNGYWAIPGGGVEPGESVRQATAREVMEETGISCEVTGVVGIYSNPGHVAAYDNGEVRQQFSICFRTRMTGGEPRTSDESSQVRFVAISDLPSYKMHPSIRLRVDHYLEERSEPYIG

SEQ ID NO: 19261 - protein, 100 aa, Glycine max
CEKTPQRGAPAFIPNACIGVKNKDASLGRRPGRGFMRIKNKPYPKSRFCRGVPDPKIRIYDVGMNKKGVDELPFCVHLVSWEKENVSSEALEAARIACNK

SEQ ID NO: 19262 - protein, 392 aa, Oryza sativa
MSMSLADSWGSAPASPIGFEGYEKRLEITLSDAPVFVDPCGRGLRALSREQIDSFLDLAKCTIVSHLSNKHFDSYVLSESSLFVYPHKVVLKTCGTTKLLLSIPRILELAAELSLPVLSVKYSRGMFIFPGAQPSPHRSFSEEVSVLNSFFGGLKSGGNAYVIGDAFKPKKKWHVYYATEEPEQPMVTLEMCMTGLDAKKAEVFFKDSTDGSCSSAKEMTMLSGISEIIPEMEICDFEFDPCGYSMNGIYGPAVSTIHVTPEEGFSYASYEAMNFNPSSLVYDDLIKKVLACFCPSDFSVAVTIFGGHGFAKSWAKGAEVDSYMCDDLVEQELPGGGVLMYQSFTAVTPGAVSPRSTLDGWNSDGAEMVAKSKEMSVCWEGEKAAKKKDADA

SEQ ID NO: 19263 - protein, 404 aa, Unknown
  Azoarcus sp. EbN1
MIAGKSVLAFVMAGGEGSRLHPLTAERSKPSVPFNGRHRIVDFVLSNLVNSEIYSIYLLVQYKSQSLIEHTRRAWVMSPLLPHHFVTVVPPQMQHGPEWFQGTADSVYQNLHLVELVKPDLVVVFGADHVYRMDLRQMIEFHIATQADATVAALPVPLEHTSSFGIIRTDSAGRIRDFREKPESAEPMPGRPGHALASMGNYVFSADLLVDALRRAHSRGGHDFGKNLLPAMAERNRVMAYDFTTNRMRGIRDYEEPAYWRDVGTIDAYYDANFDTLGEFPKFCMSNPHWPIYANPDQTEAAQVHDGHIRTASLGAGVVIRRAVIERSLLRREVVVEEGAEVVDSIIMDRSVIGKGARVRRAIIDQYNFVPPGMKIGYDPEADRQRFHISESGVVVVGKGQLKP

SEQ ID NO: 19264 - protein, 708 aa, Alteromonadales bacterium
MQAIIKEFQLGQHTVTLETGAIARQADGAVLASIGDTSVLVTVVGKREAQPGQDFFPLTVNYQERMYAAGRIPGGFLKREGRPNDGETLIARLIDRPIRPLFPNGFVNEVQVIATVVSVNPEIQPDMVAMIGTSAALAISGIPFSGPIGAARVGYIGGEYVLNPTLKELEESQLDLVVAGTDNAVLMVESEADVLAEDVMLGAVVYGHEQSQSIINAINEFKAEAGKPTWDWTAPEKNVSLEEKVAELAADKVGEAYRITDKVARKEALGVAKDAVIEALSSELAEGETLDKQEVGKVFGSLEKKIVRGRIAAGEKRIDGREPDMIRALDVMTGVLPRTHGSAIFTRGETQALVTATLGTERDSQLIDDLTGTHKNHFMLNYNFPPFCVGETGFVGSPKRREIGHGNLAKRGIQAVMPTLTDFPYSIRVVSEITESNGSSSMASVCGTSLALMNAGVPIKASVAGIAMGLVKEDEKFVVLSDILGDEDHLGDMDFKVAGTTNGITALQMDIKIEGITQEIMQIALKQAKAARLHILEVMDEAISAPSEELSMFAPRIYTMKIPQKKIAEVIGKGGATIRQLTEETGTTIEIGDDGTIKIAATDGESAANAISRIEQLTAELEVGTIYEGKVVRIVDFGAFVNILPGKDGLVHISQISTERVNNVADHLSEGQEVKVKVLEVDRQGRVRLSIKEAMESAAPAADTSTDA

SEQ ID NO: 19265 - protein, 533 aa, Magnaporthe grisea
MAANTMAARGAQSVTESATDLIGNTPLVRLNKIPQSLGIKAQVFGKLELMNTGGSVKDRIALRMIEEAEKEGRIKPGDTLIEPTSGNTGIGLALVGAVKGYKTIITLPEKMSAEKVSVLKALGATIIRTPTQAAWDAPESHIGVAKRLLKEIPNSHILDQYSNPNNPLAHEHGTAEEIWAQTGGKITAVVAGAGTGGTISGLARGLRKHSKTVKVIAADPIGSILALPESLNDNGVNEPYKVEGIGYDFIPDVLDRELVDKWYKTEDRESFMYARRLIAEEGLLVGGSSGSAMAAMVRAVKDLNLGEDDVVVVVLPDSIRSYLSKFADDDWLAANDLLLPTPDSSVNGDTLDSPAVAEAQALHKSRARRASNPYGGATVRSLRLKPVTSVLADSKCSEAIETMRDKGFDQLPVVRDNKLVGLVTLGNMLSYVSRGRVKTNSPVSDVMFDFGRLDEVITDPRDVEGAAKMSTAHGRKKRNFVEITMNTPLDVLSKFLEWNSAAIVTEKSGEVSKPVAVVTKVDLLTWMMKELKA

SEQ ID NO: 19266 - protein, 383 aa, Nicotiana sylvestris
MKKATVGAAVVGAATVCAVAAFIVNHRMRKSSKWARAMAILREFEEKCGTPDAKLKQVADAMTVEMHAGLASEGGSKLKMLITYVDNLPTGDEAGVFYALDLGGTNFRVLRVQLGGKDGGIVHQEFAEASIPPNLMVGTSEALFDYIAAELAKFVAEEEEKFQQPPGKQRELGFTFSFPVMQTSINSGTIMRWTKGFSIDDAVGQDVVGELTKAMKRKGVDMRVSALVNDTVGTLAGGKYTHNDVAVAVILGTGTNAAYVERVQAIPKWHGPVPKSGEMVINMEWGNFRSSHLPLTQYDHALDTNSLNPGDQIFEKMTSGMYLGEILRRVLLRVAEDAGIFGDEVPPKLKSPFVLRTPDMSAMHHDISSDLRVVGDKLKDILE

SEQ ID NO: 19267 - protein, 472 aa, Triticum aestivum
MATTPPNHRPPLLPLSSSLLLLLLLLVHPFLSAGTPSITTKAVPRLPGFAGPLPFSLETGYVALDDGVRLFYYFIQSERDPAEDPVLLWLTGGPGCSALSGLVYEIGPFYFDFHGYTGGLPTLLYKPASWTKVSNVIFVDAPAGTGFSYATGDKRTIPSDTIAIQQLHVFLETWFDEHPQFLSNPLYISGDSYSGIIIPSLAMKIAKGIEVGDERLTNLKGVIAGNPLTDTTTYFNAQIAFLHRMAIIPDEIYEAAREGCGGEYRWPSNSHCAKSLQDIKECMSGLNDVHILEKICPEYPSLTLHKQPALQDHGRRRLTESAVSSVCRNATYFLSELWTNDEAVRESLGIHKETVPSWLRCDFNLPYTYEINSTVDDHLALITKGYRAMIYSGDHDSKISYVDTQAWIRRLNLPITHRWRPWHLDDQIVGYTRTYSNNLTYATVKGAGHTAPEYMPRECLAMIDRWLSGEPL

SEQ ID NO: 19268 - protein, 767 aa, Unknown
  Azoarcus sp. EbN1
MMGGLMHGFLASMKEGLPYPLGATWDGEGVNFALFSAHATRVELCLFDDSGRIEVTRVDLPEFTDEIWHGYLPGAGPGLVYGYRVHGPYVPEQGHRFNPHKLLLDPYAREVVGRLRWGSALFAYELRGKKPGHGFDKRDSAPFMLKARVVAPAPELPLPGRPRVPWERTVFYEAHVRGLTRLHPAVLARLRGSFAGLGSPVIIEHLKSLGVTSVELLPIHLFVDDTHLTEKGLRNYWGYNSLGFFTPDPRYLAGRAVVEFRDMVARLHDADLEVILDVVYNHTAEGNELGPTFSFKGLDNVSYYRLNPDEPCYYINDTGTGNTLDVNHPRVLQMVLDSLRYWVLQMGVDGFRFDLATILGREAHGFDPGSGFFDACRQDPVLNRIKLIGEPWDCGPGGYQLGAFPPGWGEWNDSFRDAVRSFWKGDEGRAPELATRLSASADRFNRRGRRPWASINFITAHDGFTLHDLVSYNDKHNEANGEDNNDGHDDNRSWNCGAEGPTDDPDIIELRERQKRNLLATLLFAHGTPMLLAGDEFGRTQRGNNNAYCQDNDISWANWEEIDARGERLLAFARHLLVLRDALPVLRPGRFSTGEMHPVHEVRDVAWLTPAGAELEEKEWADPQMRCFGMLADGRAQHTVVPHPGSDVIVLLVVNAGHEAVEWTLPHVRGAGHWTRLVNTESPDDPAFPAFVAGHRVPLGARSLLLFAAAADKPSAIFIDGLLVGLTARGTRSRLQVDETDGDGAGDGQGGGQGGGQGQGGGDAQPD

SEQ ID NO: 19269 - protein, 320 aa, Lactobacillus acidophilus
MKRIGILTSGGDAPGMNAAIRAVTKTAIHHGLEVFGIRYGFAGLVAGDFIPLTTENVDHKISEGGTFLYSARFPEFAQEEVQQKGVEQLKKHGIDAVIVIGGDGSYHGALALTRHGVNSVGLPGTIDNDIPYTDYTIGFDSACRTAMDAIDKIRDTASSHHRVFVVNVMGRECGDIAMRVGVASGADAIVIPERPYDVKEIAETIKRGFADGKDHGIIVLAEGVMDAEEFKDELLKYGDFDARANVLAHMQRGGSPTVEDRVNATKMGNYAVNLLLDGKGGLAVGMENGKLNTHDILDLFDSKHQGDFSLLDVNEEMTKD

SEQ ID NO: 19270 - protein, 352 aa, Oryza sativa
MAQQQMDEFWRDRQKEIEMTNDFSEHMIPMARLKKIVSSQKGNMMMTFDMPAFLSKMCELFVQELAVRAWACAQSHNRCIILDTDIAEAVASTESYDFLVDILHNHSVKQKSTPCSSTKRCSKGSGLTRKQYQCTFANNNIPDNIVGCSSPTVLASMMSPALLEVAGTSLNPPNSHSICTMNMINSSDPSGSSIGDINVANQASLAPSGRFNPAILRESSCPSFLHSNNDTIVAIPEGVDISGTMDVASDVAAIVINGQEEHERETNVEHHQQNEIYESIDIGIINASVADDNKYSISWDELGMADDSLLDKFLEEFQVRKNDVSDTRIAFNKDPFLDDVVLSNPSTSNGNK

SEQ ID NO: 19271 - protein, 607 aa, Bacillus cereus
MCGITGWVNWNKDLSNEHVILEKMAHSIQHRGPDAEGFWFSPRAAFAHRRLIVIDPEGGAQPKTFRAGDYTYALTYNGEIYNFRELREQLRKCGHTFETHSDTEVLLHAYLEWKEDCVQHLNGIFAFALWDDQKQQLFLARDHLGVKPLFYTERNDSIIFGSEIKALLAHPSVPTEIDADGINEIFGLGLFRTPGCGVFKHIEEVRAGHSITFTRDKKVVTKYWNLESKAHTDSTEDTASHILSILQDTVKRQLIADVPLVCMLSGGLDSSGITALAGKEFAAENKTLHTYSIDFVNSAKDFELTFARTGLDAPWVKRVSEHVGTSHHDIIVNAEELANHLFVPLRAKDLPSAGEMETSLYLLFCEMKKDATVALSGESADEVFGGYPWFHQEELLYVDKFPWLTNWKNTSPLLLHEVSNQCNLEEYIDTRFQEAILEVPTLKGESKKSAKQRQMFYLFLTRFLPFLLDRKDRMSMAVGFEVRVPLCDYRLVEYLWNVPFNIKSIDNIEKGILRRALKPALPDDVRNRRKSAYPTSQDPHYLQTIRHLSLDMCSNKNNPIFSLINHSTLLAIADQSNKDINNFEARSAMEYMLQVNEWLKTYHIHIA

SEQ ID NO: 19272 - protein, 142 aa, Bacillus clausii
MSIEAGSKLQGKVTGITHFGAFVELPGGSTGLVHISEVADHYVKDINELLKVGDEVTVKVVNVEKDGKIGLSIRKAVDRPEGESRPPRPHPRSGNNRGGGKSRPAPSFEDKMSRFLKDSEERLSTIKRQTESKRGGRGAKRG

SEQ ID NO: 19273 - protein, 254 aa, Cytophaga hutchinsonii
MAKKIEYKDLLDAGVHFGHLTRKWNPKMAPYIFMEKNGIHLIDLNKTLVCLDEANAALKTIVRSGRKVLFVATKKQAQEVVTAEAKRLKMPYATERWLGGMLTNFATVRKSLKKMSSMEKMMKDEAFSSLNKKERLVLSREKEKLEKVLGGIADLTRLPAAIFVVDVKKEHIAIAEAKKLGIPVFAIVDTNSDPTIVDFPIPANDDAFKSISILTQAIGQGIEDALSERKREKDDAKLKEDEESKKASDKAEIQ

SEQ ID NO: 19274 - protein, 103 aa, Candida glabrata
MSGRGKGGKGLGKGGAKRHRKILRDNIQGITKPAIRRLARRGGVKRISGLIYEEVRAVLKSFLESVIRDAVTYTEHAKRKTVTSLDVVYALKRQGRTLYGFGG

SEQ ID NO: 19275 - protein, 153 aa, Lilium longiflorum
MQIFVKTLTGKTITLEVESSDTIDNVKAKIQDREGIPPDQQRLIFAGKQLEDGRTLADYNIHKESTLHLVLRLRGGMQIFVKTLTGKTITLEVESSDTIDNVKAKIHDKEGIPPTTRLIFAGTAEDGRTLADYNIQKESTLHLVLRLRGGATC

SEQ ID NO: 19276 - protein, 720 aa, Petunia integrifolia
MMTEVHDAGRPRVVIFNGSQLQREAIIPFASRSSCFHHQLCSRGHLLIIFLLLVSPFNDAAVDVDGDDNDNLIIDHVPDAKSSSEALLNFKSSLSTSSPRGHEVLGSWIPSNSPCSGNNGNWLGVLCYEGDVWGLQLENLDLSGVIDIDSLLPLHFLRTLSFMNNSFKGQCLIGISLEPSSHCTCPIIASPVRSRMMLPGYDLSQEALFGKQPIQRQHPHLPGYLLPQVFELSLENNRFTGSIPHFPPNVLKVLNLSNNQLEGPIPPALSLMDPTTFSGNKGLCGKPLESACNSPSQEANNPDSRNSSTISGQSSTDVIRKSPTRLSKVMLIVAVCLVVLCLLIVLILIIRRRSHSSSQNPQPVESNYSNNDRDQNAFTSSAPDDHVTLSGNSTYSNNQHSNSNKAEAPTAAVVGKLSFVRDDRPRFDLQDLLRASAEVLGSGNLGSSYKALLMDGQAVVVKRFKQMNHVAKEDFHEHMRRLGRLTHPNLLPLVAYYYRKEEKLLVYDYASNGSLASHLHGNQSRLDWSSRLKIVKGVAKALAYLHNELPSLALPHGHLKSSNVLLDKYLNPVLMDYTLVPLVNLAQVQHLLVAYKAPEYAQQGRITRKTDVWSLGILILETLTGKFPTNYLALSTGYGTELATWVDTIIRDNESAFDKEMNTTKDSQGQIRKLFDIGVACCQEDLDTRWDLKEVVQSIQSLNDKDHGHSNSDQMHDAGV

SEQ ID NO: 19277 - protein, 576 aa, Rhodobacter capsulatus
MDGKDKATGKCPVMHGAMTAAGVSNTSWWPNALNLDILHQHDTKGNPLNGFDYRAAVKGLDVGLRADLHALMTDSQPWWPADWGHYGGLMIRMAWHAAGSYRAADGRGGGNTGKPARFAPLNSWPDNVSLDKARRLLWPIKKKYGNAVSWADLILFAGTVAYESMGLKTFGFGFGREDIWAPEKDVYWGAEKDWLAPSDGRYGDLAKPETMENPLAAVQMGLIYVNPEGVNGQPDPARTALHIRETFARMGMNDEETVALTAGGHTVGKAHGNGDAKALGPDPEAADVTVRALAGRTRIWAARRRRPSPRGSRAPGPRIRRAGTWAISRCSSGHDWELTKSPAGAWQWKPVTIAEEAKPLDATDLTTRHDPLMTDADMAMKVDPSTMRSVRSSWPIRPPSTTLSRAPGSSCCIATWGRRRATSAPMCPPRIWSAGPGAAGPTGWDVAKVKAQIAASGLSVADLVATAWDSARTFRQSDYRGGANGARIRLAPQKDWAGNEPERLAGACGARTDRGGAGASVADVIVLAGNLGVEQAAAGVSRWRCPSPPVAAMRAAMTDGPSLTCWSRCMTASATG

SEQ ID NO: 19278 - protein, 327 aa, Hyphomonas neptunium
MAGTVKLEGGVTLDGPRGRIYGSILETVGATPLVRAEKFAKAEGVDADILFKLEFFNPLASVKDRIGLAMILGLEAEGKLKPGGVLIEPTSGNTGIGLAFVAAAKGYRLILTMPESMSVERRKMLAYLGAELVLTPKEKGMGGAIARANELLAEIPGAVSPSQFDNPANPAIHEKTTAEEIWSDTAGAVDAIVSGIGTGGTFTGVGRVLKPRKPSLKMFAIEPEASPVLSGGAPGPHMIQGIGAGFVPGNADTSLIDEIVKVSNEESFAMARKLAKTEGIPGGISSGAAAAAAVRIGKRPEMAGKTIVVILASFAERYLSTALFDGV

SEQ ID NO: 19279 - protein, 776 aa, Unknown
  Frankia sp. CcI3
MKRPRPANTVRPVGFGRMSQVWPGSPYPLGATYDGSGTNFAIFSEVADRVQLCLFDDAGNEERIDLRERDAFVWHAYLPTVGPGQRYGYRVHGSYDPARGLRCNSTKLLLDPYAKAVDGEVAWDQAVFPYTFGDPDSVNDADSGPHMMKSVVISPFFDWNGDRPPRRPYNESVIYEAHVRGLTKNHPGLPEEYRGTYAGVAHPVMIDHYRKLGVTAIELLPVHQFVHDEHLVSRGLRNYWGYNSIAFLAPHSGYSASGGHGRQVQEFKGMVKNLHEAGIEVILDVVYNHTAEGNHMGPMLCFRGIDNSAYYRLVDNRPQYYMDYTGTGNSLRVRHPHVLQLIMDSLRYWVTDMHVDGFRFDLAATLAREFYDVDRLSSFFDLVQQDPVVSQVKLIAEPWDLGEGGYQVGNFPPLWTEWNGKYRDTVRGFWRGQDHGIAEFASRLTGSSDLYENSGRRPWASINFITAHDGFTLHDLVSYNEKHNEANGEDNRDGSDDNRSWNCGVEGPTDDPTVLSLRAAQTRNLLTTLLLSQGVPMLVAGDEMGRTQQGNNNAYCQDNPISWLDWSDAERNADLIEFTGMLSRLRHDHPIFRRRRFFQGKSLRGQGGTTHGAAEAVTGGQAGGQDADGSGGRSGDDPAVKDDPAVKDIAWLRPDGTEMSDSDWESGTARSLGVYLNGEGIPDPDALGQAIIDDSFLLFFNAHHEPVGFQAPATSFGSSWEIVVDTRASTAEVDARLSDTALLHSALDPASMGRAVKAGDPIELDARSTVVLRRVS

SEQ ID NO: 19280 - protein, 500 aa, Saccharomyces cerevisiae
MSFDDLHKATERAVIQAVDQICDDFEVTPEKLDELTAYFIEQMEKGLAPPKEGHTLASDKGLPMIPAFVTGSPNGTERGVLLAADLGGTNFRICSVNLHGDHTFSMEQMKSKIPDDLLDDENVTSDDLFGFLARRTLAFMKKYHPDELAKGKDAKPMKLGFTFSYPVDQTSLNSGTLIRWTKGFRIADTVGKDVVQLYQEQLSAQGMPMIKVVALTNDTVGTYLSHCYTSDNTDSMTSGEISEPVIGCIFGTGTNGCYMEEINKITKLPQELRDKLIKEGKTHMIINVEWGSFDNELKHLPTTKYDVVIDQKLSTNPGFHLFEKRVSGMFLGEVLRNILVDLHSQGLLLQQYRSKEQLPRHLTTPFQLSSEVLSHIEIDDSTGLRETELSLLQSLRLPTTPTERVQIQKLVRAISRRSAYLAAVPLAAILIKTNALNKRYHGEVEIGCDGSVVEYYPGFRSMLRHALALSPLGAEGERKVHLKIAKDGSGVGAALCALVA

SEQ ID NO: 19281 - protein, 546 aa, Staphylococcus aureus
MKQRIGAYLIDAIHRAGVDKIFGVPGDFNLAFLDDIISNPNVDWVGNTNELNASYAADGYARLNGLAALVTTFGVGELSAVNGIAGSYAERIPVIAITGAPTRAVEQAGKYVHHSLGEGTFDDYRKMFAHITVAQGYITPENAATEIPRLINTAIAERRPVHLHLPIDVAISEIEIPTPFEVTAAKDTDASTYIELLVSKLHQSKQPIIITGHEINSFHLHQELEDFVNQTQIPVAQLSLGKGAFNEENPYYMGIYDGKIAEDKIRDYVDNSDLILNIGAKLTDSATAGFSYQFNIDDVVMLNHHNIKIDDVTNDEISLSSLLQQLTDISYTNNASFPAYHRPTSPDYTVGTEPLTQQTYFKMMQNFLKPNDVIIADQGTSFFGDYDLALYKSNTFIGQPLWGSIGYTLPATLGSQLADKDRRNLLLIGDGSLQLTVQAISTMIRQHIKPVLFVINNDGYTVERLIHGMYEPYNEIHMWDYKALPAVFGGKNVEIHDVESSKDLQEVFNTINGHPDVMHFVEVKMSVEDAPKKLIDIAKAFSQQNK

SEQ ID NO: 19282 - protein, 179 aa, Bacillus clausii
MKNDMKEILLTEEQIQQKIKELGQAITKEYEGRFPLVVGVLKGALPFMADLIKAVDTHLEIDFMDVSSYGKSTVSSGEVKIVKDLDTKVEGRDVLIVEDIIDSGLTLSYLIELFKYRKAKSVKVVTLLDKPEGRKVDLVPDMTGFVVPDEFVVGYGLDFAERYRNLPYVGILKPEVYEG

SEQ ID NO: 19283 - protein, 95 aa, Triticum aestivum
  misc_feature (36)..(36): Xaa can be any naturally occurring amino acid
  misc_feature (48)..(48): Xaa can be any naturally occurring amino acid
  misc_feature (50)..(51): Xaa can be any naturally occurring amino acid
  misc_feature (57)..(57): Xaa can be any naturally occurring amino acid
  misc_feature (64)..(64): Xaa can be any naturally occurring amino acid
  misc_feature (69)..(72): Xaa can be any naturally occurring amino acid
  misc_feature (74)..(74): Xaa can be any naturally occurring amino acid
  misc_feature (76)..(76): Xaa can be any naturally occurring amino acid
  misc_feature (78)..(78): Xaa can be any naturally occurring amino acid
  misc_feature (80)..(82): Xaa can be any naturally occurring amino acid
  misc_feature (85)..(86): Xaa can be any naturally occurring amino acid
  misc_feature (89)..(89): Xaa can be any naturally occurring amino acid
MEVKLWNDKRERELLESLADLYAIIKATEKLERAYXFDLVSAADYEAXCXXLISQGXSLSSSLXGIVTXXXXTXKXYXAXXXPVXXNRXFSPVSR

SEQ ID NO: 19284 - protein, 204 aa, Viburnum japonicum
YDKPVKGRKINWMKAGILESDQILTVSPYYAKELVSGEDKGVELDNILRKTGILGIVNGMDIQEWNPLTDKYTGIKYDATTVMNAKPLIKEALQAEVGLPVDKDIPVIGFIGRLEEQKGSDILVEAISQFIGENVQIIVLGTGKKAMEKQLEQLEIEYPDKARGVAKFNVPLAHMIIAGADFILVPSRFEPCGLIQLHAMRYGT

SEQ ID NO: 19285 - protein, 204 aa, Viburnum kansuense
YDKPVKGRKINWMKVGILESDQILTVSPYYAKELVSGEDKGVELDNILRKTGILGIVNGMDVQEWNPFTDKYTGIKYDATTVMNAKPLIKEALQAEVGLPVDKDIPVIGFIGRLEEQKGSDILVEAISQFIGENVQIIVLGTGKKAMEKQLEKLEIEYPDKARGVAKFNVPLAHMIIAGADFILVPSRFEPCGLIQLHAMRYGT

SEQ ID NO: 19286 - protein, 894 aa, Cordyceps bassiana
MAVKSQLGVTYTTKTFPPSPPRTVGNSHAGSDDERDEVDATPTTPPVEKLGQLLKPYSLPPTNTPTHVLPEDLKTPDHRVNRDPRLIRLTGVHPFNVEPPLTDLYDEGFLNSENLHYVRNHGPVPHCPDDESLNWTFTVDGLVEKPFTIAVRDLIQKYDQFTYPVTLVCAGNRRKEQNVVRKSKGFSWGAAGLSTALWTGVPIGALLRMAKPKRAAKYVCFEGADKLPNGYYGTSVKLNWCMDENRGIMVAHKMNGQSLHPDHGKPVRIIIPGQIGGRSVKWLKKITITSEPSDNWYHIYDNRVLPTTISPDASANLPDVWKDEKYAIYDLNANSAICYPRHDERLVLATAPDTYKVRGYAYGGGGKRITRLEVTLNKGKSWLLAGIHYPEDDYRRAPDGDLLYGGSTDMWWRETCFCWCFWEIDIPVADLSAADDIMIRAMDEGMMVQPRDMYWSVLGMMNNPWFRVVIHKEDGALRFEHPTQPALMPGGWMERVKRRGGNLTNGFWGEKTAAEEEQVLAEPEKEICMTNPKVVRIISLEELKAHEGEMEPWFVVNGHVYNGTPYLDNHPGGATSIINAAAQDATEEFMTIHSENAKAMMPQYHIGTLNDAARKALEGSAEESPASDPTRAVFLQPKYWSKAILETKTDVSSDSKIFSFRLDHAAQSIGLPTGQHLLVRLRDPATREAVIRAYTPLSETHAKGQLDILIKIYRDVPGQPGGKMTQALDSIPLGHFVDIKGPVGKFEYLGKGHCTVSGTSRHVRRFVMICAGSGVTPIFQVLRAVTSDAQDGTECLVLDGNRCEKDILCREELDAMVARAPARTTLLHKLSRPDASWCGLRGRMDKEYLEEHIGGFRKSDGREMVLVCGPAALEETVRSVLVEMAWKPEDMLFF

SEQ ID NO: 19287 - protein, 204 aa, Viburnum lantana
YDKPVKGRKINWMKAGILESDQILTVSPYYAEELVSGEDKGVELDNILRKTGILGIVNGMDVQEWNPLTDKYTGIKYDATTVMNAKPLIKEALQAEVGLPVDKDIPVIGFIGRLEEQKGSDILVEAISQFIGENVQIIVLGTGKKAMEKQLEQLEREYPDKARGVAKFNVPLAHMIIAGADFILVPSRFEPCGLIQLHAMRYGT

SEQ ID NO: 19288 - protein, 414 aa, Campylobacter upsaliensis
MSLEQFDKEIYDLTTAELKRQCDGLEMIASENFTLPEVMEVMGSVLTNKYAEGYPGKRYYGGCEIVDEIETLAIQRCKKLFNCAFANVQPNSGSQANQGVYAALLNAGDRILGMDLSHGGHLTHGAKVSSSGKMYESFFYGVELDGRINYEKVREIAHIVKPKLIVCGASAYARIIDFAKFREIADEVGAYLFADIAHIAGLIVAGEHPSPFPHAHIVSSTTHKTLRGPRGGIIMCNDEEIAKKINSAIFPGIQGGPLMHIIAAKAVGFKFNLSPEWKNYAKQVVQNAKVLATILMERKFKLVSDGTDNHLVLMSFLDKEFSGKDADLALGNAGITANKNTVPGETRSPFVTSGLRLGTPALTARGFKEKEIEIVAHSIADILDDINNTNLQINTKEKLKKLASDFIIYPKAMF

SEQ ID NO: 19289 - protein, 920 aa, Cichorium intybus
MAASVENRQFRHEPGLSAAGVVRSFSPNHRRSDSPIRNCNYPAAAREFMTPKKLPPETYDTSDDEEDEADYRDAIKKSNSELESSVFDPRDQGTADQWIERNPSMVRLTGKHPFNSEPPLNKLMQHGFITPDPLHYVRNHGPVPNATWEDWTVEICGLVKRPARFSMTQLVNEFPSREFPVTLVCAGNRRKEQNLTKQTIGFNWGAAGISTSVWKGVPLVHILKRCGIYSRKKGALNVCFEGAEDLPGGGGSKYGTSIKIEMAMDPARDIILAYMQNGEKLSPDHGFPVRMIIPGFIGGRMVKWLKRIIVTTPESESYYHFKDNRVLPSHVDAELANSEGWWYKPEYIINELNINSVITTPCHEEILPINSWTTQRPYTLRGYAYSGGGKKVTRVEVTMDGGETWNVCTLDHKEKPTRYAKYWCWCFWSLEVEVLDLLSAKEIAVRAWDETLNTQPDKLIWNLMGMMNNCWFRVKTNMCKPHKGEIGIVFEHPTQPGNQSGGWMAREKHLEISSELAHPTLKKSVSSPFMNTTSLTFTMSEVKKHNSADSAWIVVHGHIYDCTSFLKDHPGGSDSILLNAGTDCTEEFDAIHSDKAKKLLEEYRVGELITMGYSSDSAASSPNNSVHGATNYLTLHLSLATIKEIAPTRSVALIPKEIAPTRREKIPCKLISKTSVSHDVRLFRFALPSPDQVLGLPVGKHVFVCATIDDKLCMRAYTPTSTIDEVGYFELLVKIYFKGVEPKFPNGGLMSQHLESMELGSSIEIKGPLGHIEYMGRGTFSVHGKQKFARKLAMFAGGTGITPDLSSDASYLKDPEDDTEMYVVYANRTEDDILLREELDAWADKYSDRVKVWYVVAKSIREGWKYSEGFITEDIMREHVPEVSEDTLALACGPPPMIQFAINPNLEKMGYDIKNSLLVF

SEQ ID NO: 19290 - protein, 660 aa, Arabidopsis thaliana
MQRSCRTRRRVSVNKFNGRNSFYKVSLSLVFLLWVLLFFSTLLISHGDGAKDEPLDDSMGMADPDDGQSDEKVVPFDGPLSLASASVDVTSDLSRNDDVNLSEESEDKEQEAEISSTVSGNDIESKDTYLLKQSEINKKDTGIDAGSKYDDFPKKSEINNTGTWNDTEGKDDNNFLKQSQLNKTGTGNDTESSDNEFLEQNQMNKTVLGNGTEINVSKVDQPSRAVPLGLDEFKSRASNSRNKSLSDQVSGVIHRMEPGGKEYNYASASKGAKVLSSNKEAKGAASILSRDNDKYLRNPCSTEGKFVVVELSEETLVNTIKIANFEHYSSNLKEFELQGTLVYPTDTWVHMGNFTASNVKHEQNFTLLEPKWVRYLKLNFISHYGSEFYCTLSLIEVYGVDAVERMLEDLISVQDNKNAYKPREGDSEHKEKPMQQIESLEGDDGADKSTHREKEKEAPPENMLAKTEASMAKSSNKLSEPVEEMRHHQPGSRMPGDTVLKILMQKLRSLDLNLSILERYLEELNLRYGNIFKEMDREAGVREKAIVALRLDLEGMKERQEGMVSEAEEMKEWRKRVEAEMEKAEKEKENIRQSLEQVSKRLEWMEKKCLTVFTVCLGFGIIAVIAVVIGMGTGLAEKTGSGAWLLLLISSTFIMFVLSL

SEQ ID NO: 19291 - protein, 372 aa, Photorhabdus luminescens
MAKRDYYEVLGVSKTASEKEIKKAYKRLAMKYHPDRNQGDKEAESQFKEVKEAYEILTDDQKRAAYDQYGHAAFEQGGMGGGGADFSDIFGDVFGDIFGGGRRQQRPSRGADLRYSMELTLEEAVRGVTKEIRIPTLETCDICHGSGAKAGTSPVTCSTCQGAGQVHMRQGFFTVQQPCPHCHGRGQIIKDSCHKCHGHGRVERYKTLSVKIPAGVDTGDRVRLSGEGEAGAKGAPAGDLYVQVQVKSHHIFERQESNLYCEVPVNFAMAALGGEIEVPTLDGRVKLKIPAETQTGKMFRMKGKGVKSVRGGVQGDLLCRVVVETPVKLNERQKELLRELGESFGGAGEETNSPRSKSFFDGVKKFFDDLTK

SEQ ID NO: 19292 - protein, 133 aa, Glycine max
MIFKCTLQQLISTSVFNTLHNSYNQIRSKSHYTYMGIRLPIFMALHANKIFKWQQHLHSRNHSNVPKGHIVVYVGEAQKKRFVVPISYLNHPSFVDLLNRVVEEFGYNHPMGGLTIPCKEEAFITLTSQLRAS

SEQ ID NO: 19293 - protein, 127 aa, Glycine max
  misc_feature (105)..(105): Xaa can be any naturally occurring amino acid
SLRAAGEGGRGGYNTGIGAAASATKGRSKLPSLQQKASEWRGATIDDAFGIDDTNVFQKLGLQTFINLCTNIYNRGYDDEEEWLRPIFANSEKENAIQNQYEGFXVQRMGGPPLSSQRRGNIFLLTR

SEQ ID NO: 19294 - protein, 195 aa, Dechloromonas aromatica
MRQAEITRNTLETQITVRLNLDGTGQGKYATGVPFLDHMLDQIARHGLIDLDIEAKGDLHIDAHHTVEDIGITFGQALAKAWGDKKGLTRYGHSYVPLDEALSRVVIDLSGRPGLELHVEFTRAVIGTFDVDLVGEFFHGLVNHAGMTLHIDNLRGKNAHHQAETIFKAFGRALRMAVTPDPRMAGTMPSTKGSL

SEQ ID NO: 19295 - protein, 596 aa, Arabidopsis thaliana
MATGENRTVPDNLKKQLAVSVRNIQWSYGIFWSVSASQPGVLEWGDGYYNGDIKTRKTIQAAEVKIDQLGLERSEQLRELYESLSLAESSASGSSQVTRRASAAALSPEDLTDTEWYYLVCMSFVFNIGEGIPGGALSNGEPIWLCNAETADSKVFTRSLLAKSASLQTVVCFPFLGGVLEIGTTEHIKEDMNVIQSVKTLFLEAPPYTTISTRSDYQEIFDPLSDDKYTPVFITEAFPTTSTSGFEQEPEDHDSFINDGGASQVQSWQFVGEEISNCIHQSLNSSDCVSQTFVGTTGRLACDPRKSRIQRLGQIQEQSNHVNMDDDVHYQGVISTIFKTTHQLILGPQFQNFDKRSSFTRWKRSSSVKTLGEKSQKMIKKILFEVPLMNKKEELLPDTPEETGNHALSEKKRREKLNERFMTLRSIIPSISKIDKVSILDDTIEYLQDLQKRVQELESCRESADTETRITMMKRKKPDDEEERASANCMNSKRKGSDVNVGEDEPADIGYAGLTDNLRISSLGNEVVIELRCAWREGILLEIMDVISDLNLDSHSVQSSTGDGLLCLTVNCKHKGTKIATTGMIQEALQRVAWIC

SEQ ID NO: 19296 - protein, 411 aa, Lactobacillus acidophilus
MKYAEKSPALWDAIRQEEKRQQNTIELIASENIVSDAVREAQGSVLTNKYAEGYPGRRYYGGCQYIDQVEQLAIDYAKKLFNAKFANVQPHSGSQANMAVYQALLKPGDVILGMGMDAGGHLTHGAKVNFSGKEYKSYEYGLNVETEELDFDQIRKVALEVKPKLIVAGASAYSRIIDWQKFRDIADEVGAYLMVDMAHIAGLVATDQHPSPIPVADIVTTTTHKTLRGPRGGMILSNNLEIGKKINSALFPGIQGGPLEHVIAGKAQAFYEDLQPQFTDYIKQVVKNAKAMAEVFDESENIRVVSGGTDNHLMIIDITDTGLTGKDAQNLLDFVNITTNKESIPGDKRSPFITSGLRIGTPAITSRGFNEEDARKTASLIIEILSDPDNEATIEHVKKEVHELTKKHPVE

SEQ ID NO: 19297 - protein, 452 aa, Mycoplasma mycoides
MEIRQIFEQHSGLLDKEVEILGRVRSNRQGKFVSFMILNDGTTFTDLQVVYKTKGYEQALQARVSSIVKVVGRVVLTPEKQQKFEVQADEIELIDQAIEDYPLQKKEHTTEYLREIAHLRAKTKTFNAIFKIRSAAAYAIHRFFNEKNFVYIHSPIITSNDAEGAGEAFLVTTREDADYEKDFFGKKASLTVSGQLHAEAFAQAFKKVYTFGPTFRAENSNTAKHAAEFWMIEPEVAFADLKDNIQLIQDMVKYIINYIFKHNRRELEFCNEQLENGLIDKLNNVRNSEFKVTTYTEAIEILKQAVKDGHKFEVSDIEFGLDLGTEHERYICEQVNKAPTFVTNYPKEIKAFYMKQNDDNKTVAAVDLLVPGIGELVGGSQREDNYEKLIKRCKEVNIDIDQLEWYNNLRLYGYYKSAGFGLGFERLVMYITGASNIRDVIPFPRTPKNLLF

SEQ ID NO: 19298 - protein, 412 aa, Enterococcus faecalis
MDYKTYDPDLWNAIAREEERQENNLELIASENVVSKAVMAAQGSILTNKYAEGYPGKRYYGGCEFIDIVENLAIDRAKELFGAKFANVQAHSGSQANTAAYLSLVEPGDTILGMDLSAGGHLTHGSPVNFSGKTYNFVSYGVDPSTEVIDYDVVRILAREHRPKLIVAGASAYSRTIDFKRFREIADEVDAKLMVDMAHIAGLVASGLHPNPVPYADIVTSTTHKTLRGPRGGLILTNSEELAKKVNSSIFPGIQGGPLEHVIAGKAAAFKEALDPSFAEYSQQVIANAQAMTKVFNQAPEARLISGATDNHLLLIEVTGFGLNGKEAEAILDSVNITVNKNSIPFEQLSPFKTSGIRIGTPAITSRGFKEEDAVEVAKLIVQVLKDPENTAVHDEVKAAVAALTKKYPLYN

SEQ ID NO: 19299 - protein, 309 aa, Mycoplasma mycoides
MNKVIYLAGGCFWGVEAYFSKLKGVIDAENGYANGISEKTKYYSLAKTLHAETVKVTYDPNQISLEELLVHYFRIIHPDSLNKQGNDVGTQYRTGVYYTDINDKKVIELVFLEYKKQYDEFYVELEELKNYMTAEDYHQDYLDKNPTGYCHVNLNVDFNLTDKEQELIKLIRKELSLDELSLNVLKYSATEKPHTSEFNDEHRKGIYVEKITKEVLFASNTKFNAGCGWPSFANPINSKAVEYKADYSHNMHRVEVRSKTGDNHLGHVFNDGPKEMGGLRYCINGAALEFIPYEEMDEKGYSEYKKFLD

SEQ ID NO: 19300 - protein, 498 aa, Citrus sinensis
MGKVTVAATVVCAAAVCAAAALVVRRRMKSTGRWARAVAILKEMEEKCGTPIGKLRQVADAMTVEMHAGLASEGGSKLKMLISYVDNLPTGDEKGLFYALDLGGTNFRVLRVQLGGREGRVVKQEFEEVSIPPHLMTGSSHELFDYIAAALAKFVATEGEGFHVSPGRQRELGFTFSFPVRQTSIASGDLIKWTKGFSIEDTVGEDVVGELTKAMERIGLDMRVAALVNDTIGTLAGGRYHNKDAIAAVILGTGTNAAYVERAHAIPKWHGLLPKSGEMVINMEWGNFRSSHLPLTEYDEALDTESLNPGEQIFEKIISGMYLGEIVRRVLCRMAEEANFFGDTVPPKLKIPFILRTPHMSAMHHDTSPDLRVVGKKLKDILEISNTSLKMRKLVVELCDIVATRGARLSAAGIVGILKKLGRDTVRDGEKQKSVIALDGGLFEHYTKFSACMQSTVKELLGEEVSETVVIEHSNDGSGIGAALLAASHSQYLEVEES

SEQ ID NO: 19301 - protein, 141 aa, Zea mays
  misc_feature (52)..(52): Xaa can be any naturally occurring amino acid
MALAEADDGAVVFGEEQEALVLKSWAVMKKDAANLGLRFFLKVFEIAPSAKXMFSFLRDSDVPLEKNPKLKTHAMSVFVMTCEAAAQLRKAGKVTVTGFALLETIKEALPADMWSLEMKKAWAEAYSQLVAAIKREMKPDA

SEQ ID NO: 19302 - protein, 495 aa, Lactobacillus acidophilus
MKFSELGLNEALLKAIKRSGFEEATPIQEQTIPLALEGKDVIGQAQTGTGKTAAFGLPILQIIDKKEKAIQAIIIEPTRELAIQTQEELFRLGRDERAHVQVVYGGADIGRQIRSLKHHVPSILVGTPGRLLDHLKRGTIDLDKVKTVVLDEADEMLDMGFIQDIESILKYAKNRNQTLLFSATMPKPILRIGEKFMNNPEIVQIKAKELTADLIDQYFVRAKESEKFDIMCRLIDVQGPDLAVVFGRTKRRVDELTRGLQARGYNAAGIHGDLSQARRMAVLKRFREGKLDILVATDVAARGLDISGVTHVYNYDIPQDPDSYVHRIGRTGRAGQNGISVTFVTPNEIGYMRTIEQLTKKKMSPLRPPTDDQALRGQLKQAKAQIEDLINSDLGKYTQDASELLDNYSAVDLVAAFLKNLSKDSTDIKVKITPEKPLPYKGDGRRNRRGHGRGRNNNRNHGNYRRRNNNYRHNGNRGKRGRGNGHEFVIKSKEK

SEQ ID NO: 19303 - protein, 477 aa, Unknown
  Rhodococcus sp. RHA1
MTVDSSHEQLNEDGLAQGLNKRHIRMIAIGGAIGVGLFLGSGKGISYAGPALVGVYAITGVFIFIIMRALGELLMYRPVTGSFAEYAREFLGPVYGFITGWGYWITWTIIGMAELTAAGIFVRFWFPSMPQYLTALIALIALVTLNLAKVGFFGEAEFWFASIKVITIVALIAGGIFALVFNVGKAGQEGGIANLWDHGGIAPHGLLAVLLAFQIVVFSYQGVELIGMTAAETKNRATVLPKAINSIPWRIGIFYVGTLVVLLSLFPWDQFNADSSPFVKGFTQIGLPAAASIMNFVVLASALSSCSAGLFSNGRLLKKLAADGVAPKMFEKTNRGHVPAAAIIASGSLMLVSVAINAIVPEQAFSYISSVATLGAIWSWGVIVACHLVYRRRVERGEVPASTFRLPLATPLCWATLAFLAAVTVLLAFDEGQRIALYALPIWAAVLLTGYYLSARRTASPVAPSPATENDRPALHP

SEQ ID NO: 19304 - protein, 722 aa, Myxococcus xanthus
MLKKSVKIGESELSIEVGRLAKQADGSVVVRYGDTMLLVTAVSAREKKDIDFLPLTVEYQEKLYSAGRIPGSYFKREGRLTEKETLASRLVDRSCRPLFPEGYAYETQIIASVISSDPENEGDIHGITGASAALWVSDIPFDGPIAGIRVGRVGGQLVANPTAKQREQSDLDLVMAVSRKAIVMVEGGAEEVSEADMVAALDFGFTTAQPALDLQDELRRELNKQVRSFEKPAAVDEGLRAKVRELAMDGIKAGYGIKEKGARYEALGKTKKEALAKLKEQLGDGYTPLVEKHAKAVVEDLKYEHMREMTVNGGRIGDRGHDVVRSITCEVGVLPRTHGSAVFTRGETQALVVTTLGTSDDEQRLEMLGGMAFKRFMLHYNFPPFSVNETKPLRGPGRREVGHGALAERALRNMVPKSESFPYTVRLVSDILESNGSSSMASVCGGTLALMDAGVPLKAPVAGIAMGLVKEGDKIAILSDILGDEDHLGDMDFKVCGTSKGITSIQMDIKITGLTTEIMSRALEQARQGRLHILGEMLKTLAESRKEISQYAPRITTIQIRPEFIKNVIGPGGKVIKDIIARTGAAINIEDSGRVDIASANGEAVKAAIAMIQALTREAEIGKIYTGTVRKIAEFGAFVELFPGTDGLIHISELSDKRVKSVSDVLNEGDEVLVKVVSIDKTGKIRLSRKEAMAERAAQQGAAAGEAAAQPAPAPTQPDAKA

SEQ ID NO: 19305 - protein, 121 aa, Zea mays
VLAANACQFKNVVAIVDPPRVGLRPTVIKALRTHPRIRRLVYVSCNPDSLVANAIELCTPPSENQEKTKGTRGWRFMSSAGFVRQRTKSIPNFDPFIPKRAMAVDLFPHTPHCEMVMFFER

SEQ ID NO: 19306 - protein, 591 aa, Cryptococcus neoformans
MPFGFTHKPLVALANSAICSFFREIEVYGAENVPTEGPIIFACTHANMAVDPALLSNTVPHGHLMHYWVKDSLFKNPAVGWLLHNAGNIAVDRTTRNNQMLFRGTFEALALGECIGVFPEGTSHTEPHIIPLKDGTSWAALEYVRYLQGTEENKGAKKGKKAVVVPVGIAYVDKAKYRSRVVVHYRKPITMEQFESQFLSDEPGANKVAVKNLTKAITLEFRKMTVNCPDWDTAFAAQMARELLWERESDLSLADYVQVSQTLVDLFCTPNSKIENLKTLLATYQRLLTSSRLSNAALVGLKLPRQLNPDSVTSLPSRFSTLWLLIKDSIACLIRLPFFIVPMLLHIPVYIVGILGARLVEDELETQAQMKITFGLLLSFLTYPVLFFSLWAVFRNWTLGTVMAAGAVWLLGRYHSALIDENYDAMKRLVAAWRLVVGVWLPRDFEMPLPNFVAQYSLFAPDPPKVAGLPPATPPEKYQKPKRLSSRVLVKHILRVRAQAARELAELLLELENGEEVVAQTWLAEEFGGKVLQQSQQDGAEEQLTGRWVKQGGTRSGREVLQYLKSKGARLGFTAEEVGAVNASGVDTEME

SEQ ID NO: 19307 - protein, 718 aa, Sulfolobus shibatae
MSIFFRTRDRPLRPGDPYPLGSNWIEDEDGVNFSLFSENAEKVELFLYSQTNQKYPKEIIEVKNKTGDIWHVFIPGLRPGQLYAYRVYGPYKPELGLRFNPNKVLIDPYAKAINGNVIWNDAVFGYKIGDQNQDLSYDERDSSEYVPKSVVINPYFEWDDENFIKGKKVPLKDTVIYEVHVKGFTKLRLDLPENLRGTYEGLASEQMISYLKDLGITTVELMPVFHFIDQRFLIDKGLTNYWGYDPINFFSPECRYSSSGCLGEQVISFKRMVNKLHNAGIEVIIDVVYNHTAEGNHLGPTLSFRGIDNTAYYMLQPDNKRYYLDFTGTGNTLNLSHPRVIQMVLDSLRYWVTEMHVDGFRFDLAAALARELYSVNMLNTFFIALQQDPILSQVKLIAEPWDVGQGGYQVGNFPYQWAEWNGKYRDSIRRFWRGEALPYSEIANRLLGSPDIYLGNNKTPFASINYVTSHDGFTLEDLVSYNQKHNEANGFNNQDGMNENYSWNCGTEGTTNDQNVIMCREKQKRNFMITLLVSQGTPMILGGDELSRTQRGNNNAFCQDNEITWFDWNLDERKSKFLEFVKKMIQFYKAHPVFRRERYFQGKKLFGMPLKDVTFYTSDGKEVDEKTWNSPTQTVIFVLEGSVMDEINIYGERIADDSFLIILNANPNNVKVKFPKGKWELVVGSYLREIKPEERIVDGEKELEIEGRTALVYRRTEL

SEQ ID NO: 19308 - protein, 403 aa, Lactobacillus acidophilus
MSENSNQFLDALKQMQGVEVGDIVDVEVLDVEDGQIDVGVENAGVEGVITRREYTSDRNADLRDLVKPGDKFKALVLRRAGGDKENGEFFFSVTRLKEREAFDKLQKDFEEGNAIEGTVTSSVRGGLLVDVGTRGFLPASLISNRYVSDLKPYIGKTMKLKITEIDPNKNRLILSHKDLVEEEREEAFDKVASQLVVGDVVEGKVSRLTNFGSFIDVGGVDGLVHISEISYKHVDKPSDVLKVGQDVKVKVIGIDNDRHRISLSIKQTEPSPFEQATADLNEGDIFEGEVKSLTNFGAFVEVADGIQGLVHVSEISNKHVDKPSDVLKVGQTVKVKVLNIDPNDRRISLSIKAADSNSSSSDNHNSRPRRSRNENTVNKKYMSDNDNGFALGDIIGDQLKDRK

SEQ ID NO: 19309 - protein, 312 aa, Bacillus clausii
MTVVNNITELIGNTPLVKLNRLATAEHADVYLKLEYQNPGSSVKDRIALAMVNAAEESGELKPGATIVEPTSGNTGIGLAMVAAAKGYKTKLVMPETMSMERRNLLRAYGAELVLTPGPEGMGGAIRKATELAKQDGHFMPQQFENSANPKIHRETTGKELLKQVDGQLDGFVAGIGTGGTITGAGGLLKEHFPELKIVAIEPKDSPVLSGGKPGPHKLQGIGPGFVPGILNTNVYDSVLQVSTEQAFEYARRAAREEGILGGISSGAAIYGALELAKELGPGKKVVAIIPSNGERYLSTPLYQFEEETTHS

SEQ ID NO: 19310 - protein, 431 aa, Trichodesmium erythraeum
MVTEVSLIEIAKTTRQAAQKSAVLSTEAKNQAIEAVAQALEKATPKIITANQLDCRIAETDGIAKPLYNRLKMDEAKLNSAIEGLRNVATLRDPIGVVQIHRELDAGLILKRITCPLGVIGVVFEARPDAVIQISALAIKSGNGVILKGGKEATNSCLELVTAIRQGLSTTSVNPDGVQLLTTREETLELLKLDEYVDLIIPRGSNSFVKFVQENTQIPVLGHAEGICHVYVDKFADIQKAVKITIDAKTQYPAACNAAETLLVHTDVAAKFLSEVFPELEKRQVELRGDRATQQILSSVKEATDLDWATEYSDLVLSVKVVDSLDSAIAHINNYGSGHTDAIITEDGKAAEIFLAQIGSAGVFHNCSTRFSDGFRYGFGAEVGISTQKMPPRGPVGLEGLVTYKYQIVGDGHIAATYSGENAKPFTHQDF

SEQ ID NO: 19311 - protein, 294 aa, Saccharomyces cerevisiae
MKTLVHVASVEKGRSYEDFQKVYNAIALKLREDDEYDNYIGYGPVLVRLAWHISGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDAGYVRTFFQRLNMNDREVVALMGAHALGKTHLKNSGYEGPWGAANNVFTNEGYLNLLNEDWKLEKNDANNEQWDSKSGYMMLPTDYSLIQDPKYLSIVKEYANDQDKFFKDFSKAFEKLLENGITFPKDAPSPFIFKTLEEQGL

SEQ ID NO: 19312 - protein, 539 aa, Prochlorococcus marinus
MNFNLKFEKLNKKNYQRKHYGKILTVRLPCNPIFPIGPIYLADHIHKCFPDLEQQFIDLAIIPSNKVSKCLARKIDQFRPHLIIFSWRDIQIYAPVDGRSGNPLQNSFEVFYSKNILKKIRGSWGGLKLIASHYGEIYRNTSLVKMGLKRAQKYNKNIKVILGGGAVSVFYEQLGNLLPKGTVISVGEGENLIEKIIKGDSIEEERCYVAGQKPRSKLIHEQPSGTVKTACDYKYIKSKWPEFDWYIEGGEYYVGVQTKRGCPHNCCFCVYTVVEGKQVRVNPVKEVISEMKQLYDLGVRGFWFTDAQFIPAKKHIEDAKTLLQAIKDQGWDDINWAAYIRADNIDAELAQLMVDTGMSYFEIGITSGSQELVRKMRLAYDLETVLNNCRMLVKSGFKNHVSVNYSFNVFDETPSTIRQTIAYHRELENIFGKGLVDPAIFFIGLQPHTLLEKYALEHKILKPNYNPMSMMPWTARKLLWNPGSLGKKLGQVCLEAFDNTEDEFGKTVIDILERDYGKSSLKESLKVRPLSERKLAHSK

SEQ ID NO: 19313 - protein, 133 aa, Unknown
  Synechococcus sp. WH 7805
MRMLHTMLRVGDLERSLAFYTDVLGMRLLRRKDYPGGRFTLAFVGYGDESESTVLELTHNWDTAEYDLGSGYGHIALGVDDIQATCAGIAGQGGRVVREPGPMKHGSTVIAFVEDPDGYKIELIELSSRSTSA

SEQ ID NO: 19314 - protein, 509 aa, Myxococcus xanthus
MRAPAPTPKRTVYTEAMEIFHRAADLIALDKRVRLELEEPDYEHIFYVTAKLKDRLVPLSEEKARTFSNLPETQVRNKEGLELLANGNIILNGRALLGSDVDIRQGHLRLPDGKVYQLVPGESQRFKAYRVQHNQARGPYKGGLRYHREVSLDLFKALAAEMTWKTAIAEVPFGGGKGGIQIDPREYGREEIEAITLRFMYRLKSMIGPDIDIPAPDVGTNPGIMALLYRQYSDGERERHNLRGIVTGKDVRIGGSEGRHKATGQGVAFCIEDYYADRGESVKGKTFIIQGFGNVGSHAANILSQMGARLLAVNDADGTIFNGDGIDVTALSAYVQDPKNLKRSVLGFPGAQRIEKKDLWDVQADILVPAALGGEITADVAERLRVKLVAEGANGPTTPEADRILEKRGIELIPDIIANAGGVTVSYYEWIQNKRMERWSEAEVDQRLERAMKRNYRIIRDISRNQPRKTEMHDSRQYCIGETVDTRCAAMILALKRIEAHYLLEGFSQ

SEQ ID NO: 19315 - protein, 450 aa, Geobacter metallireducens
MSPQLIDERLAGIYQDVLKRNPGEVEFHQAVAEVLESLGPVVTKHPEYLERKIIERIAEPERQIIFRVPWQDDKGQVHINRGFRVEFNSALGPYKGGLRFHPSVYLGIIKFLGFEQIFKNSLTGMPIGGGKGGSDFDPKGKTDDEVMRFCQSFMTELYRHIGEHTDVPAGDIGVGGREIGYMFGQYKRITNRWEAGVLTGKGLKFGGSLVRPEATGYGATYFINEALKVRKDSFDGKTCLVSGSGNVAIYTIEKIHQLGGKCIACSDSNGVIIHEKGLDVELIKQLKEVERRRIADYATYHKDAKYIANGNIWDIPCQVAMPSATQNEINGKDAKTLVKNGCIAVGEGANMPTTPEGIKVFIEAQIAYGPGKAANAGGVATSALEMQQNAQRDSWSFEETEKKLEKIMVGIHKLCYETAEEYGDKGNYVTGANIAGFIKVADAMVAHGLV

SEQ ID NO: 19316 - protein, 507 aa, Zymomonas mobilis
MARIANKAAIDAAWKQVSACSEKTLKQLFEEDSNRLSGLVVETAKLRFDFSKNHLDSQKLTAFKKLLEACDFDARRKALFAGEKINITEDRAVEHMAERGQGAPASVARAKEYHARMRTLIEAIDAGAFGEVKHLLHIGIGGSALGPKLLIDALTRESGRYDVAVVSNVDGQALEEVFKKFNPHKTLIAVASKTFTTAETMLNAESAMEWMKKHGVEDPQGRMIALTANPAKASEMGIDDTRILPFAESIGGRYSLWSSIGFPAALALGWEGFQQLLEGGAAMDRHFLEAAPEKNAPILAAFADQYYSAVRGAQTHGIFAYDERLQLLPFYLQQLEMESNGKRVDLDGNLIDHPSAFITWGGVGTDAQHAVFQLLHQGTRLVPIEFIAAIKADDTLNPVHHKTLLTNAFAQGAALMSGRDNKDPARSYPGDRPSTTILMEELRPAQLGALIAFYEHRTFTNGVLLGINSFDQFGVELGKEMAHAIADHPENSDFDPSTKALIAAALK

SEQ ID NO: 19317 - protein, 262 aa, Campylobacter upsaliensis
MVSMRDLLECGVHFGHQTRRWNPKMKKYIFGERKGIYVIDLQKTLRYFRYTYNIVRDAAAEGKTILFVGTKKQAGGAIKEYAEKCGMPYVNHRWLGGMMTNFGTIRQSIRKLEVIEKMEEDGSIKLLTKKEALMLTRKKEKLLAYLGGIRYMKSQPDMIFVIDTVKERIAVAEANRLKIPVVAPLDTNCDPDLVTYPIPGNDDAIRSVQLFCQEMAEAINEGKALREQDGVVENEEKEISEEEKQEVLEEAMSEEDFEEEQE

SEQ ID NO: 19318 - protein, 204 aa, Viburnum lentago
  misc_feature (83)..(83): Xaa can be any naturally occurring amino acid
YDKPVKGRKINWMKAGILESDQILTVSPYYAEELVSGEDKGVELDNILRKTGILGIVNGMDVQEWNPLTDKYTGIKYDATTVXNAKPLIKEALQAEVGLPVDKDIPVIGFIGRLEEQKGSDILVEAIPQFIGENVQIIVLGTGKKAMEKQLEQLEREYPDKARGVAKFNVPLAHMIIAGSDFILVPSRFEPCGLIQLHAMRYGT

SEQ ID NO: 19319 - protein, 493 aa, Hyphomonas neptunium
MDQAVNKATTRIAILGAGMSGLGAAAKLKEAGYSVIDIFEKSGGVGGTWRDNTYPGCGCDVPSHLYSYSFELNPDWDYKWSLQPQILKYFEDFADKYDVRRHCRFNTEITECRWDDAANSWTLTDRAGKTYTADVLISGLGQLNIPHTPNFPGLDTFKGGAFHSARWDHSVGLKGKTVAVIGNGPSAVQFVPEIQKVVGKMLSFQRSPAWCRPRGQRAYDAKAKKYFAGADWRINWYRWRIRAFADFGFGAFLQKSPLGLADSMKKMCQKHLEDQVQDPVLREKLTPDFEPGCKRILISDDYYPALAKPNVDVLRQGIKAVTPDGVIGEDGQEYKCDAIIWATGFQSTEFLTPMQVYGRNGLSLNQAWKDGAEAFKGMAVSGFPNLFLLYGPNTNLGHNSIILMVEHQIHYMIQCIDKIAEKGVAAIDVTPSAMTAYNVRVQSEIAKTVWASDCHSWYKNEAGKVTNNWYGKTTDYKKETRTPDWTDFEVVKG

SEQ ID NO: 19320 - protein, 508 aa, Unknown
  Nocardioides sp. JS614
MWNRLAHAGLGVLATLVGVAAGHLVAGLTEPAASPVLVVGSTVIDLTPTPVKEWAIAQFGTHDKTVLVGSVLLGVLVLAAVAGLLARRRFGYGAALLLVLVAVPAGAALTRPGAATSDVLPSLAAAVAGVGALAGLTRARTAAAATAAPGPAVAAPSRRGVLVAAGALGVAAAAMGGAGRWIAAYRTRTTRVDLPAATDPAPRLPAGLEQRVPGISAFRTPTAEFYRVDTRLTLPIVDVDGWTLTIDGDVEHEVTLTFDDLLTMPLVERDITLTCVSNEVGGSYLGSARWLGVRLTDLLDRAGIDGTRADQILSTDVDGMTISTPLAVATDGRDALIAVGMNGRSLTREHGFPARMVVPGLYGFVSACKWITRMTLTTYAEQQAYWTRRDWATDAPVRISSRIDTPRPLATVAAGRTVVGGVAWAQHQGGIDRVEVRVDGGPWQQARLGPSAGQDYWRQWYLPWTAEPGRHSLAVRAVDGDGEVQTGARATPFPQGATGIQQIVVTVA

SEQ ID NO: 19321 - protein, 264 aa, Daucus carota
MAMAASSSTVVRATPFLGLTKATNANPLRDVVSMGPGKFTMGSDLWYGPDRVKYLGPFSAQTPSYLTGEFPGDYGWDTAGLSADPEAFAKNRALEVIHGRWAMLGAFGCITPEVLEKWVKVDFKEPVWFKAGSQIFTEGGLDYLGNPNLVHAQSILAVLGFQVVLMGLVESFRINGLPGVGEGNDLYPGGQYFDPLGLADDPVTLAELKVKEIKNGRLAMFSMFGFFVQAIVTGKGPLENLLDHLDNPVANNAWVYATKFVPGS

SEQ ID NO: 19322 - protein, 204 aa, Viburnum melanocarpum
YDKPVKGRKINWMKAGILESDQILTVSPYYAKELVSGEDKGVELDNILRKTGILGIVNGMDVQEWNPLTDKYTGIKYDATTVMNAKPLIKEALQAEVGLPVDKDIPVIGFIGRLEEQKGSDILVEAISQFIGENVQIIVLGTGKKAMEKQLEQLEIDYPDKARGVAKFNVPLAHMIIAGADFILVPSRFEPCGLIQLHAMRYGT

SEQ ID NO: 19323 - protein, 720 aa, Xanthomonas oryzae
MATRKFTQRSRIREGRPNSLGATWDGLGVNFALYSRNATRVELCLFDDRGREQERIALPEYTDEVWHGYLPDARPGQLYGYRVHGPYAPDAGHRFNHNKLLLDPYAKQIVGELKWAPHLFGYIIGHRDKDLSFDRRDSAAFMPKSAVIDPAFTWGQDRPPQTPWNRTVIYEAHVRGLSMLHPAVPPEERGTFSALKTDELIDHISSLGVTAVELLPVHAFVDDQYLLENGLRNYWGYNTLGFFAPQARYMSTRTVAEFKQMVARLHHAGLEVLLDVVYNHTAEGNELGPTLSFKGIDNASYYRLADDRRFYINDTGTGNTFDLTNVGALRMVMDSLRYWVQEMHVDGFRFDLASILGRERYGFDPSGSFLDAVRQDPVLSQTKLIAEPWDIGPGGYQVGNFPPGWVEWNDKFRDNVRAFWRGDGGQLAELATRLTGSADLFNHSGRRPTASVNFVTAHDGFTLRDLVSYEGKHNLANGEDGRDGSDHNISCNYGVEGETNDPTIKQLRRQQMRNLLATLLLSQGTPMLLAGDEFGHSQNGNNNAYCQDNELTWIDWTAATKAAAADQAAFVRRLIRIRQRYPLLHRARFFDGKFDEALGLKDLTWLAPDGHEMDEAGWHDPEARALMLRLDGRSPATGLREIAANVTLLMLINAASTSVSFTLPAMHDEHWRVLVDTARHGGRVVAGGSEWKASAHSLTLLAVERDRIISSARIVSEGAR

SEQ ID NO: 19324 - protein, 331 aa, Xanthobacter autotrophicus
MEQPDMRLMEPPRLVLNPTVTPLLPAPQLTGTLGGPEIWIKRDDLIPFGCGGNKIRGLELIVADALRAGADTLVTGAGTLSNHVRATAAAAAFAGLGMSAVYWGDPPQKAKGNHLLSVLWGARTRFTGSSDRNSVDAMLEVEAADIRAAGGRPYVIPRGGACALGVIGHVHAVGEVMAQCRQAGIRPDCVVMAVGSGGTLAGWLLGSRLLGASWRVEGITVSRPAAEARVRVKDLADQAADHLGLARSVAADDVVIHDGFIGAGYGIASPAGMSAIERAARSEGVVLDPVYTGKAMAGYGALLGAGRYGDATTVLFLHSGGLPSLFVDGNA

SEQ ID NO: 19325 - protein, 388 aa, Photorhabdus luminescens
MTAIIRQFLKLEAAGGLLLIITAIIALIMANSPLQGIYQQFLNISVAVQFAALEINKPLLLWINDGLMAVFFLIVGLEVKRELLEGSLAGRDKALFPVIAAIGGMVAPALIYLLFNGNDEFTRQGWAIPAATDIAFALGVMALLSKRVPTELKVFLLALAIIDDLGVIVIIALFYTKTVSLVALGLSAAMIALLVWMNWRGVEKTSAYLAVGAILWVCILKSGVHATLAGVIVGFLIPLRGQNGHSPSELLEHGLHPWVAYLILPLFAFANAGVALNGVTLNGLTDILPLGIAVALFLGKPLGIFLFSYISIQIGFAKLPQQINLKQIFAVSVLCGIGFTMSIFISGLAFEGVDESFSVYSRLGILMGSTIAAFMGYGLLRMVLPKKK

SEQ ID NO: 19326 - protein, 143 aa, Agaricus bisporus
MAPKPASTAGKAPASTASKAPVKSDAAKTASKSKVSSGADGEKKKRKKTRKETYSSYIYKVLKQVHPDTGISNKAMAILNSFVNDIFERIATEASKLASYSKKSTISSREIQTSVRLILPGELAKHAISEGTKSVTKFSSGGK

SEQ ID NO: 19327 - protein, 515 aa, Daucus carota
MENGTKELNKPQPPSSAAMQLQTPVQKIPTATWKLVLVAAIAAGVQFGWALQLSLLTPYVQLLGIPHKWAAYIWLCGPISGMLVQPIVGYYSDHCQSSFGRRRPFIASGAGCVAISVILIGFAADISYKAGDDMSKTLKPRAVTVFVIGFWILDVANNMLQGPCRALLADLCSGDTRRMRSANAFYSFFMAVGNILGYAAGSYNNLYKLFPFSKTHACDLYCANLKSCFIISIALLIIITVVALSVVRENSGPPDDADAAEEPPSSGKIPVFGELLGALKDLPRPMLLLLIVTCLNWIAWFPFILFDTDWMGREIYGGTAGQGKLYDQGVRAGALGLLLNSVVLGLTSIAVEYLVRGVGGVKILWGFVNFILAIGLVMTVVVSKVAQHQREHSANGQLLPPSAGVKAGALSLFSILGIPLSITYSIPFALASIYSSGSGAGQGLSLGVLNLAIVVPQMIVSVLAGPFDSLFGGGNLPAFVVGAISAAISGVLAIVLLPKPSKDAASKLSLSGTYH

SEQ ID NO: 19328 - protein, 78 aa, Pinus thunbergii
MKKQNLIHAEGLVTESLPNGMFRVLTDNGCQILTHISGRIRRNSVRILPGDRVKVELSAYDLTKGRIIYRLSNKSSND

SEQ ID NO: 19329 - protein, 204 aa, Viburnum nudum
YDKPVKGRKINWMKAGILESDQILTVSPYYAEELVSGEDKGVELDNILRKTGILGIVNGMDVQEWNPLTDKYTGIKYDATTVMNAKPLIKEALQAEVGLPVDKDIPVIGFIGRLEEQKGSDILVEAIPQFIGENVQIIVLGTGKKAMEKQLEQLEIEYPDKARGVAKFNVPLAHIIIAGADFILVPSRFEPCGLIQLHAMRYGT

SEQ ID NO: 19330 - protein, 426 aa, Gloeobacter violaceus
MPVSDDLLRATDPLVAGWIDRELNRQRSHLELIASENFTSAAVMAAQGSVLTNKYAEGLPSKRYYGGCEFVDAVEQIAIDRAKALFGAAHANVQPHSGAQANAAVFLALLERGDKILGMDLSHGGHLTHGSPVNQSGIYFEALHYGVDPASHRIDFDQVRELAHAHRPKLIICGYSAYPRVIDFECFREIADEVGAYLLADIAHIAGLVVAGVHPNPIPHCDVVTTTTHKTLRGPRGGLILTRDEALGKRFDKAVFPGTQGGPLEHVIAAKAVAFGEALQPEFKTYAADVVANARALAERLTARGLTLVSGGTDNHLMLVDLRSVDLTGKQADLLMSDVNITTNKNTIPFDPQSPFVTSGLRLGSPAMTTRGLGTTEFGEIGEIIANRLTQPTDARVVADCLERVASLCTRFALYPHLGRVVAPVG

SEQ ID NO: 19331 - protein, 164 aa, Ralstonia eutropha
MSNVYQFEAKSLAGQPVPLSQFRGKVLLIVNTASECGFTPQYAGLQALHDAYAARGLEVLGFPCNQFGKQEPGDAQQIGQFCESRFSVKFPMFAKIDVKGPDAHPLYQWLTSAKRGVLGTQAIKWNFTKFLLRRDGTVYKRYGSITKPEEIRADIETLLADPAA

SEQ ID NO: 19332 - protein, 195 aa, Triticum aestivum
MAVLQVAAAAPPPVSAIGFEGYEKRLEISFSEAPVFADPNGRGLRALSRDQIDSVLDLARCTIVSELSNEDFDSYVLSESSLFVYPYKMVIKTCGTTKLLLAIPRILELAKELSLPLSAVKYSRGTFIFPDAQPSPHKNFADEVAFLNRFFGGLRSGGNAYVIGDSAKPGQKWHVYYASEHPEEPVVTLEMCMTG

SEQ ID NO: 19333 - protein, 457 aa, Saccharophagus degradans
MVNYLKRAALCMLALVAVACAKSQPETKVEELPATKTAANAGVAATEFVQVNGGRFTLRGQDYAYIGTNMWFAAYIGSTNPEYGDRERLIKELDLLKSLGVTNLRILGASEKSPLRDSMKPAISERGEINQHDILEGLDFALAEMAKRDMKAVIFLNNFWEWSGGMATYLSWVNGGEIVDMADPTKPWPAFALFSAGFYSNEEAKQLFNNYLTKVVSRRNTITGELYANDPTIMSWQLANEPRPGNGDVSKSNLPAYYDWISKTTQLIKSIAPKQLVSIGSEGTMGCLELDECVITAHKETGIDYVTFHMWLKNWGWFDVQNAEQTYDSAVATADKYIDHHIKLANELNMPVVLEEFGMERDGGEFSPESAVTYRDKFYAYVFDRQIKSIRSGGPFVGSNFWAWGGYGKAMHDDAVWRKGDKTFVGDPPQEPQGLNAVFASDTSTLEVLKQAADAIR

SEQ ID NO: 19334 - protein, 501 aa, Daucus carota
MAGPEADRNRHRGGATAAPPPRSRVSLRLLLRVASVACGIQFGWALQLSLLTPYVQELGIPHAWSSIIWLCGPLSGLLVQPIVGHMSDQCTSKYGRRRPFIVAGGTAIILAVIIIAHSADIGGLLGDTADNKTMAIVAFVIGFWILDVANNMTQGPCRALLADLTGNDARRTRVANAYFSLFMAIGNVLGYATGAYSGWYKVFPFSLTSSCTINCANLKSAFYIDIIFIIITTYISISAAKERPRISSQDGPQFSEDGTAQSGHIEEAFLWELFGTFRLLPGSVWVILLVTCLNWIGWFPFILFDTDWMGREIYGGEPNQGQSYSDGVRMGAFGLMMNSVVLGITSVLMEKLCRIWGSGFMWGLSNILMTICFFAMLLITFIAKNMDYGTNPPPNGIVISALIVFAILGIPLAITYSVPYALVSTRIESLGLGQGLSMGVLNLAIVVPQVIVSLGSGPWDQLFGGGNSPAFVVAALSAFAAGLIALIAIRRPRVDKSRLHH

SEQ ID NO: 19335 - protein, 411 aa, Unknown
  Oceanospirillum sp. MED92
MQIVNILIMFLIMLMLAALLRPLASRLHLPYSLVLVFAGFIGSEVITSLGYDTGLRWQHFQLLVFYIFLPVLIFEAALHIDAKRLCKKLLPILLLSTPLMLLATAVSAVFLYYGIGYPNHYPVLAALLTGALLSATDPAAVISLLKKAGVSEDLILLMEGESLFNDASAIMMFGLISSLLLMPEGDFSFSYAALSFAKIFFGGIAVGGAVLVILGGCFYLVKDSFSRMVFMLSGAYAGYVIAESVLHVSGVMCVLVTGVGFGELIRRYSRDEQKIRLSNHWLFAGELSSAMIFLLLGVTVTLAMFQQQWLAMLLGIAAVLIARGVGLVIIGPLINVIPGTRLNWKDHCIIYWGGLRGAVTIALALSLPLELDAWFTIQSIAYGVVMFSLCVQATSTPWLLTKLARKEKEGK

SEQ ID NO: 19336 - protein, 480 aa, Aspergillus nidulans
MSGFEAHFSDRPQFSGFMKPCRFEGDVSHLEVYGEIPKDIDGVFYRVMPDPQLPPFIEDDPRYVQTEKFVREREAQRALLAGLGKYRNRFTDAVELKVRSTANTNVVFFNGQLLALKEDSPPYALDPVTLDTKGLYDFEGQLPSLTFTAHPKFDPATGEMVCFGYEARGDGTPDVCYYSVSPTGKFTEVVWLVAPVVAMIHDFAVTDNWVIFPIIPQVCDLERMKQGGEHWQWSPETPFYLGVMPRRGAKAEEVKWFRYMNSFPGHTANAYENEQGHLVIDLGLSEKNVFFWWPDAQGNAPEPSSIVSQLVRFTIDPQTEDLTLREPEVLQEGNSEFYRIDDRFATRPYRHCYFDLMDPQLGTDFERIGTKIGGGFPLYNSLAHLDHTTGQVEVYFPGRTHLVQEPVFIPRKNSSTEGDGHVLALVNNYDTMASELHLLDTRDFARAQAKILLPVRLRQGLHGSWVDASDDDHRVSTVGS

SEQ ID NO: 19337 - protein, 267 aa, Thermotoga maritima
MGSDKIHHHHHHMKEVFDLRGRVALVTGGSRGLGFGIAQGLAEAGCSVVVASRNLEEASEAAQKLTEKYGVETMAFRCDVSNYEEVKKLLEAVKEKFGKLDTVVNAAGINRRHPAEEFPLDEFRQVIEVNLFGTYYVCREAFSLLRESDNPSIINIGSLTVEEVTMPNISAYAASKGGVASLTKALAKEWGRYGIRVNVIAPGWYRTKMTEAVFSDPEKLDYMLKRIPLGRTGVPEDLKGVAVFLASEEAKYVTGQIIFVDGGWTAN

SEQ ID NO: 19338 - protein, 110 aa, Mycobacterium smegmatis
MSEDSATVAVTDDSFSTDVLGSSKPVLVDFWATWCGPCKMVAPVLEEIAAEKGDQLTVAKIDVDANPATARDFQVVSIPTMILFKDGAPVKRIVGAKGKAALLRELSDAL

SEQ ID NO: 19339 - protein, 524 aa, Solanum lycopersicum
MDTCCAAMKSTVHLGRVSTGGFNNGEKEIFGEKIRGSLNNNLRINQLSKSLKLEKKIKPGVAYSVITTENDTETVFVDMPRLERRRANPKDVAAVILGGGEGTKLFPLTSRTATPAVPVGGCYRLIDIPMSNCINSAINKIFVLTQYNSAALNRHIARTYFGNGVSFGDGFVEVLAATQTPGEAGKKWFQGTADAVRKFIWVFEDAKNKNIENILVLSGDHLYRMDYMELVQNHIDRNADITLSCAPAEDSRASDFGLVKIDSRGRVVQFAEKPKGFELKAMQVDTTLVGLSPQDAKKSPYIASMGVYVFKTDVLLKLLKWSYPTSNDFGSEIIPAAIDDYNVQAYIFKDYWEDIGTIKSFYNASLALTQEFPEFQFYDPKTPFYTSPRFLPPTKIDNCKIKDAIISHGCFLRDCTVEHSIVGERSRLDCGVELKDTFMMGADYYQTESEIASLLAEGKVPIGIGENTKIRKCIIDKNAKIGKNVSIINKDGVQEADRPEEGFYIRSGIIIISEKATIRDGTVI

SEQ ID NO: 19340 - protein, 305 aa, Helicobacter pylori
MILTAMQDAIGRTPIFKFTRKDYPIPLKSAIYAKLEHLNPGGSVKDRLGQYLIKEAFRTRKITSTTTIIEPTAGNTGIALALVAIKHHLKTIFVVPKKFSTEKQQIMRALGALVINTPTSEGISGAIKKSKELAESIPDSYLPLQFENPDNPAAYYHTLAPEIVQELGTNLTSFVAGIGSGGTFAGMAKYLKERIPNIRLIGVEPEGSILNGGEPGPHEIEGIGVEFIPPFFANLDIDRFETISDEEGFSYTRKLAKKNGLLVGSSSGAAFAAALKEVQRLPEGSQVLTIFPDMADRYLSKGIYS

SEQ ID NO: 19341 - protein, 406 aa, Clostridium perfringens
MNKEIKLRNDIYSVGVIDNRPVPFHRLILEKGTTYNSYLLKTKKPTVIDTVDLIYTKDFLNNLKEIIDLKDISYIVINHTEPDHSGALGGLARQATNAKIVCSEKAVYHLKELYKLHDRDFIVVNDGDTLDIGGKTLLFKMTPYLHTEETMITYDVEDKILFPCDIFSTHLTAKEHFSSKSNEDITEDFLTYYKLIMEPHRKYIRPLIDILKDLDIEVIAPSHGYILDENIQSYIDIYDKYSKETKKGKKATIVYTTMRNATKKIAEKFKSELENEDIEVYIFNADKSTKEDILASIKESDSILFGTSTKYGDLIGSIEDILKELPKLDLSNKLLGAFGSFGWSGEPIEIIQDYLNSTNGNVLNTSSIIKSTGMIDVHFPVRIRFSLNEESEKEVVRAADYISSII

SEQ ID NO: 19342 - protein, 456 aa, Staphylococcus epidermidis
METIKKNEVKTGKVIDLTHEGHGVVKVDRYPIFIPNALIDEEIKFKLIKVKKNFAIGKLIEVISESDDRVTPPCIYYAKCGGCQLQHMTYRAQLDMKREQVVNLFHRKGPFENTVIKETIGMVNPWRYRNKSQIPVGQSNSNQVIMGFYRQRSHDIIDMDSCLIQDRQHQEVMNRVKYWLNELNISIYNEKTKTGLIRHLVVRTGYHTDEMMVIFVTNGATFKQSELLVNKLKKEFPNITSIKQNINNSHSNVIMGRQSMTLYGKDKIEDQLSEVTYHISDLSFYQINSSQTEKLYQQALNYAQLTGKEIVLDTYCGIGTIGLYMAPLAKHVYGVEVVPQAIKDAEDNATKNQLKNTTFECGKAEDVILTWKSQGIKPDVVMVDPPRKGCDETFLTTLLKLNPKRIVYISCNPSTQQRDAQILAEQYELVEITPVDMFPQTTHIETVALFVRKEEE

SEQ ID NO: 19343 - protein, 527 aa, Solanum habrochaites
MDTCCAAMKSTVHLGRVSTGSFNNGEKEIFGEKMRGSLNNNLRINQLSKSLKLEKKEKKIKPGVAYAVITTENDTETVFVDMPRLERRRANPKDVAAVILGGGEGTKLFPLTSRTATPAVPVGGCYRLIDIPMSNCINSAINKIFVLTQYNSAALNRHIARTYFGNGVSFGDGFVEVLAATQTPGEAGKKWFQGTADAVRKFIWVFEDAKNKNIENILVLSGDHLYRMDYMELVQNHIDRNADITLSCAPAEDSRASDFGLVKIDNRGRVVQFAEKPKGFELKAMQVDTTLVGLSPQDAKKSPYIASMGVYVFKTDVLLKLLKWSYPTSNDFGSEIIPAAIDDYNVQAYIFKDYWEDIGTIKSFYNASLALTQEFPEFQFYDPKTPFYTSPRFLPPTKIDNCKIKDAIISHGCFLRDCSVEHSIVGERSRLDCGVELKDTFMMGADYYQTESEIASLLAEGKVPIGIGENTKIRKCIIDKNAKIGKNVSIINKDGVQEADRPEEGFYIRSGITIISEKATIRDGTVI

SEQ ID NO: 19344 - protein, 162 aa, Pseudomonas syringae
MSAFHDIRLKALGGQELPLADFKNKVVLVVNVASKCGLTPQYAALENLYQQYRDKGLVILGLPCNQFAGQEPGTEQEIAEFCQLNYGVTFPLGEKLDVNGPNRHSLYRLLAGEGAEFPGDITWNFEKFLVGKNGGVSARFSPRTAPDDPAVIQAIEKALAHN

SEQ ID NO: 19345 - protein, 129 aa, Candida glabrata
MSAEKKPASKAPAEKKPAAKKTAPSADGKKRTKARKETYSSYIYKVLKQTHPDTGISQKSMSILNSFVNDIFERIASEASKLAAYNKKSTISAREIQTAVRLILPGELAKHAVSEGTRAVTKYSSSTQA

SEQ ID NO: 19346 - protein, 319 aa, Nostoc punctiforme
MRIAQDITELIGRTPLVQLNKIPQAEGVVARIVVKLEGMNPAASVKDRIGLSMVLSAEAAGSIQPGKTILVEPTSGNTGIALAMVAAARGYRLILTMPETMSQERRAMLRAYGASLELTPGAEGMRGAIRKAEEIVANTPDAFMLQQFRNPANPKVHQETTAEEIWTDTDGEVDIVIAGVGTGGTITGIAEVLKGRKKTFKAIAVEPSNSPVLSGGEAGPHRIQGIGAGFIPDVLRLELVDEVIRVSDEQAIAYGRRLAKEEGLLSGISSGAALCAAIQVGKRPENAGRLIVMIQPSFGERYLSTPMFQDLSLETAGVR

SEQ ID NO: 19347 - protein, 134 aa, Archaeoglobus fulgidus
MDELELIRQKKLKEMMQKMSGEEKARKVLDSPVKLNSSNFDETLKNNENVVVDFWAEWCMPCKMIAPVIEELAKEYAGKVVFGKLNTDENPTIAARYGISAIPTLIFFKKGKPVDQLVGAMPKSELKRWVQRNL

SEQ ID NO: 19348 - protein, 204 aa, Viburnum plicatum
  misc_feature (183)..(183): Xaa can be any naturally occurring amino acid
YDKPVKGRKINWMKAGILESDQILTVSPYYAEELVSGEDKGVELDNILRKTGIIGIVNGMDVQEWNPLTDKYTGIKYDASTVMNAKPLIKEALQAEVGLPVDKDIPVIGFIGRLEEQKGSDILVEAISQFIGENVQIIVLGTGKKAMEKQLEQLEIEYPDKARGVAKFNVPLAHMIIAGADFXLVPSRFEPCGLIQLHAMRYGT

SEQ ID NO: 19349 - protein, 480 aa, Fagus sylvatica
MGEEGNSWIRRTKFSHTVCHRLDASRLASFPIIIRPERNSGLKSRPGATSSSEKFGTIYNKQRSLSPLPESRLSDVFKEARSETKRFMTPLPRRREQAKGVMGKFVHKDFHEVKASDSKSLANSSALRHLSSMKVNDKSKYRKESSWAKYFDHGGGRVNAVETSDEWTVDLSKLFLGLKFAHGAHSRLYHGIYNDEPVAVKIIRVPEDDENGALGARLEKQFNREVTLLSRLHFHNIIKFVAACRKPPVYCVVTEYLSEGSLRAYLHKLERKSLPLQKLIAFALDIARGMEYIHSQGVIHRDLKPENVLIDQEFHLKIADFGIACEEAYCDSLADDPGTYRWMAPEMIKHKSYGRKVDVYSFGLILWEMVAGTIPYEDMNPVQAAFAVVNKNLRPVIPRYCPPAMRALIEQCWSLQSEKRPEFWQVVKVLEQFESSLARDGTLNLVQSLTCQDHKKGLLHWIHKLGPVHPNGSMPKPKLT

SEQ ID NO: 19350 - protein, 204 aa, Viburnum prunifolium
YDKPVKGRKINWMKAGILESDQILTVSPYYAEELVSGEDKGVELDNILRKTGILGIVNGMDVQEWNPLTDKYTGIKYDATTVMNAKPLIKEALQAEVGLPVDKDIPVIGFIGRLEEQKGSDILVEAIPQFIGENVQIIVLGTGKKAMEKQLEQLEREYPDKARGVAKFNVPLAHLIIAGSDFILVPSRFEPCGLIQLHAMRYGT

SEQ ID NO: 19351 - protein, 204 aa, Viburnum rafinesquianum
YDKPVKGRKINWMKAGILESDQILTVSPYYAKELVSGEDKGVELDNILRKTGILGIVNGMDVQEWNPLTDKYTGIKYDATTVMNAKPLIKEALQAEVGLAVDKDIPVMGFIGRLEEQKGSDILVEAISQFIGENVQIIVLGTGKKAMEKQLEQLEIEYPDKARGVAKFNVPLAHMIIAGADFILVPSRFEPCGLIQLHAMRYGT

SEQ ID NO: 19352 - protein, 204 aa, Viburnum rufidulum
YDKPVKGRKINWMKAGILESDQILTVSPYYAEELVSGEDKGVELDNILRKTGILGIVNGMDVQEWNPLTDKYTGIKYDATTVMNAKPLIKEALQAEVGLPVDKDIPVIGFIGRLEEQKGSDILVEAIPQFIGENVQIIVLGTGKKAMEKQLEQLEREYPDKARGVAKFNVPLAHLIIAGADFILVPSRFEPCGLIQLHAMRYGT

SEQ ID NO: 19353 - protein, 204 aa, Viburnum opulus
YDKPVKGRKINWMKAGILESDQILTVSPYYAEELVSGEDKGVELDNILRKTGILGIVNGMDVQEWNPLTDKYTGIKYDATTVMNAKPLIKEALQAEVGLPVNKDIPVIGFIGRLEEQKGSDILVEALSQFISKNVQIIVLGTGKKAMEKQLEQLEIEYPDKARGVAKFNVPLAHMIIAGADFILVPSRFEPCGLIQLHAMRYGT

SEQ ID NO: 19354 - protein, 255 aa, Andropogon gerardii
  misc_feature (219)..(219): Xaa can be any naturally occurring amino acid
  misc_feature (251)..(251): Xaa can be any naturally occurring amino acid
CELDNIMRLTGITGIVNGMDVSEWDPSKDKYIAVKYDVSTAVEAKALNKEALQAEVGLPVDRKIPLVAFIGRLEEQKGPDVMAAAIPQLMEEDVQIVLLGTGKKKFERMLMSAEEKYPDKVRAVVKFNAALAHHMMAGADVLAVTSRFEPCGLIQLQGMRYGAPCACASTGGLVDTIIEGKTGFHMGRLSVDCNVVEPADVKKVATTLMRAIKVVGTPXYEEMVKNCMIQDLSWKGPAKNWENVLLSLGVXGGEP

SEQ ID NO: 19355 - protein, 423 aa, Schizosaccharomyces pombe
VSWNYFINYFVTFPLELTTCAITFRYWTDINSAAWISIFLVVIIIVNLFGVRAYGEVEFILSTVKVVATFGFIILAIIINCGGVPTDHRGYIGGSIIKHKPFRHGFKGFCSVFTTAAFSFSGTEVIGLAAAEVDNPQKALPHAVKQVFWRIAIFYVVSLILIGLLISPDDPNLMGNGSTSVSPFVLAIKEANIKGLPSVFNAVIIISVVSVTNSSTYTAGRTLHGMANLKQAPSFFKYTDRLGRPLLAMIVVLLFGFFAYINEADKNGNDVSDTVFNWLLALSGLSNFFTWGSICLCHIIFRLAFKKQGHSLKELGFVSPMGIWGSCIGLFFNILCLMAQFYVSLFPIGGKPNANDFFQGYLAAPVTLAFFIGYKIYDRSHIPSLDKLDITTGLKTYENLDEEEDEPTTASKRIFKKISSVFC

SEQ ID NO: 19356 - protein, 202 aa, Oryza sativa
MQSLQDKASEWSGVAAGDAFAIDDGNVFEALGGTTQPFVDLSTNFYTRSRLLSLARRRSGSFFLLAISGALILGGVNRVYEDEEEWFRQIFAGSKKEDAIRNQYEFLVQRMGGPQLFSQRRGHPALIARHRPFPVTHQAAERWLHHMQQAVDTTDSIDAATKTKMMYFFRHTAYFLVAGNEMTRQGHGTSCKCKHGESKPAE

SEQ ID NO: 19357 - protein, 255 aa, Arundinella hirta
  misc_feature (199)..(199): Xaa can be any naturally occurring amino acid
  misc_feature (253)..(254): Xaa can be any naturally occurring amino acid
CELDNIMRLTGITGIVNGMDVSEWDPSKDKYIAVKYDVSTAVEAKALNKEALQAEVGLPVDRKIPLVAFIGRLEEQKGPDVMAAAIPQLMEEDVQIVLLGTGKKKFERMLMAAEDKYTDKVRAVVKFNAALAHHIMAGADLLAVTSRFEPCGLIQLQGMRYGAPCACASTGGLVDAVIEGKTGFHMGRLSVDCNVVEPXDVQKVVTTVKRALKVVGTPAYEEMVKNCMIQDLSWKGPAKNWENVLLSLGVAGXXP

SEQ ID NO: 19358 - protein, 244 aa, Arundinella nepalensis
CELDNIMRLTGITGIVNGMDVSEWDPSKDKYIAVKYDVSTAVEAKALNKEALQAEVGLPVDRKIPLVAFIGRLEEQKGPDVMAAAIPQLMEEDVQMVLLGTGKKKFERMLMAAEDKYPDKVRAVVKFNAALAHHIMAGADLLAVTSRFEPCGLIQLQGMRYGTPCACASTGGLVDTVIEGKTGFHMGRLSVDCNVVEPADVQKVETTVKRALKVVGTPAYEEMVKNCMIQDLSWKGPAKNWENV

SEQ ID NO: 19359 - protein, 954 aa, Xanthomonas campestris
MSQTPSSLRDLEHHSAFVERHIGPNDAEIAQMLDVVGHACLDALTDAIVPGNIKSPAPLALPEAITEEEALAKIRAIADKNTVFRNFIGQGYYGTHTPKVILRNILENPAWYTAYTPYQAEISQGRMEALINFQTLCADLTGMQIANASLLDEATAAAEAMTLAKRSAKSRSNTFFVHDAVHPQTLELLRTRAEPLDIVLRVGTPEEALQAECFGVLLQYPDSFGHIGDHAALADAVHAQGGLVAVATDLLALTLIAAPGEWGADIVVGNSQRFGVPFGFGGPHAAFMACRDAYKRSMPGRLIGVSIDAAGNPAYRLTLQTREQHIRREKATSNICTAQVLLAVMASMYAVYHGPDGLTRIARRTHRLAAILAAALRSAGVTVGERFFDTLHVKAIDANAIHARARAAGINLRAIDSEAVGISLDETSTRADVVALAALFGAQADVDALDAATADALPQGLLRTTPFLTHPVFNTHHSEHELLRYMRSLADKDLAMDRTMIPLGSCTMKLNATAEMIPVTWPEFGAIHPLAPAEQSAGYAQLIDELEAMLVECTGYDAVSLQPNSGAQGEYAGLLAIRAYHRSRGEAHRDICLIPESAHGTNPASAQMCGMTVVVTKCDANGNVDVDDIRAKAEKYSDRLAALMITYPSTHGVFEEDVVAICEAVHAHGGQVYTDGANMNALVGVAKPGKWGSDVSHLNLHKTFCIPHGGGGPGVGPCAVKSHLAPYLPKTLGGEGDVGMVSAASYGSASILPISWMYVTMMGSAGLRKATQVALLNANYIAKRLAPHYKTLYTGRNGLVAHECILDVRPLEKTSGIGAEDIAKRLIDFGFHAPTLSFPVAGTLMVEPTESESQHELDRFIDAMIQIREEIRAIEDGRLDREDNPLKHAPHTATQVSASEWTHAYPRELAAFPLPSLKQQKYWPPVARVDNVYGDKNVMCACIPVDAYKEDVEA

SEQ ID NO: 19360 - protein, 803 aa, Flavobacteria bacterium
MNHFLKLWVLIFVITASCDSDMSRISTAKVERSKTNINQDWQYLEHPTQDLNEAILMEGWHSINLPHTWNALDATDLNPGYRRSSSWYKKDLNIETIADNAVYELYFEGVNIVSEVYVNGTKVGGHIGGYIGFTVDITDVVKAGSNEVLVRADNSYDPEVIPSQKSDFFIYGGITRDVWLLTLPETHIDRVKVTPTVSAENASVLINVETSALPKEFIVDCELTSPTGKSVKMTEAVGTDKFTSLSFENIAFPELWSTKTPNLYTLTTTIKNGDKIIDQTEEKVGLRWFEFKDHGAFYLNGERLLLRGTHRHEEHAGVGAAMSNEQHRADIELIKGMGTNFVRLAHYPQDPEVYKACDELGLIVWDELPWCRGGLGNDTWKKNTTNMMKEIINQNYNHPSIVFWSLGNEMYWLPDFEDGDNTVNMNKYLQSLNDLAHEMDPSRVTAIRKYYEGADIVDVFSPSIWSGWYSGSYKSYQKAIDQYKAQYKHFIHTEYGGSSHLGRHTENPITGEGEIKADGWEEAIVQTDVANIAQIGDWSENYMVDLFDWHLRISETDSTFIGNAQWAFKDFGTPLRPENDIPYINQKGLVDRDNNPKDAYYVFKSYWSNEPFAWIESHTWTERQGPKGTKREISVYSNAPEVEFFMNGKSLGTKSKDISKFPASGLTWLVDFKEGKNSMIAVGKTAKGKEVIDELEVNYRFTKNGKAKKLILESKKLDNGNYLITAIAKDSDGLRCLDYEDRVYFQALSGGATMKSLGTPTGSESIRMANGRASIEAIRDTSGAPLEVMVLNQSFKGTYLVID

SEQ ID NO: 19361 - protein, 762 aa, Vibrio vulnificus
MSFRIKTIIGIACIEIIMLMLLVFSAMNFMRQSNQEQFIQKANATSQMFARASKDALLSLDLATLDDLTQEILSLPDILYVDIRNNDQQLAFAGALPKVSADWQADDHVSLGDLVFDVSEKITVDGLTYGEIRMGFNTTAIQTALDEASKAIVLIAVLEIILVALFSYFLGSYLSQNLYQLTRAAERVANDGPGFQLQLKAKDEIGKVAAAFDSMSHNLATSYQELEQARTQAELANESKSRFLASMSHEIRTPMNGVLGLLGILGETKLDNHQQNLVHTAKESGELLLSIINDILDFSRMEANTLILYPRPFELKSCVEEIVNSFEPLAKTKGLYLSLTFNDECDYVVVGDSNRYRQVLLNLLGNAVKFTQKGSVSLHVTTQNEGDKLYIRCEINDTGIGIAPDAMAILFEEFTMVDQGYSRTREGSGLGLAICKRLAQLMEGEINVESEVGKGSCFVFSVEMPLAEHDTVTQQAQPDNDSVCTLLQGKRILVAEDNTANQMVIKAMFERLGVAIDLANDGYEAVSMASNHHYDIIFMDISMPGKDGMQACKEIRQLPDAKQAATPIIALTAHALYGDKEKFLRSGMNGYLSKPLRSRHLIEELNKILSASNHHDTATKPLETEKTNHMQITLTSEKNTTAPLVDELIIQQMIRDTSAEVMPMLIEHYIEESERRLVKIDQAIAHSDFQQLEFELHTLGSSSLALGNRRLSNLARKLERLCVAKEYDAVMEDASGIAQLAHDSLSALNERKQLGFVEPNSI

SEQ ID NO: 19362 - protein, 105 aa, Nostoc punctiforme
MATKKQFNSFEEMLSASDVPVLVDFYADWCGPCQMMVPILEQVNLQLKDRLRIVKIDTEKYTDLATEYKIASLPTLVLFKQGQPVDRIEGVMQAPQLVQYLQTKI

SEQ ID NO: 19363 - protein, 194 aa, Medicago truncatula
MALIAKPNVFNGLNFHINETQFPFSSFSVIRKRFGDSSHRNVVLKSNGNASILPKIRAQNLPDYVPESKFYKVEAILRPWRIPQVSSGLLKMGIRGVTVSDVKGFGAQGGSKERQGGSEFSEDNFVAKVKMEIVVRKDQVEAVINKIMETARTGEIGDGKIFLIPVSDVIRIRTGERGEQAERMAGGLTDALSV

SEQ ID NO: 19364 - protein, 320 aa, Pseudomonas syringae
MSDVRHSRVIILGSGPAGYSAAVYAARANLKPLLITGMQAGGQLTTTTEVDNWPGDPHGLTGPALMERMREHAERFETEIVFDHINSVDLAGKPFSLQGDSATYTCDALIIATGASARYLGLPSEEAFMGKGVSACATCDGFFYRNREVAVVGGGNTAVEEALYLANIASKVTLVHRRETFRAEKILIDKLHARVAEGKIVLKLNATLDEVLGDNMGVTGARLKNNDGSSDELKVDGVFIAIGHTPNTSLFEGQLALKDGYMVVHGGREGNATATSVEGVFAAGDVADHVYRQAITSAGAGCMAALDVERYLDGLANATF

SEQ ID NO: 19365 - protein, 415 aa, Novosphingobium aromaticivorans
MASEVQAERADVVIVGAGHGGAQAAIALRQNGFEGRVLVIGREPEIPYERPPLSKEYLAREKTFERICIRPAQFWEDKAVEMKLGAEVVSLDPAAHTVKLGDGSAIEYGKLIWATGGDPRRLSCVGADLAGVHAVRTKEDADRLMAELDAGAKNAVVIGGGYIGLEAAAVLTKFGVNVTLLEALPRVLARVAGEALSEFYQAEHRAHGVDLRTGAAMDCIEGDGTKVTGVRMQDGSVIPADIVIVGIGIVPCVGALISAGASGGNGVDVDEFCRTSLTDVYAIGDCAAHANDFADGAVIRLESVQNANDMATAAAKDICGAPVPYKATPWFWSNQYDLKLQTVGLSTGHDNAVLRGDPATRSFSVVYLKGGKVVALDCVNMVKDYVQGKKLVEARAQIAPEQLADAGVPLKEMLA

SEQ ID NO: 19366 - protein, 699 aa, Unknown
  Azoarcus sp. EbN1
MPTAIKKTFAYGAHTVTLETGEIARQAGGAVIVNMDDTIVLATVVAAKEAKAGQDFFPLTVDYVEKFYAAGRIPGGFFKREGRPTEKETLTSRLIDRPIRPLFPEGFYNEVQVIITVLSLNPEVDPDIPAMIGASAALAISGVPFDGPIGACRVGYSGGQYLLNPTVEQLKASELNLVVAGTEAAVLMVESEARELSEEVMLGAVVFGHQQMQVAIRAINELVEVAGKPEWDWQPPAKNEPLIARIKELAGAHLEEAFRITSKQARTQRINEIRKQTFGVVADGVEVPPTGNELKDIFHDLEAGVVRSRILAGEPRIDGRDTRTVRPIDIRVGVLPRTHGSALFTRGETQALVIATLGTGRDEQIIDAIAGEYRESFLLHYNFPPFSTGETGRMGVTKRREVGHGRLAKRALIAALPADEDFSYTVRVVSEITESNGSSSMASVCGASLAMMDAGVPMKAHVAGIAMGLIKEGNRFAVLTDILGDEDHLGDMDFKVAGTENGITALQMDIKIQGITKEIMQVALAQAGEGRIHILALMKQALASHRGEVSEFAPRMLTMKINPEKIRDVIGKGGAVIRGLQEETGTVIELQDDGSVTISSVSAEGAQLAKEKIEAITAEVEVGKVYNGTVVRLLDFGAIVNIMPGRDGLLHVSQIANERVNNVADYVKEGQAVRVKVLETDERGKIRLSMKALLDQPAE

SEQ ID NO: 19367 - protein, 179 aa, Oryza sativa
MTTSEREPCPDRILDDVGGAFAMGAVGGTAFHFLRGAYNSPNGHRLSGGSQAVRMSVPRTGGNFAAWGGLFSAFDCAMGPRATATSALVGASLLALVEGAGILLTRTMATLPQEDHAYPFPVVPPPEEVSAHESSPIAWVRGIFGRKEEKPAAAGGDRKSDVLESFETPSPPIPSFDYR

SEQ ID NO: 19368 - protein, 194 aa, Oryza sativa
MGGSHAPSAQIPFPDHIVHEAGTGFALGSPFHFFKGLRGSPRGHRRPGPSARGRPRAAGSFAAFFAAFCVPECGMAYARGGKEESWNFVFAGAATSGFLRLRQGAVTAGRDALWSAAFFALAEGASLAIHRALDDLPPADVPRGLAARAPVGRPRRLPASPGFPGQLIVVKEVAVADNEDDSGFSDGFFAEERQ

SEQ ID NO: 19369 - protein, 414 aa, Unknown
  Rhizobium sp. NGR234
MQFTLPEEGAMHYDCLIVGSGHGGAQAATSLRQNGFQGSIGILSEDRDPPYERPPLSKDYLLGGKTFDRILIRPAEFWTSRSIDLLLGHEVVKVHAKEKQVLCADGATYSYGYLIWSAGGRPRRMSCPGHDLQGIHAVRTRSDVDRLVKDLASAEGVVVVGGGYIGLEAAAALTKLGKTVTVVEAMNRVLARVAAEPLSRFYEREHRDHGVEIRLETGVDKFVGSEGRLTGVLLKDGVTLPADIAIVGIGIVPCVEPLIEAGASGENGLDVDEHCRTSLPDVFAVGDCARVKSAHGLRIESVQNAHDQATAVAKTLCGELTPYSATPWFWSNQYDLRLQTVGLSAGFDRTVVRGDPNTRSFSIVYLREGAVIALDCINSVRDYVEGRMLVERRARVSPDVLANNSIRLKSLALA

SEQ ID NO: 19370 - protein, 177 aa, Vibrio cholerae
MKHTVEVMISEQEVAQRIRELGQQITEHYQGSSDLVLVGLLRGSFVFMADLARQIHLTHQVDFMTASSYGNSMQSSRDVRILKDLDDDIKGKDVLLVEDIIDTGNTLNKVKEILALREPKSIRICTLLDKPTRREVDVEVNWVGFEIPDEFVVGVGIDYAQKYRHLPYIGKVVPLAE

SEQ ID NO: 19371 - protein, 226 aa, Caulobacter crescentus
MVKPPAGGNEGGRGKPARLKTAYGRTPSQQAWLERQINDPFSAKARALGYRSRAAFKISEIDDKFHFFSKGAKVIDLGCAPGGWLQIAVERGVTTLAGIDLLPVDPVAPAHLLEMDFTADGAPEKLLELLGGEPDLVMSDMAPNTVGHRETDHLRIVGLIEIAAEFAIDVLKPGGAFVAKAFQGGETAEIIGKLKRHFDKVQHFKPKASRQDSSEVFLVATGFKGR

SEQ ID NO: 19372 - protein, 276 aa, Candida glabrata
MEEAAADAYKLSYKVGVAENKNAKFRRTMEDVHTYVKNFASRLDWGYFAIFDGHAGIQASKWCGSNLHTIIENKLMADETKDVRDVLNESFVMIDKQINKDLQGNSGCTAAVCVLRWELPDGCTEQEEMDLTKHKRKLYTANVGDSRIVLFRNGQSIRLTYDHKASDPLEMQRVEKAGGLIMKSRVNGMLAVTRSLGDKFFDSLVVGSPFTTSVEITPADQFLIIACDGLWDVIDDQEACEMIQDIEDPHEAARALVRNALERGTTDNVTVMVVTL

SEQ ID NO: 19373 - protein, 652 aa, Triticum aestivum
  misc_feature (612)..(612): Xaa can be any naturally occurring amino acid
MMGGGLLMDQGMAFSGVHNFVDLLQQNGADKNLGFGSLMPQTSSGDQCVMGEGDLVDPPTNNFPDAGEDDSDDDVDDIEELERRMWRDRMKLKRLKELQQSRGKEQAAGGGGAGDGLKPRQSQEQARRKKMSRAQDGILKYMLKMMEVCRAQGFVYGIIPEKGKPVSGASDNLRAWWKEKVRFDRNGPAAIAKYQADNAVPGSESELASGTASPHSLQELQDTTLGSLLSALMQHCDPPQRRFPLEKGISPPWWPSGDEEWWPELGIPKDQGPPPYKKPHDLKKAWKVSVLTAVIKHMSPDIEKIRRLVRQSKCLQDKMTAKEISTWLAVVKQEEELFMRLHPGARPPASAGGIASAISFNASSSEYDVDVADDCKGDEAGTHKMAMADPTAFNLGAAILNDKFLMQAPMKEETADMEYVQKRSAVAAEPELMLNNRVYTCNNVQCPHSDYGYGFLDRNARTNHQYTCKYNDPLPPSAENKAAPPAPPQVFPAAYNQPNHGLNNLDFGLPMDGQRSIAELMNMYDTAFPANNKNMGNDDVTIIERPNAITPVTQMDEGFFGQGNGIGGNGDSMFSDVSNMMQQQQQQPQQPQQQQQQAPAQQQFFIRDDARXQFGNQMGSISGASDFRFGSGFNMSGTVDYPQKNDGPNWYY

SEQ ID NO: 19374 - protein, 568 aa, Desulfovibrio desulfuricans
MPQNIVVIGAVALGPKAACRFKRLCPEDNVIMIDQSDRISYGGCGIPYYVSGEVNTLEELQMTPYHTIRDAEFFRVNKDVKVLARTKVESIDRQAKKVLIRDLTTGETAELPYDKLVLAMGSAPNRPPFEGIDLEGVHTCTTLDDAQAIREAVAAGSVSGAVVVGGGFIGLEVAVSLADMWGIKTSVVEIADQILPGFLSGNMVKIATHDLRKNDVDVFCGEKVIRIEGENGKVARVVTDKRTIDAELVVMAAGIRPNTEIARAAGIELNERGAIIVNDRMQTSDPDIYAGGDCVTVPNLVTGKPGFFPLGSMANRQGRVIGTNLAGGDARFPGGVGTWAVKLFEQNAAGAGLTIESALREGFDAVNVHVEGFDRAHFYPEHTVMALDLVVERPTRRVLGIQGTSSLGDALVARINAVAPLLQNKPKLEDISNLEVAYSPPFASAMDIINTVANVAENVLEGRNHTLDPDEFAVMWQNRESGSCTFVDTRLASNAESLVEKYPGQWLSIPLEEMEQRLDEIPEDKTVVLICNTGLRSFESQLIMNRHGRKSLSVQGGMASVTKQGNEI

SEQ ID NO: 19375 - protein, 612 aa, Gibberella zeae
MPSQKNSNGTGQVSHRLRNFFRMNTGGSTGSASSDKEKDKDKEKNSASTTPDPSKPRHTKFFSNTVGRLRAHTVASEGNQLEEAMSPTAHANPYFAHQGQPGLRHHNSDSVPPSPPDTPSLKVHGPDGTPATDQTTSETKEELARRLRRVASAPNAQGLFSKNDPNNERPATAELGKDPLLTSSGALGLIEPAKTPQNEEMPTHANPEDILAALPAPNMSMAFRRTYSSNSIKVRNVEVSPSSFDKIKLIGKGDVGKVYLVREKKSSRLYAMKILSKKEMIKRNKIKRALAEQEILATSNHPFIVTLYHSFQSEDYLYLCMEYCSGGEFFRALQTRPGKCIPEEDARFYAAEVTAALEYLHLMGFIYRDLKPENILLHQSGHIMLSDFDLSKQSDPGGKPTMIVGKNGARTDALPTIDTRSCIANFRTNSFVGTEEYIAPEVIKGSGHTSAVDWWTLGILIYEMLYGTTPFKGKNRNATFANILREDIPFPDHAGAPQISKKLLIKDENRRLGARAGASDIKAHPFFRTTQWALIRHMKPPIVPHAGRGVDTVNFRNVKESESVDLSGSRAMNLKGVPLDSGLATPGGEIADPFLEFNSVTLHHDGDDDHHR

SEQ ID NO: 19376 - protein, 240 aa, Trichodesmium erythraeum
MTESQTNFTKYPSFNISELEYQLESGSEKKQLQVIPNLAKIGDEGVEILMEFLQKKKLDSPTIVKGKIYQVLRQIKSSKVDEFIQKNFPLGVVPINSASNIDYSHLQVKLAHQDFLEADKLTMQKLCELVGEAAIQRKWLYFSEVDSIPIPDMKTINNMWLIYSEGKFGYSVQREIWLGSGKNWDKFLPKIGWKNGNTWSRYPNEFTWNLSAPKGHLPLSNLLRGVRMFASILSHPAWSK

SEQ ID NO: 19377 - protein, 482 aa, Vibrio parahaemolyticus
MKGDIGVIGLAVMGQNLILNMNDHGFKVVAHNRTAAKVDEFLEGPAKGTNIIGAYSLEELVEKLETPRKVMLMVRAGDVVDKFIDALVPLLDKGDIIIDGGNTNYPDTNRRVAALREKGIHFIGTGVSGGEEGARFGPSIMPGGAPEAWEAVKPIFQGISAKTDAGEPCCDWVGNDGAGHFVKMVHNGIEYGDMQLITEAYQFMKDGLGMSADEMQAVFAEWNNTELNSYLVEITADILGYKDEDGEPLVEKILDTAGQKGTGKWTGINALDLGIPLTLISESVFSRCLSALKDQRVEAEKLFGKTITPVEGDKQEWVDALRQALLASKIISYAQGFMLMREASNENGWDLNYGNVALMWRGGCIIRSAFLGNIRDAYEANPELAFLGSDDYFKGILQSSLVAWRKVAAKSLEAGIPMPCTTSALTFLDGYTTARLPANLLQAQRDYFGAHTYERIDRERGEFFHTNWTGTGGNTASTTYDV

SEQ ID NO: 19378 - protein, 174 aa, Solanum lycopersicum
NCVGFVCPEYFKSDFVYRTLWLQDSPSEDITSILYDVFDYFEDVREQHGKVFVHCCQGVSRSTSLVIAYRMWREGQSFDDAFEYVKAARGIADPNMGFACQLLQCQKRVHASPLSPSSLLRMYRVAPHSPYDPLHLVPKMLNDPSPAALDSRGAFIIHIPSSVYVWIGKKCEAI

SEQ ID NO: 19379 - protein, 73 aa, Ralstonia eutropha
MAKEELIEFGGVVSEALPDNRYRVLLENGVEIWAYASGKMQKHRIRILAGDRVTLEMSPYDLTKGRINFRHKS

SEQ ID NO: 19380 - protein, 419 aa, Desulfovibrio vulgaris
MNIASQIEDMGRRARAAGRRLAAASPAAKAGALDHLATLLEQRQDAILAANAADLAAAAEAGMDAPRMDRLRLTPATIAEMAAACRHVAALPDPVGAIETQWQRPNGLLVGKMRIPLGVIAMIYESRPNVTIDSAILCLKAGNAVILRGGSEAIHSNLALAALITEALSSVGLPAEAVQVVSTTDRAVIAELCKLEEHIDVIIPRGGETLIRAVVDMARMPVLKHYKGVCHAYIDSGADLAQAVEIIHNAKVQRPGVCNALEGLLVHRDEAAAFLPAIAERLGNDGVEFRACPASLPLLGDSAIPMKDEDNGQEFHDLILLVRIVDDMDEALAHIAAYGSNHTEIICTRDHGNAMRFLREADASMVAVNASSRFNDGGQLGLGAEIGISTSKLHSYGPMGVQELTTTKFVVFGAGQIRQ

SEQ ID NO: 19381 - protein, 325 aa, Zea mays
MGEASPSIAKDVTELIGNTPLVYLNKVTDGCVGRSRAKLESMEPCSSVKDRIGYSMITDAEEKGLITPGVSVLIEPTSGNTGIGLAFMAAAKGYKLTLTMPASMSMERRIILKAFGAELVLTDPLLGMKGAVKKAEEIQAKTPNSYILQQFENPANPKIHYETTGPEIWKATAGKIDGLVSGIGTGGTITGTGRYLREQNPNVKLYGVEPVESAVLNGGKPGPHKIQGIGAGFIPGVLDVDLLDETLQVSSDEAIETAKALALKEGLLVGISSGAAAAAAVRLAKRPENAGKLFVVVFPSFGERYLSSVLFQSIKKEAESMVVEP

SEQ ID NO: 19382 - protein, 84 aa, Glycine max
  misc_feature (10)..(11): Xaa can be any naturally occurring amino acid
  misc_feature (15)..(15): Xaa can be any naturally occurring amino acid
  misc_feature (17)..(17): Xaa can be any naturally occurring amino acid
  misc_feature (20)..(24): Xaa can be any naturally occurring amino acid
  misc_feature (33)..(34): Xaa can be any naturally occurring amino acid
  misc_feature (39)..(40): Xaa can be any naturally occurring amino acid
  misc_feature (43)..(44): Xaa can be any naturally occurring amino acid
MTKRYGNIIXXGMMXGXGHXXXXXLGRWNARMXXLYMLXXRGXXMMNVRGTGRVLSEACDLVFDAGSEGKRFLIGGYKKKSRGI

SEQ ID NO: 19383 - protein, 977 aa, Xanthomonas axonopodis
MSQTPSSLRDLEHHSAFVERHIGPNDAEIAQMLDVVGHASLDALTDAIVPGNIKSPAPLALPEAITEEEALAKIRAIASKNQVQRNFIGQGYYGTHTPKVILRNILENPAWYTAYTPYQAEISQGRMEALINFQTLCADLTGMQIANASLLDEATAAAEAMTLAKRSAKSKSNTFFVHDAVHPQTLELLRTRAEPLDIVLRVGTPEEALQAECFGVLLQYPDSFGHIGDHAALADAVHAQGGLVAVATDLLALTLIAAPGEWGADIVVGNSQRFGVPFGFGGPHAAFMACRDAYKRSMPGRLIGVSIDAAGNPAYRLTLQTREQHIRREKATSNICTAQVLLAVMASMYAVYHGPDGLVRIARRTHRLAAILAAALRSAGVSVGDRFFDTLHVKAIDADAIHARARAAGINLRAIDSEAVGISLDETTTRADVVALAQLFGATADVDALDAATADALPQGLLRTTPFLTHPVFNTHHSEHELLRYMRSLADKDLAMDRTMIPLGSCTMKLNATAEMIPVTWPEFGAIHPLAPAEQSAGYAQLIDELEAMLVECTGYDAVSLQPNSGAQGEYAGLLAIRAYHRSRGQAHRDICLIPESAHGTNPASAQMCGMTVVVTKCDANGNVDVDDIRAKAEKYSDRLAALMITYPSTHGVFEEDVVAICEAVHAHGGQVYTDGANMNALVGVAKPGKWGSDVSHLNLHKTFCIPHGGGGPGVGPCAVKSHLAPYLPRAGIHAGEGQTAAIHGGGFNSESGNGHSSRIGGMVSAAAYGSASILPISWMYVTMMGSAGLRKATQVALLNANYIAKRLAPHYKTLYTGRNGLVAHECILDVRPLEKTSGIGAEDIAKRLIDFGFHAPTLSFPVAGTLMVEPTESESQHELDRFIDAMIQIREEIRAIEDGRLDREDNPLKHAPHTATQVSASEWTHAYPRELAAFPLPSLKQQKYWPPVARVDNVYGDKNVMCACIPVDAYKEDAEA

SEQ ID NO: 19384 - protein, 784 aa, Oryza sativa
MTPARRMPPVIGRNGVAYESPSAQLPLTQADMLDSHHLQQALQQQYFDQIPVTTTAAADSGDNMLHGRADAGGLVDEFESKSCSENVDGAGDGLSGDDQDPNQRPRKKRYHRHTQHQIQEMEAFFKECPHPDDKQRKELSRELGLEPLQVKFWFQNKRTQMKNQHERHENAQLRAENDKLRAENMRYKEALSSASCPNCGGPAALGEMSFDEHHLRVENARLRDEIDRISGIAAKHVGKPPIVSFSVLSSPLAVAAARSPLDLAGAYGVVTPGLDMFGGAGDLLRGVHPLDADKPMIVELAVAAMDELVQMAQLDEPLWSSSSEPAAALLDEEEYARMFPRGLGPKQYGLKSEASRHGAVVIMTHSNLVEILMDVNQFATVFSSIVSRASTHEVLSTGVAGNYNGALQVMSMEFQVPSPLVPTRESYFVRYCKNNSDGTWAVVDVSLDSLRPSPVQKCRRRPSGCLIQEMPNGYSKVTWVEHVEVDDSSVHNIYKPLVNSGLAFGAKRWVGTLDRQCERLASAMASNIPNGDLGVITSVEGRKSMLKLAERMVASFCGGVTASVAHQWTTLSGSGAEDVRVMTRKSVDDPGRPPGIVLNAATSFWLPVPPAAVFDFLRDETSRSEWDILSNGGAVQEMAHIANGRDHGNSVSLLRVNSANSNQSNMLILQESCTDASGSYVVYAPVDIVAMNVVLNGGDPDYVALLPSGFAILPDGPSGNAQAAVGENGSGSGGGSLLTVAFQILVDSVPTAKLSLGSVATVNSLIACTVERIKAAVCRDSNPQ

SEQ ID NO: 19385 - protein, 170 aa, Brassica napus
MMASSQALLLLTLTMVLIPFSLAQSPMMAPSGSMSMPPMPSGGSPMPMMTPPPMPMMTPPPMPMTPPPMPMAPPPMPMTPPPMPMAPPPMSMATPPMMPMTPSSSPMSPPTTPMSPGPSPAISVPDMASPPTPAMESSPSPGPGPMPPAMSSPDSGAFNVRIDVVALSFL

SEQ ID NO: 19386 - protein, 406 aa, Coprinopsis cinerea
MRDRLKSAPSQPDPSKIPFRRTYSSNSIKVGRVEVGPSSFLKVKMLGKGDVGRVYLVREKKTNKLYAMKVLSKKEMIERKKIKRALTEQEILATANHPFIVTLYHSFQSEGYLYFCMEYCMGGEFFRALQTRPGKCLPEDGSRFYAAEVVAALEYLHLMGFIYRDLKPENILLHQSGHIMLSDFDLAKQSAEYGGLPSMVHSEQNGVPLVDTMSCTANFRTNSFVGTEAIPEYIAPEVIAAQGHTAAVDWWTLGILIYEMIYATTPFKGQERNETFNNIRHQPVTFRDSPKISSAGKDCMTRLLDKNERTRLGSRSGASEVKQHKWFSKINWGLLRNTRPPIVPSSSNGLDAAHFRHMRESTSLHLDLEDQSKAQPSADLLADDGQPADVLFKAFNSITLHHDGDT

SEQ ID NO: 19387 - protein, 132 aa, Geobacillus kaustophilus
MSIEVGSKLQGKVTGITKFGAFVELPEGVTGLVHISEVADNYVKDINDHLKVGDMVYVKVINVGQDGKIGLSIRKAKDTPSSQRPRHRTNDRSAADSLEQKISRFLKESEDRLASLRRHTESKRGGRGARRG

SEQ ID NO: 19388 - protein, 446 aa, Shigella boydii
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRD

SEQ ID NO: 19389 - protein, 96 aa, Escherichia coli
GSHMLEQKKANIYKGKITRIEPSLEAAFVDYGAERHGFLPLKEIAREYFPANYSAHGRPNIKDVLREGQEVIVQIDKEERGNKGAALTTFISLAGS

SEQ ID NO: 19390 - protein, 429 aa, Arabidopsis thaliana
  misc_feature (133)..(133): Xaa can be any naturally occurring amino acid
  misc_feature (168)..(168): Xaa can be any naturally occurring amino acid
MEEYRLGELRHLLTTVFLSGFSEFLVKPVMTDVTVAAVCSGLNETCSLAVYLTGVEQVTVGLGTMVMMPVIGNLSDRYGIKTLLTLPMCLSILPPAILAYRRDTNFFYAFYITKILFDMVCQGTVDCLAHAYXKRISMFGVLAGVRSISGVCATFSARLLPIASIFQXISFFFGLVYMRVFLKERLHDDDEDDCDEDDNTSGRNHHDGGDLTMLAEPILRDAPTKIHIVLNTKYSSLKDMVSLIKNSTILVQTLVVTFFATFAQSGMQSAFLYFLKARFGFNKNDFAELILLVTIIGSISQLFILPKLVSAIGERRVLSTGLLMDSVNAACLSVSWSAWVPYATTVLVPVTMFVMPSVCGIASRQVGPGEQGKVQGCISGVKSFSGVVAPFIYSPLTALFLSEKAPFYFPGFSLLCVTFSLRSNYHIEP

SEQ ID NO: 19391 - protein, 235 aa, Glycine max
  misc_feature (66)..(66): Xaa can be any naturally occurring amino acid
  misc_feature (104)..(104): Xaa can be any naturally occurring amino acid
MAGDGELKLLGVWTSPFVIRVRVVLNLKSLPYEYVEENLGSKSALLLGSNPVHQSVPVLLHGGRPXVNESQVIVQYIDEVWAGAGPSVLPADPYERATARFWAXYVDDKVGSAVERGCSSPCKTEEERAEAVSRAVAALETLEGAFAECSKGKAFFGGDAIGFVDVVLGGYLGWFGAIDKIIGRRLIDPARTPLLARWEERFRAADAAKGVVPDDADKMLEFLPTVLAWIAGKAK

SEQ ID NO: 19392 - protein, 388 aa, Mycoplasma penetrans
MSSKRDYYEVLGVSKDATDDQIKSAFRKKAMQYHPDRNKEPDAEEKFKEVNQAYEVLSDPDKRANYDRFGHEGVDGQFGGGAGFDPFDIFNQFFGGGRGGGAHFEQSFGGSGFEDIFSNFFGGGRRGASSQQREANLVVSIVLTFVESVVGVKKTIEYKIEKDCESCHGSGADNSEGSISTCSNCNGSGVEITQKRTIMGIIQSQNICSRCNGEGKEIHKKCNSCKGRKVHEERVEIDVEIPGGVSNDEHLKVSGKGSVVGGKTGDLYINIQIKPSKIFSRKGNDIYVILKVDPILAIVGGEANIPTPFGIKSIKMKPGTRNGEIITVPSHGVKSTKRFGSNGDLFAVVEYTSAKRFSSAELKSLSKFAQETNDEIEKYLKEARKEIN

SEQ ID NO: 19393 - protein, 268 aa, Pseudomonas syringae
MRIALYQCPPLPLDISGNLARLEQQAVSAAAQGANVLICPEMFLTGYNIGAQAVSELAQAHDGSAATRIAAIAKANGIAILYGYPERDTDQQVYNAVQLIDEHGVSLCNYRKTHLFSELDRSMFSAGADYFPVVELNGWRLGMLICYDVEFPENTRRLALAGAELILVPTANMAPYDFVCDVTVRARAFENHCYVVYANYCGSEGEIRYCGLSSLCAPDGSRPLLAGQDEGLLVGTLDKALLAQARTVNDYFVDRRPELYTSLTRARD

SEQ ID NO: 19394 - protein, 481 aa, Methylobacillus flagellatus
MTKSLVWFRRDLRDYDHAALYHALKDSEQVVCAFVFDTDILDGLPRDDRRVEFIWESVRELKLALQERGGDLLVRHGKATEEIPALASVLGVECVYCNRDYEPAAVKRDDTVSQQLGTQGIAFKSFKDQVIFERDEIMTKSGTPFSVFTPYKNACLRKLDDFHLKAYPVDRYIHHLAQSAPQPMPSLESLAFARSNLKQLRLPTGMSGGMALFEDFSERMPRYRDARDFPALKGPSYLSVHLRFGTVSIRHLARTAWQQGGAGAETWLNELLWRDFYFQVLYHHPQVAEGHSFKPEFEHIPFPNGESLFKAWCEGRTGYPLVDAAMRQINQTGYMHNRLRMVAAGFLVKDLLIDWRWGERYFAEKLIDFDLAANNGGWQWAASTGCDAQPWFRIFNPVTQSEKFDPEGKFIRKYVPELQPCDDKEIHAPWLIPPLRQQALGLVIGKDYPAPVVDHAMRREQVLSLYRQASSRKKWPASSVL

SEQ ID NO: 19395 - protein, 193 aa, Geobacillus kaustophilus
MGMKDDIQKVLITEEEIQAKVKELGGLLTKEYEGRFPLAVGVLKGAMPFMADLLKHIDTYLEMDFMDVSSYGNATVSSGEVKIVKDLNTSVEGRDILIIEDIIDSGLTLSYLVDLFRYRKANSIKIVTLLDKPSGRKADIQADYTGFTVPDEFVVGYGLDYAEKYRNLPFIGVLKPEVYQSRTVAGRRPNCLY

SEQ ID NO: 19396 - protein, 618 aa, Glycine max
MMMMFDEMGLCNNLDMISAPLGEEDITTRQTDPEVIVEDDFTDEEIGVDELEQRMWKDKMRLKRLKEQSKSKEGIDAVKQRQSQEQARRKKMSRAQDGILKYMLKMMEVCKAQGFVYGIIPEKGKPVTGASDNLREWWKDKVRFDRNGPAAIAKYQADNTIPGRNDGCNSIGPTPHTLQELQDTTLGSLLSALMQHCDPPQRRFPLEKGVPPPWWPTGNEEWWPQIGLSKDQNSPPYKKPHDLKKAWKVGVLTAVIKHMSPDIAKIRKLVRQSKCLQDKMTAKESATWLAIINQEEALARELYPDYIPPLASAGGSGSLVINDSNEYDVEGGEDEPNFDVEDCKHENLHTSNLGMERVRVTLPVQQPSFSIKGETVTNLDFIRKRKVSNDFNMMDLKIYTCEHPQCPYSQVRLGFPDRISRDNHQLICAYRGTSDFGGPSFPVNEIKPVVHPPSFVQPKSTAQPGSMVPPVIDLTGLEVSDNGQKMITDLMTNYDTNVRGNKKTSSCNHLAAENFDLPQHAMQQQQDNFIRGQGITAEGNIFDEANMPNNHHMFAREEGQFDRFKALNAPFETNHNNNNFHSMFGSLCDLASFDFKEDMQGVGMDTLQKQPDISIWYQ

SEQ ID NO: 19397 - protein, 367 aa, Nostoc punctiforme
MTKTIVVKIGTSSLTQAETGQLALSTIATLAETLCHLRSQGHRVILVSSGAVGVGCARLGLTERPRAIALKQAVAAVGQGRLIRIYDDLFTTLQQAIAQVLLTRSDLVQRSRYLNAYNTFQELLGLGVIPIVNENDTVAIDELKFGDNDTLSALVASLIEADWLFLLTDVDRLYSADPRSVPDARPIALVSSIKELAELQIGSQGSQWGTGGMVTKISAARIAIAAGVRTVITQGRFPQNIEKIIQGELIGTHFEPQPEPTSARKRWIAYGLLPAGKLYLDEGAIAAISLAGKSLLAAGIKLVEGEFDTQDAVQLCDSNGNEIARGLVNYNSNDLQKIRGCHSREISTILGYAGAETVIHRDNLVLI

SEQ ID NO: 19398 - protein, 181 aa, Secale cereale
MSSTGAAGPDADAPAGEGLELAQFGAGCFWSVELAYQRLPGVARTEVGYSQGHLDGPTYRDVCGGGTGHAEVVRVHYDPKECSYAVLLDVFWAKHNPTTLNKQGNDVGTQYRSGIYYYTAEQERQARESLAEKQQEWKEKIVTEVLPARKFYPAEDYHQQYLEKGGQSAKKRCSDPIRCYG

SEQ ID NO: 19399 - protein, 400 aa, Magnaporthe grisea
MHIKYLVTLLGFQQLVSALPMQLAQNGAAAPQAQALDQGKKKGKDGKDGKEMITSALEQVMTVLKNLDTAINNIDPKDLTTAQPLLTVAQTSMGTFQEANAKIQAAPKLGLIDSLSIAQSASGLGDQVKQTLGDIVKKKPVFDMLGVSPLIRDQLVTQKAQTGGLQEAVVSKLPAIARPIAEMQTKDITKVVDDAIETYSQPPANPPPKAAPPPPKTSPPPAPAPAPAPAPPASPPKPPSPAPAPAPPANPPKPPSPAPAPAPPASPPATPPKSPSPAPPANPPANPPANPPKPPSPAPAPAPAPAPAPAPVPAPAPAPKPEPPKQPGTPGTPGTPGTPGTPGTPGTPGTPGTPGQPAPAPAPKPPSPAPPPGTPAPAPVPAPATPPQPPSVPKPPNNVN

SEQ ID NO: 19400 - protein, 205 aa, Hyphomonas neptunium
MRTLLLAAAAACLTACSNAALPQAASAEPAARAQAAENEAIAVFAGGCFWCIEAELEEVPGVRTVVSGYTGGTTPDPTYERMGDHAEAVEVIYDPAEVTYDQLLEVFWSNIDPTDEGGQFYDRGSQYRTAIYVLDDAQAAAARASLEANAKRLNQPIATAVIPATEFYPAEEYHQDYYLKEPDRYEAYKKGSRREETLKEVWQTE

SEQ ID NO: 19401 - protein, 488 aa, Bdellovibrio bacteriovorus
MKLPHVKIVPAVIAFFVTCLFWFVISPPEGVDLNAWRLLGIFVGTITAIIGKALPIGGAAMIGILLVGITQVTSPGNPGKAMGDALSGYSNTLIWLIGISFFISRAFIKTGLGSRVAYYFVRAIGKKTLGISYGLSFAELVLSPVMPSNTARGGGVLYPINRSISESMGSRPDEATRLKVGAFLTLVAYQINVITSAMFITATAPNPLVTAGIRDIAKIDVSWAQWAMAAFVPGLLAILIIPWVLFKLYPPQIKETPDAAGYANKKLQELGPLRLDEKILIGVFFLLLFIWAGGPELLSSDPLFKVDATAGAFVGLGVLLFSGVLTWDDLLKEKGAWDTVTWFSSLVMLATFLNKLGVVAWFSKTVESSIAHWGLGWMEAAAILVLLYVFIHYFFASNTAHISALFASFFGVGVALGAPPLMFGLFLGFASSLCASLTHYGTGSAPVLFGSGYVTMGEWWKWGFVVTLLNLLIFAGGCAVWWKVLGYW

SEQ ID NO: 19402 - protein, 92 aa, Chlamydomonas reinhardtii
  misc_feature (42)..(45): Xaa can be any naturally occurring amino acid
SAVETYKLYIYKVLKQVHPDTGISSKAMSIMNSFINDIFEKXXXXASKLSRYNKKPTVTSREIQTAVRLVLPGELAKHAVSEGTKAVTKFTS

SEQ ID NO: 19403 - protein, 407 aa, Parvularcula bermudensis
MPSDIQGALSRLSPLLDYEQHLQSIVGLLQSPTELIQRQLIIEREDGRSDALDAWRCRYNDFLGPTKGGLRFSPGVNADEVQRLAFLMTLKCALVGLPFGGAKGGVKVDISQCNDRERARIAHEFGRRFSDILGPERDIAAPDVGTGAPEMAAIARGYDRMGAGRGVVTGKPLDLGGIDLRFGATGKGAAIVVQSMRETLGLAEGKSARIAIQGFGGAGQAFARAMAENGDDLVAFADSTGTVSDPDGLNVEDMIEAKGQGNLSYTEESEAIFDKECDILCLAALGDAINRDRADRVGAKAVIEISNAGVAPEADASLRAKGVKICPDILVNAGGVIASYHEWVAYRTGNAQAIGDAEAQWRKSLISAASAVTEKCSVTDGDLRQAALLCALSRLDGAARHQGVYHR

SEQ ID NO: 19404 - protein, 370 aa, Anthurium andraeanum
MVPAATPFLPTTAEEATLRPSFIRDEDERPKVPHNQFSDAIPVLSLAGIDDSDGSPRRAELCREIVEACEGWGIFQVVDHGVDPGLVADMTRLATEFFALPPEDKLRYDMSGGKKGGFIVSSHLQGEAVQDWREIVTYFSYPVRARDYTRWPDKPEGWRAVVEAYSEGLMGLACKLLGVLSEAMGLDKEALAKACVDMDQKVVVNFYPRCPQPDLTLGVKRHTDPGTITLLLQDQVGGLQATRDGGKTWITVQPVEGAFVVNLGDHGHLLSNGRFKNADHQAVVNSERSRLSIATFQNPAPEGVVYPLAVREGEKPVLDEPISFSEMYRRKMSRDLELARLKKQAKLQQQDVLAKAEDANKHKALDEILA

SEQ ID NO: 19405 - protein, 376 aa, Flavobacteria bacterium
MTDFYDILGISKGATAAEIKKAYRKKAIEFHPDKNPGDATAEENFKKAAEAYETLSDPQKKARYDQLGHQAYTSGGAGGFGGGGFGGMDMDDIFSQFGDIFGGGGFSGFGGGGGFGGGGRRRVKGKDLRIRVSLTLEEAAVGVEKKVKVKRKKQAPGVTYKTCTTCGGSGQVTRIQNTILGRMQTSAPCNVCGGAGQTMDKKPAGADAQGLIIDEETVSIKIPAGVETDMRLKVSGKGNEAPGNGVSGDLLVDIEVKEHAELQREGNNLHYDLYVSVPEAVLGTTKEIQTVTGKVRIPIEAGIQSGKILRLRGKGMPSVNGYATGDLLVHVNVWTPRNLSRDQKEFFESMMADSHFEPAPEKGDKSFFEKVKDMFS

SEQ ID NO: 19406 - protein, 202 aa, Triticum aestivum
  misc_feature (125)..(125): Xaa can be any naturally occurring amino acid
RGGWVVFLWPRNHWVALRWRREAASERGGGSTFELLRAAAGEKTRVLPGEWPTRSSTAVVGVVAFFTKVVYGSMVNQLRITAGVFIVMQQLAEGNGGHYEAIFSIFFGGYDHIIVQGASLTSEEXSLVVVGGSGVFEEASDQLKIIQLVFPFKMFFTFFLKDIIDVPKEVLFSAAVVPSSTVEDTTAAKNAEAPASLSNFSA

SEQ ID NO: 19407 - protein, 143 aa, Zygosaccharomyces rouxii
ATQATSAQTIDIHTGIGFLDHMIHALAKHSGWSLIVECIGDLHIDDHHTTEDCGIALGDAFKQALGQVRGVKRFGFGFAPLDEALSRAVVDLSNRPCSVIELGLKREKIGDLSCEMIPHFLESFTEAARLTVHVDCLRGFNDH

SEQ ID NO: 19408 - protein, 486 aa, Zea mays
MACLEAPPRVELCPVSCQPRGLQLPPWRLSLSRSSSSCRSCTLVSRQLPICNAQSYADDLWVAAPHSPASVRSRLLAAEREEAKAVLSLFLRQKGLRSTLAARIVNKSDGFIEHLVSKLQIAYRSRYAEGRELSTPEIRDALLPYLEALSKEHGDSLVEVVENFPDPFAMEREALSSSMAFTPTSSNKQKAIARISTAASGAALPELVPYLLDLGMDHEEIKDIVRKFPAFAYYSVDRKIKPLVELLLELGVKNSSIPGIIKKRPQLCGISMSDNLKPMMAYLESIGVDKAQWSKVITRFPALLTYSRNKVQTTVSFLAELGVSEKSIGKILTRCPHIMSYSVDDNLRPTAAYFRSIGADAASLIQKSPQAFGLNVEAKLRPTTDFFLARGFSVEEVGVMANRFGIVHTLSLEENLLPKYEFFLAMEYPRCELVKFPQYFGYSLDRRIKPRYARMTGCGVRLILNQMLSVSDARFEKILEKKTARL

SEQ ID NO: 19409 - protein, 225 aa, Ralstonia eutropha
MAKGKSKNKFNQSWLHDHINDPYVKMAQREGYRARAAYKLKEIDEQDKLIQPGQVIVDLGAAPGSWSQYARNKLAASPRATGGKPDGAVVAIDILPMEPVADVTFIQGDFREEDVFRQLEEVVMAASGGAKIDLVLSDMAPNLSGVASADSARIEYLCDLALDFAQTHLKPDGALLVKCFHGSGYSQIVEKFKRQFKVVAPRKPKASRDKSSETFILGRYLKVVN

SEQ ID NO: 19410 - protein, 429 aa, Clostridium perfringens
MKRSLINELKNHLNENVCIKGWIYKIRRLKFITFIIIRDRSGLVQCVAENEKLDLSNLTVESVVSIEGALKESKNSLNSFEIQVENIEIINKAKEELKIEVNKETLDINLDTMLNNRMLSLRHKKINAIFKVQNIITDSFREFLNKEGFTEIHTPKIVKEGAEGGTEVFEVKYFENKAYLAQSPQFYKQMMVGAGFERVFEIGHAYRAEEHNTNRHLNEYVSMDLEMGFIENEFDIMNLEENLLKFILNSLRIKGKEYLELLQVELPVIYEEIPKIEFNEAIEILKEQYNKNDLDGDLDPEAEKLLYKYAKEKLNSDFLFLTNYPRKKRPMYTMPKGEKGTHSFDLLFRGIEITTGGQRIHDYEMLVENMKYKGLNPNSYESYLELFKLGMPKHGGLAIGLERITARILGLENVREATLITRDRKRLVP

SEQ ID NO: 19411 - protein, 418 aa, Streptococcus pneumoniae
MIFDKDDFKAYDADLWNAIAKEEERQQNNIELIASENVVSKAVMAAQGSILTNKYAEGYPGRRYYGGTDVVDVVETLAIERAKEIFGAKFANVQPHSGSQANCAAYMSLIEPGDTVMGMDLAAGGHLTHGAPVSFSGQTYNFLSYSVDPETELLDFDAILKQAQEVKPKLIVAGASAYSQIIDFSKFREIADAVGAKLMVDMAHIAGLVAAGLHPSPVPYAHITTTTTHKTLRGPRGGLILTNDEELAKKINSAIFPGIQGGPLEHVVAAKAVSFKEVLDPAFKEYAANVIKNSKAMADVFLQDPDFRIISGGTENHLFLVDVTKVVENGKVAQNLLDEVNITLNKNSIPYETLSPFKTSGIRIGAAAITARGFGEEESRKVAELIIKTLKNSENEAVLEEVRSAVKELTDAFPLYED

SEQ ID NO: 19412 - protein, 311 aa, Oryza sativa
MSGELKRDYEIGEEIGRGRFGVVHRCTSRATGEAFAVKSVDRSQLADDLDRELAELEPKLAQLAAAGNPGVVQVHAVYEDDAWTHMVMDLCSGPDLLDWIRLRRGAPVPEPVAAAVVAQLAEALAHCHRRGVAHRDVKPDNILLDVVDDGIDGGGTPRARLADFGSAAWVGESGGSAEGLVGTPHYVAPEVVAGGEYGEKADVWSAGVVLYVLLSGGALPFGGETAAEVLASVLRGSVRFPPRLFAGVSPAAKDLMRRMMCRDTWRRFSAEQVLGFRSKRTNHLIACRAVRNAGHPWIVSGGGARAMEQPT

SEQ ID NO: 19413 - protein, 186 aa, Triticum aestivum
MSAQIAPPEHVCYVHCNFCNTILAVSVPSNSMLNIVTVRCGHCTSLLSVNLRGLIQSPPVQDHSQENFKAHNISFRGNYPDYGTSSKYRMPMMFSTKSDQEHMLHMRPAPEKRQRVPSAYNRFIKEEIRRIKTNNPDISHREAFSTAAKNWAHFPNIHFGLGSNESSKKLDEAIAAPIPQKVQGLY

SEQ ID NO: 19414 - protein, 528 aa, Bacillus anthracis
MTTFRELGLSDSLLQSVESMGFEEATPIQAETIPHALQGKDIIGQAQTGTGKTAAFGLPLLDKVDTHKESVQGIVIAPTRELAIQVGEELYKIGKHKRVRILPIYGGQDINRQIRALKKHPHIIVGTPGRILDHINRKTLRLQNVETVVLDEADEMLNMGFIEDIEAILTDVPETHQTLLFSATMPDPIRRIAERFMTEPQHIKVKAKEVTMPNIQQFYLEVQEKKKFDVLTRLLDIQSPELAIVFGRTKRRVDELSEALNLRGYAAEGIHGDLTQAKRMSVLRKFKEGSIEVLVATDVAARGLDISGVTHVYNFDIPQDPESYVHRIGRTGRAGKKGIAMLFVTPRESGQLKNIERTTKRKMDRMDAPTLDEALEGQQRLIAEKLQSTIENENLAYYKRIAEEMLEENDSVTVVAAALKMMTKEPDTTPIALTSEPPVVSRGGGSKKRGGNGGGYRDGNRNRSRDGRGGDGRNRDRNRDGRNRDGNRDRNREGSRDGNRGRRGEGQGRPGSSNGRGERKHHSRKPQA

SEQ ID NO: 19415 - protein, 531 aa, Symbiobacterium thermophilum
MTNTINELQDMGPGDAIFAIGTNTTECHPIIGIRMLEAHRRGARLIVADPRETELAKHADVYMRHNPGSDVALLNAMMYVIVTEGLADEAFIRSRTENFEACRETVLKYAPEKVEGITGVPAEKVRQAARLFATAENAATYYTMGITQHTSGVDNVLSIANLALMTGNLGKPKAGVNPLRGQNNVQGACDMGALPNVYPAYQPVTDPKNREKFEKAWGRPLSDRMGMAISDVLRGIEEGKVRFLYVMGENPMRSDPDVNHVRHCLEHVDFLVVQDIFLTESAALADVVLPGATWAEKDGTFTNTERRVQRVRKAMEPQGNARPDWMILRDIMRAMDYPADYNSPKDIFNELRTLAPSYAGVTYERLEKLGGLHWPCPNEEHPGTPILHVGKFSRGLGKFSAIEWRPPAELPDEEYPLVLTTGRRTAHYHTGTMTRNCWGLDGVAPEEWVEINPADAASLGVAHGDYVRVTTRRGSVVVRAEVTARVPKGVTFITFHYTEAAGNLLTNSALDPVSKTPEYKVCAVRVEKVSA

SEQ ID NO: 19416 - protein, 357 aa, Unknown
  Candidatus Blochmannia floridanus
MNDKILFIDRDGTLIHEPKDNFQIDSLDKLLLEPYVIPTLIALKNIKFKFIIVTNQNGLGTDLFPKTKFNKPHQFMIQIFKSQGIKFDQILICPHLPEDQCNCRKPKTGLISCWLKNKSLDMPNSYVIGDRDTDIQFAHNIGIQGIKYHQIHFNWKKIHKYLMQNSHRVAHIQRITNETNVDVKIWLNQCDQNKINTGIHFFDHMLEQIAIHAKIRMHIITKGDLHIDDHHTIEDTALSLGEALNQALGDKRGIGRFGFTLPMDESIAQCILDLSGRTYFDYQAEYSLQKIGNFSTHMIEHFFRSLSSKMHCTLHLKVIGNNDHHKAESLFKSFGKSLNQAIYIQHNQIPSSKGILL

SEQ ID NO: 19417 - protein, 474 aa, Myxococcus xanthus
MSESAGAQFGVAGMGVMGASLALNIADHGFRVAVWDRHAERIDEMHRKHGHPEVWGTESLEAFVQRLERPRKVLLMVTAGAAVDSMLERLLPLMAEGDVIMDAGNSWFLDTRRREEQCKAKGIHFLGVGVSGGEEGARNGPSIMPGGAPSAYELVRPVFEAIAANTDMGPCVTYVGADGAGHFVKMVHNGIEYADMQLLAETYDVLRRGLGLDADALADLLSQWDHGIAGSFLLETTIKVLRQKDPETGKPLVDLVLDKAGQKGTGKWTVQVALDLGVPIPSIAASLDARILSSMKDERVAAAPKLNGPVGQLSKEERAQLAAWTHDALYAARVVTYAQGMRLIQAASQEYQWNISLAELARIWRGGCIIRAKLLTPLREAFQQQPTLPNLMVSDAFAPVLERMAPAWRQVVGVATRVGIPVPVFSSSLAYLDSYRTAELPQNLTQAQRDAFGAHTYQRKDRPEAGFVHTEWGK

SEQ ID NO: 19418 - protein, 486 aa, Bacillus firmus
MNSGVHVGNSDSLKAVWFRRDFRLHDHTALKHAIEAIEKHGGKWLAFFYLDPKTASVEPVHHDYFFQTVMQFKQMLKTNGGDLYIITGTIEGGQLSKLLQAFPEIDAVYANDDRVGDGRLRDEAAEHFLAKQSIPFYTFEDAYLTEPDQVLKKDGTPYKVFTPYYKAWAKERKRTPAVIKRDVLLGSVHKGTAPDREAETLFNNLIKKCSYDWSAIGEEHAIKRLQMFTKKRLSGYKANRDFPSITGTSRLSPYIKTGAVSSRSIYYHILNAEADSYSAETFLKELAWRDFYRMVHFYEPDCKDREIMEGYRELNWSHDQDDLTSWKRGETGFPIVDAGMRQLLNEGWMHNRLRMITASFLTKDLLIDWRLGERYFERMLIDYDPSSNIGGWQWAASVGTDAVPYFRIFNPVTQSKRFDENGTYIRTYIPELNHVPDHYIHEPWKMSEEEQVKYKCRLDEDYPLPIVDHSKQRKKALSFFKGDDEE

SEQ ID NO: 19419 - protein, 238 aa, Zea mays
MVVVAAANRQSSTSEGGSAASPSKKRIRSDSLDTAPHHQNTRKPSPSPPPPFAAHDQMECTSAAAAAAFHHEPGSRVREECKSKVSRRYVHADPSDLSLAVKDGYQWRKYGQKVTKDNPCPRAYFRCSFAPSCPVKKKLVEHFFQSVVNTSGMTLHIRQRVCMTPSLSPDLDPYCLLKLAGKNSHHIIEASFKAFARALRQATEYDLRRQGTVPSFCQQINGRAEKIRALQLSGKRDG

SEQ ID NO: 19420 - protein, 382 aa, Legionella pneumophila
MNKSGSFYNLETIGGILLFIAAVIAIIIANSPFRVGYEYFLSINGSVSVGNLSITKPLLLWINDGLMAIYFLLIGLEIKREVNRGILSDKTNLLVPALTALAGLIFPALIFIFFNAHHPVYLKGWAIPTATDIAFTLGIVSLLGSRVPFSLKILLTAIAIFDDIAAIVIIALFYTEQLSLLSLSLALVFTLILIGLNYFKCRRISVFMLFGVALWIAVLKSGVHATLAGIVIAMTIPDEGKESMLARLEDGLHHWVVFLILPLFAFANAGVSFVGLDASMFTHPVVLGIGLGLFLGKQLGIFLSLGYFVQFKKFLKADKVNLAQVYGIALICGVGFTMSLFIGSLAYQNYDLSLMPMVKIGVVLGSFIAGLTGFLVLKLKQQ

SEQ ID NO: 19421 - protein, 121 aa, Photobacterium profundum
MLRVGNLDRAVNFYTNVMGMDLLRKRKNEAYKYTLAFVGYGDESQGAVIELTYNWGTTEYEMGDAFGHIAIGTEDIYATCDAIKAAGGNVTREPGPVKGGNTHIAFVTDPDGYKIELIQRA

SEQ ID NO: 19422 - protein, 355 aa, Bifidobacterium longum
MTIHNSLAELIGNTPLVKLNHIPQAAGVKATIAVKVEYFNPGGSSKDRIAERIIDAAEQSGQLKPGGVIVEPTSGNTGVGLALVAQQRGYRTIFTLPDKVSESKRAVLRAYGAEVIVTPTDAGPDDPRSYYQVAERLANTIPGGFRPNQYDNPNGPLSHYYTTGPEIWEATDHKVTHFVAGIGTGGTISGTGKYLKEASNGAVKVIGSDPEGSIYSASSRDEVHQYDIEGVGEDFYPKAFDRNITDDIVRVSDAEAFEMTRRLAGEEALLVGGSSGMAVASAIKYALANDLDENQIVVVLAPDSGRSYLEKIFNDDWMRANGYGDIVERTSKPSLAEQYLNGAPSDEGAGDGLHN

SEQ ID NO: 19423 - protein, 710 aa, Oryza sativa
MDTPDRPPRAAATAAVEMLRPFAAPDWGLIVLEVSIQDSPVFNFINSLSPIPPPKPSDSAHNVQLFKSSDLAPVSSIFASPHVNPAKESKLPIREDSVQLSRESHSPNSVRTRTGATSSIIRMIRCKNIVSENCSITCYLNDSTSSKASQPIQLCGGSAESDTNQNTDGKKDPTTEQDRTDIEFVLLDQCGPEKMDSSQSGNNACENQLSEQHKDELGSFDGGYMFAHQPHSDMLRLAPPFESETQLVNETLQTDNVYCETLLTDGPSGSYTQNSAPDPHLYWAGAVEGCATDYTPQMLPGACQSQLVPNDQINNKLNEPSDYMPMDHNVSSQNLRGMRRRCLFNEKSGAANEGAKNSSARHSTNSTTPRRKISSSDNNLKTLRTPPCALPGIGLHLNALATVPKDKMTAVVAYVGESSQGSPKKKRHKFDNGDGTSCKRCSCKKSKCLKLYCECFHAGVFCSEPCSCQGCLNMPSNMETVLSTREQIESRNPLAFAPKVIRTEPGQELAGGVGCSVSCRCEGCKNAFGRREGVALLGIEEAKRGCEEKDGGVKEETTDNDKQLVIYQDSINLTPAESVLATPSVVDYRPLVALPPLSSKKPRSSTKLGGYSSRLEGHLKSDILLSPFESYAEMMLGDGTSNVLKGESSPQTSVKVVSPNKKRVSPPRIGTGLSPICKSGRKLILKSIPSFPSLGVDITNEDPNTSSLAP

SEQ ID NO: 19424 - protein, 206 aa, Ostreococcus tauri
MTTTTLALGLGHVLALGRGDRAWAYERPRAGYARYVDAIDGGNDVFFRDPREVETNAFVEVSSPTSSGYGSVRDLGTPEEAAEKVLDRYLGELMSTRLGVRREKEVVRAREVTGKDGKAYYDVEVRISSYSARNQYGLTAEDRPQSLEWDRTLRAALGTENGKLYELRLQSPTESYARNTERFDEMVDSFRVFEADTPSVRSGFGL

SEQ ID NO: 19425 - protein, 121 aa, Vibrio cholerae
MDDCFREEEMKLINAIIKPFKLDDVREALADVGIEGMTVSEVKGFGRQKGHTELYRGAEYQVDFLPKVKIEIATQSDNVDRVVEAIIKAAHTGKIGDGKIFVYDLSQAVRIRTGEMDSEAL

SEQ ID NO: 19426 - protein, 529 aa, Arabidopsis thaliana
MEVSNQTRKRKAIDAGHGSQPTAYRGSDGVDLSLLEALEKSSHNGVEALDLKTLKKLVLSFERRLRDNIAARLKYVENPEKFADSEVDLHDDLQKLKVLAGAPELYPDLVASNTVPSIVNLLSHENSDIANDVVQLLQDLTDEDALEDNDEPARVLVDALVENNVLELLVQNMNRLSEADPDEATAIYATLTVIENLVEVKPAVAQLVCERTKLLRWLLTKIKVREFEGIKQYASEILAILLQNSTANQKRLGQMNGVDAVLEGVAMYKSKDPKTPDEEEMLENLFDCLCCLLMPLENKERFVNAEGVELMIIIMKQKKYAYGSAIRALDFAMTNYPPACERFVDVMGLKTAFAAFMGKIPLNKRIKRERYKEELEERVISLIASLFAGILRGSRRDRLLSKFVENEFEKIDRLMELYLRYSDRVRSEAERLDQLELDDLELDEDEKYNRKLESGLYSLQLVAVILGHIWCSEHSGMRARVELLLKQQKLSKTDVKQILQEYHDNIGDLDGAEEKERGQARIQLFISAM

SEQ ID NO: 19427 - protein, 363 aa, Anthurium andraeanum
MATEVMTAVPAGSRVESLASSGIQAIPPEYVRPAEERVSLTDALEAARRAEDGPQIPTVDVAGFSSGDEAARRACAEAVRRAATDWGVMHVVNHGIPLELIRRMQAAGEAFFALPIEEKEKYANDQSSGNIQGYGSKLANNASGQLEWQDYFFHLIFPEDKANFSIWPKQPANYVEETREFGRQLRVVASKMLAMLSLGLGVEEGKLEAEVGGMEDLLLQMKINYYPRCPQPELAVGVEAHTDVSALSFILHNMVPGLQVHNEGQWVTARCVPDSIIMHVGDVVEILSNGQYKSILHRGLVNKEKVRVSWAVFCEPPRDKILLQPLPDILGQGHPAQFPPRTFSQHIQHKLFRKTQGDFATPN

SEQ ID NO: 19428 - protein, 354 aa, Burkholderia pseudomallei
MSRTRLLSELVPGLDTLVRPLDLLARPTPVTEEPELARRWGQAGLWIKRDDLANPLYGGSKVRTLEFFLGRARAQRADGIVTMGPYGSHQLLATAVFGRRTGFLTRGVATPQPDVPEIALNRRLLPAYGMEVMRCASFAAVPAALLRARLKPLGAGRPFWIPPGANHPLGVMGVVEGALEVAQAIRAGSLPVPDDVVVPTGTCATAAGVYLGFALAGLDVRVVAVRMVPMIVTGPAKLLRMARQTERLLRRYGLTAPARWGELLWTNDHAGPSYGRAGLVAERARADVAQFGAFRTETTYTAKTLALLAGGGLQRRRVLFWNTYSAIDPDPSRDAGGACAWPDGESSAHSATAP

SEQ ID NO: 19429 - protein, 199 aa, Triticum aestivum
MEPKSTTPPPPGPVLGAPVGYPPAAVYPAAPPPGYPHAPALYAPQPPPAAVAAASQQTAAQQQQQLQVFWAEQYREIEATTDFKNHNLPLARIKKIMKADEDVRMIAAEAPVVFARACEMFILELTHRGWAHAEENKRRTLQKSDIAAAIARTEVFDFLVDIVPRDEAKDAEAAVAAGMPHPAAGMPAADMGYYYVPQQ

SEQ ID NO: 19430 - protein, 500 aa, Solanum lycopersicum
MPEIERHRTRHNRPAIREPVKPRVPLRLLLRVASVAGGIQFGWALQLSLLTPYVQELGIPHAWASIIWLCGPLSGLLVQPLVGHMSDKCTSRFGRRRPFIVAGAASIMIAVLIIGFSADIGWLLGDRGEIKVRAIAAFVVGFWLLDVANNMTQGPCRALLADLTQKDHRRTRVANAYFSLFMAIGNILGFATGSYSGWYKIFLFTLNTACTINCANLKAAFILDIIFIATTTCISISAANEQPLDPSRGSSHTGEEIDESSHGQEEAFLWELFGIFKYFPGVVWVILLVTALTWIGWFPFLLFDTDWFGREIYGGEPNDGKNYSAGVRMGSLGLMLNSVLLGLTSLFMEKLCRKWGAGFTWGVSNVVMSLCFIAMLIITAVRSNIDIGQGLPPDGIVIAALVVFSILGIPLAITYSVPYALVSSRIEALGLGQGLSMGVLNLAIVFPQIVVSLGSGPWDELFGGGNSPAFVVAALSAFAAGLIAILAIPRTRVERPKIFA

SEQ ID NO: 19431 - protein, 389 aa, Triticum aestivum
MIPAVKLSPAAFSVTNQRSKSAFVPSVSILNMKKFASCSLRPLYLTWLDDPHTSELKPRRQLLDFRCAASAADDKESKAEVLPASSEAAQKLKISIYFATWWALNVIFNIYNKKVLNAFPYPWLTSTLSLACGSAMMLFSWVTCLVEAPTPKTDLDFWKALFPVAVAHTIGHVATTVSMSKVTVSFTHIIKSAEPAFSVLVSRFILGESFPMPVYLSLLPIIGGCGLAAATELNFNMIGFMGAMISNLAFVFRNIFSKRGMKGKSVSGMNYYACLSIMSLIILAPFAIAMEGPQMWAAGWQKALADVGPNVLWWIGAQSVFYHLYNQVSYMSLDQISPLTFSIGNTMKRISVIVSSIIIFRTPARAAAQSLVRPPAGRPYGRAPNALDA

SEQ ID NO: 19432 - protein, 959 aa, Vibrio angustum
MTNTTFLQALSDDNDFSHRHNGPNALEQQRMLETIGVGSIDQLIAQTVPASIRLTEPMTLPQAQSEAAMLAELKQIAGKNIINKSYIGQGYYNTFTPNVILRNVLENPGWYTAYTPYQPEISQGRLESLLNYQQMIMDLTAMELANASLLDEATAAAEAMTLCKRAGKNKSNAFFISTDLHPQTIDVVTTRAKYVGFEIITGSAEDLAKHDVFGALLQYPASNGELQDLTDIIDAAHDKKTLVAVASDLLALTVLKAPGEMGADVVIGSAQRFGVPMGFGGPHAGFMATKDKHKRTMPGRVIGVSKDAKGNQALRMAMQTREQHIRREKATSNICTAQALLANMAAFYALYHGPEGLKKIGRRVHHFTAVLAAGLRNNGFELENQHFFDTLTIKTGNKTNALYQKALDAGINLRKYKDKLGVSIDETTLAEDIEQLLGLFTNQDLKVSMFSDDIAADEFAAIPPACRRSSAYLTHSVFSRYHSETQMMRYMKQLENKDYSLTHGMIPLGSCTMKLNAVAEMIPVTWPEFGQLHPFAPQAQTLGYQELAKNLSEMLCSITGYDAFSLQPNSGAQGEYAGLIAIQRYHEANGDSHRNVCLIPSSAHGTNPASAAMVSMKVVVVGCDELGNIDIDDLKAKIEKHRDALSCIMITYPSTHGVYEEVVQEVCDLVHEAGGQVYLDGANMNAQVGLTSPGFIGSDVSHLNLHKTFCIPHGGGGPGMGPIGVKSHLTPFLPGHVEDTNSDELQYAVSAAALGSASILPISYAYIAMMGEQGLTQATELAILNANYVMERLRPHYPVLYRGTEGRIAHECIIDLRPIKDASGISEEDIAKRLMDYGFHAPTMSFPVAGTLMIEPTESEDIAELDRFCDAMIAIKEEINLVQSGEWPLDDNPLVNAPHSQVDMMESEWNHAYSREVACFPSAHTKAAKYWPSVNRVDNVFGDRNLVCSCPSIENYIED

SEQ ID NO: 19433 - protein, 221 aa, Oryza sativa
MVDIRRAYPELGNCLYFDLAHKTHAVLYELPKNRLNWLWYINGDEPELTGSSVTMKVSEATVSEMKEEAERVWCPELARLISETAEPFVNVIYDAEPLPRLSWCGGRVALVGDAAHPTTPHGLRSTNMSIVDARVLGCCLARRGDAETTPRRALAEYEAARRPVVAAQVLHARRLGRLKQGLGMGSAGDGEGFDARTATEEEISQLRQSSMPYFSGAPTTE

SEQ ID NO: 19434 - protein, 1252 aa, Streptococcus agalactiae
MKRKDLFGDKQTQYTIRKLSVGVASVATGVCIFLHSPQVFAEEVSVSPATTAIAKSNINQVDNRQSTNLKDDINSNSETVVTPSDMPDTKQLVSDETDTQKGVTEPDKATSLLEENKGPVSDKNTLDLKVAPSTLQNTPDKTSQAIGAPSPTLKVANQAPQIENGYFRLHLKELPQGHPVESTGLWIWGDVDQPSSNWPNGAIPMTNAKKDDYGYYVDFKLSEKQRKQISFLINNKAGTNLSGDHHIPLLRPEMNQVWIDEKYGIHTYQPLKEGYVRINYLSSSGNYDHLSAWLFKDVATPSTTWPDGSNFVNQGLYGRYIDVPLKTNAKEIGFLILDESKTGDAVKVQPNDYVFRDLANHNQIFVKDKDPKVYNNPYYIDQVQLKDAQQTDLTSIQASFTTLDGVDKTEILKELKVTDKNQNAIQISDITLDTSKSLLIIKGDFNPKQGHFNISYNGNNVTTRQSWEFKDQLYAYSGNLGAVLNQDGSKVEASLWSPSADSVTMIIYDKDNQNRVVATTPLVKNNKGVWQTILDTKLGIKNYTGYYYLYEIKRGKDKVKILDPYAKSLAEWDSNTVNDDIKTAKAAFVNPSQLGPQNLSFAKIANFKGRQDAVIYEAHVRDFTSDQSLDGKLKNQFVTFAAFSEKLDYLQKLGVTHIQLLPVLSYFYVNEMDKSRSTAYTSSDNNYNWGYDPQSYFALSGMYSEKPKDPSARIAELKQLIHDIHKRGMGVILDVVYNHTAKTYLFEDIEPNYYHFMNEDGSPRESFGGGRLGTTHAMSRRVLVDSIKYLTSEFKVDGFRFDMMGDHDAAAIELAYKEAKAINPNMIMIGEGWRTFQGDQGKPVKPADQDWMKSTDTVGVFSDDIRNSLKSGFPNEGTPAFITGGPQSLQGIFKNIKAQPGNFEADSPGDVVQYIAAHDNLTLHDVIAKSINKDPKVAEEEIHRRLRLGNVMILTSQGTAFIHSGQEYGRTKRLLNPDYMTKVSDDKLPNKATLIEAVKEYPYFIHDSYDSSDAINHFDWAAATDNNKHPISTKTQAYTAGLITLRRSTDAFRKLSKAEIDREVSLITEVGQGDIKEKDLVIAYQTIDSKGDIYAVFVNADSKARNVLLGEKYKHLLKGQVIVDADQAGIKPISTPRGVHFEKDSLLIDPLTAIVIKVGKVAPSPKEELQADYPKTQSFKGSKTVEKVNRIANKTSITPVVSNKTDSYLTNEANLPKTGDKSSKILSVVGISILASLLALLGLSLKRNRHLK

SEQ ID NO: 19435 - protein, 537 aa, Saccharomyces cerevisiae
SEITLGKYLFERLKQVNVNTVFGLPGDFNLSLLDKIYEVEGMRWAGNANELNAAYAADGYARIKGMSCIITTFGVGELSALNGIAGSYAEHVGVLHVVGVPSISHHTLGNGDFTVFHRMSANISETTAMITDIATAPAEIDRCIRTTYVTQRPVYLGLPANLVDLNVPAKLLQTPIDMSLKPNDAESEKEVIDTILALVKDAKNPVILADACCSRHDVKAETKKLIDLTQFPAFVTPMGKGSISEQHPRYGGVYVGTLSKPEVKEAVESADLILSVGALLSDKTKNIVEFHSDHMKIRNATFPGVQMKFVLQKLLTNIADAAKGYKPVAVPARTPANAAVPASTPLKQEWMWNQLGNFLQEGDVVIAETGTSAFGINQTTFPNNTYGISQVLWGSIGFTTGATLGAAFAAEEIDPKKRVILFIGDGSLQLTVQEISTMIRWGLKPYLFVLNNDGYTIEKLIHGPKAQYNEIQGWDHLSLLPTFGAKDYETHRVATTGEWDKLTQDKSFNDNSKIRMIEIMLPVFDAPQNLVKQAKLT

SEQ ID NO: 19436 - protein, 463 aa, Thermobifida fusca
MCVGRRNTSGPHRLRRWAPIRGADRRYPRRPKRCVGQPTAESEDTMTDIERDVRKVAERARDAAADLAPLSRDAKDEALTAVADALRERTEEIVAANAKDVAQARENGISEAMIDRLTLTPARITAIADAVHEIVELPDPVGEVVRGKTLPNGLELRQIRVPLGVIGIIYEGRPNVTVDAAALCLKSGNAVLLRGSSSAYSSNTVLTDVIRQALASTRVPVDAVQMVPGKSRESVKHLMRARGLVDVLIPRGGASLIQTVVNESTIPVIETGTGNCHVYVDEAADLDQALKIVLNSKTQRCSVCNASETLLVHAGIADAFLPRALAELREAGVTIHGDERVRSYDSSVVPATEEDWATEYLSLDLAVRVVDSLDEAVAHIRAYSSAHTEAIITDSQAAARRFVSLVDSAAVMVNASTRFTDGGEFGFGAEIGISTQKLHARGPMGLPELTTTKYVVTGEGHVR

SEQ ID NO: 19437 - protein, 880 aa, Thermobifida fusca
MSVTEPPPRRRGRHSRARRFLTSLGATAALTAGMLGVPLATGTAHAEPAFNYAEALQKSMFFYEAQRSGKLPENNRVSWRGDSGLNDGADVGLDLTGGWYDAGDHVKFGFPMAFTATMLAWGAIESPEGYIRSGQMPYLKDNLRWVNDYFIKAHPSPNVLYVQVGDGDADHKWWGPAEVMPMERPSFKVDPSCPGSDVAAETAAAMAASSIVFADDDPAYAATLVQHAKQLYTFADTYRGVYSDCVPAGAFYNSWSGYQDELVWGAYWLYKATGDDSYLAKAEYEYDFLSTEQQTDLRSYRWTIAWDDKSYGTYVLLAKETGKQKYIDDANRWLDYWTVGVNGQRVPYSPGGMAVLDTWGALRYAANTAFVALVYAKVIDDPVRKQRYHDFAVRQINYALGDNPRNSSYVVGFGNNPPRNPHHRTAHGSWTDSIASPAENRHVLYGALVGGPGSPNDAYTDDRQDYVANEVATDYNAGFSSALAMLVEEYGGTPLADFPPTEEPDGPEIFVEAQINTPGTTFTEIKAMIRNQSGWPARMLDKGTFRYWFTLDEGVDPADITVSSAYNQCATPEDVHHVSGDLYYVEIDCTGEKIFPGGQSEHRREVQFRIAGGPGWDPSNDWSFQGIGNELAPAPYIVLYDDGVPVWGTAPEEGEEPGGGEGPGGGEEPGEDVTPPSAPGSPAVRDVTSTSAVLTWSASSDTGGSGVAGYDVFLRAGTGQEQKVGSTTRTSFTLTGLEPDTTYIAAVVARDNAGNVSQRSTVSFTTLAENGGGPDASCTVGYSTNDWDSGFTASIRITYHGTAPLSSWELSFTFPAGQQVTHGWNATWRQDGAAVTATPMSWNSSLAPGATVEVGFNGSWSGSNTPPTDFTLNGEPCALA

SEQ ID NO: 19438 - protein, 474 aa, Unknown
  Candidatus Blochmannia floridanus
MFKQQEVGVIGMGIMGQNLALNIENKGYRVSIYNRSPDKTNIIIKNNPTKNLIPYFSIEQFIFSLKKPRVIFLMITAGVHVDHIIQVLSNYLEIGDILIDGGNSFYQDTVRRDLYLSEKKINFIGLGISGGEEGALKGPSLMPGGSQDAFKIVESLLKKIAARFNDNEICMEYIGPNGSGHYVKMMHNGMEYGDMQIISEIYFFLKMVLHLTAKQLGKIFSDWNMGELSSYLIEITSHILMKSDNNQYCVLDYILDVADNKGTGLWSSKDALDLGVPSTMITESVFARYLSTLKNQRIQASKVFSNVFEGKVNFDLENIDIFVEKARKALYLSKIILYAQGFYQLKISSMTYHWNLNYQKIAKIFRAGCIIRSNFLQEIINIYSKTPKIENLLLDSYCVNIINNYQQDLRDIVTIGIDHGIPMPALSAAISYYDGFRSLMLPANLIQAQRDCFGSHTYKRIDKSGVFHTRWLSK

SEQ ID NO: 19439 - protein, 73 aa, Lactobacillus acidophilus
MAKDDVIEVEGKVVDTLPNAMFKVELENGATILAHVSGKIRMHYIRILPGDRVTVELSPYDLTKGRITYRFIK

SEQ ID NO: 19440 - protein, 388 aa, Thermobifida fusca
MGTGVGQTRAEIAQARRVVVKVGSSSLTTPQGGLDHERIRDLTDVLAERRKAGTEVVLVSSGAVAAGMAPLGLTQRPRDLATQQAAASVGQGLLLARYTAEFARHSLTAAQILLTADDLMRRAQYRNAQRAMSRLLEIGAVPIVNENDTVATHEIRFGDNDRLAALVAHLLRADVLVLLTDVDALYDGNPSLPTSTRITQVNGPEDLVGVDLGSANKRGVGTGGMITKVESARIATEAGVATVLTSAANARAALRGDPVGTFFVPAKHRRPSSRQLWLAHATAGRGSVFLDPGAVHAVVTEKASLLPAGVIKVEGDFNAGDPVDLRDENGVLVARGLVNYDSAEIPDLMGRSTRWLARELGAEYSREIVHRDDLVVLRNGSTSDREAC

SEQ ID NO: 19441 - protein, 112 aa, Glycine max
  misc_feature (68)..(68): Xaa can be any naturally occurring amino acid
ARVPFVDKEFIRVAGNIDPEGKMINKDEGRIEIWTLQMTFDDEDHPYMAKHILYNHNEQSSDGVGYGXIDGLKAYDEQHATDRFMLNTGHTITCNTYTANELYHYRMISERV

SEQ ID NO: 19442 - protein, 573 aa, Novosphingobium aromaticivorans
MTDVTKWLASLEAALAGEDKAAVASLFLPTGLWRDFLAFDWTLATHEGGEAIAAFAAARGGATATHSWATSAAPSASEGFISFETAVGAGRGYVRLMDGKALSLFTMLADLRGHEFPVRGRRASGVVHDAQGRNWQDLIAAERSAMGTSEQPYVLVVGAGQAGLAIGATLRLLGVPHLLIDKHPRVGDQWRSRYKSLTLHDPVWYDHMPYLPFPDHWPVFTPKDKMGDWLELYAEAMELNVWCDTELLAARHDPATGAWTARVRRGGTEIELRPTQLVMALGNAGFPRVPQIEGQDRFKGAQYHSSAHSGGEGLAGKRVVVIGANNSAHDICADLVEHGAHATMVQRSSTHIVRQHTMTDVMLKQVYSQEAVDAGITTELADLINASVPIRLAEISARQAWAEIREAEAPFYARLEQAGFKLDFAEDGAGINGKYLRAASGYYIDVGASEMIADGRIALKSGTEISHLTETGVAFADGTHLEADIVVYATGFGSMEEWVARLIGEDVAMKIGKCWGYGSGYKGDPGPWEGELRNMWKPTAQEGLWFMGGNLAQVRFYCKVLGLQLKARHAGLV

SEQ ID NO: 19443 - protein, 134 aa, Serratia marcescens
MSEALKSLNNIRTLRAQGRELPLEVLEEILEKLNVIVDERRQEESSKAAELQARQEKLDALRKLMEEDGINPEELLGSFQAKSTATKKSREPRPAKYSFTDENGETKTWTGQGRTPKALAEQIAAGKSLDDFLI

SEQ ID NO: 19444 - protein, 195 aa, Clostridium thermocellum
MDRKFEVSRKTGETDITLSINIDGSGKSNISTGVGFFDHMLNLFAKHGLFDLDVKAKGDLEIDAHHTVEDVGIVLGQAIKQALGEKKSIRRYGSSFVPMDEALVLVALDLSGRPYLVFDAELKCEKLGNMETELVEEFFRAVAFNAGITLHVKALYGSNTHHIIEAMFKAFGRALDDATRKDDRIEGVMSTKGML

SEQ ID NO: 19445 - protein, 586 aa, Oryza sativa
MASHIILPKEEEAALGVAVEEDHDSPAAPGYQHQQGPPVAKALPFSATCVRISRDSYPNLRALRNASAMSLPDDDAAYAKLEEGDYGYLLDDVPHFTDYLSDLPVSADTPPLPTHPCLALVVPLPDSTPATFPNPLQDHPAYSTVKQYFVNADDTVPEKVVVQKDSPRGVHFRRAGPRQRVYFESEDVKACIVTCGGLCPGLNTVIRELVCGLSHMYNVNDIFGIQNGYKGFYSSNYLPMTPKSVNDIHKRGGTVLGTSRGGHDTKKIVDNIQDRGINQVYIIGGDGTQKGAYEIYKEIRRRGLKVAVAGVPKTIDNDIAVIDKSFGFDSAVEEAQRAIDAAHVEASSAENGIGLVKLMGRYSGFIAMYATLASRDVDCCLIPESPFYLEGEGGLFEYIEKRLKENNHMVIVVAEGAGQDLIAKSIAAADQIDASGNKLLLDVGLWLTHKIKDYCKNKKMEMTIKYIDPTYMIRAIPSNASDNVYCTLLAHSAIHGAMAGYSFTVGMVNGRHAYIPFHRVTSTRNKVKITDRMWARLLSSTNQPSFLSQKDIDAAREADKLASKSPVPVNTKEHGENVKKPANGEK

SEQ ID NO: 19446 - protein, 401 aa, Unknown
  marine gamma proteobacterium HTCC2080
MSGVLIVGAGQAGGTAALQLRASGYDGDIKLAGSEPHAPYERPPLSKGYLSGALAYNSLLVRPETTYEQQQIELLKETTIARIDPESGIAQTSKDCEIKFDRLLFTTGARPRQLLIPGAELPGVYYLRTIADVEKLKGAMATAKRVCLIGGGYVGLEFASVAIKAGLDVTVLESADRLLKRVTTETMSHYFENLHRSQGVDIQCNSEIFSIEGEVCAERVVCRNSVIEADLILVGIGAIPNTELAESAGVECDNGILVDEQCRTSVANIYAAGDCTNHPNHYLNRRLRLESAPNATDQAKVAAVNMLGEDKCYRSVPWFWSDQFSSKLQAVGFSADGTSSVCRGRQEEHEFATFYLHDNRLVAVEAINFPRAFMVGKRLYGLQVDVEKLADSSVDLKSLLV

SEQ ID NO: 19447 - protein, 851 aa, Ostreococcus tauri
MATRAIASARSRAPARAREGTSLARARRWTRSPHRGVSGRRSRATRWTLDAVSTEDAEGWRRETSKAKETRPTRTTVADAGRGVDDVHARTRVAREAKRRTAPRGVPGVCDTPRRGDASALGATRVVGCPDDTVNFAVYTSAATAVSLVLWTPEGLARGEIAGEIELDETTNKTGSVWHVALPRCAEDVLYGYRVDGPYEPEAGHRFDKSKILLDPYAKFTVSRPEYGVASKKEDGTEDCWPQYAGGVPKKLRSDGKEDFDWEGVTSPKRPMRDLVVYEAHARGLTADLETKAKPGTYAAIEEALPYLKQLGVNAIELMPCHEFNEMEYHSLNHVTGEFRRNFWGYSTVNFFSPMTRYAEAGADDCGREAAREFKRMIRECHRAGIEVIMDVVFNHTAEGNEQGLTLSFRGLDNRVYYMVAPEGQFYNYSGCGNTMNCNHPVVREFILECLRYWVLEYHIDGFRFDLASILTRASSMWDRANIFGEPTAETPMLEEVVIGTPLQDPPLIDAISNDPVLAGTKLIAEAWDAGGLYQVGSFPHYGVWSEWNGKFRDDVRNFIKGVDGYAGLFAERLCGSPNLYADRSPSASINFVTAHDGFTLRDCVSYNEKQNHANGEENRDGEEHNASWNCGLSCDDDGECWDPEIVALRDRQMRNFVVALFVAQGVPMMYMGDEYGHTKCGNNNTYCHDNALNWIDWSEASSPLAGDGLARFTKQVIALRKKHSAFRLDSFPSADNIQWHGHLPDTPMWDEESRFVAFTLQDKPETDKFYIAFNSHHEPAMLKLPSPPERCKWKLILDTSLESPFDVLSAEDIAEADSYTAEAMFLPGLRKNTYLCADRSAVIFRAVSLA

SEQ ID NO: 19448 - protein, 114 aa, Hyphomonas neptunium
MKQITAVFKPSRLDAVIEAISEAGATGLTVTEVRGYGRQQGKTEVYRGAEYEVRLLPKVKVELACADADVERFIEAITQAANTGTIGDGKIFVHDLDSILRIRTGERDEQAISG

SEQ ID NO: 19449 - protein, 323 aa, Yarrowia lipolytica
MTRSKFTEYKQVLRNSCVGKPQYTEKDYPDLDGKNFLVTGATGGVGLEATKLLLEKKSHVIMVGRSKTKSQSTLDELQKTYSHGTFDFVEADLSDLTTVERAGEYIRSKYTTLDGAILNAGVMAPPYSLTPQGHESQWGINVVAHFLLSKYISPALISAAQTAPKDTVRLVWVSSSVVAMSPYEGGIKFDDINHSKVKNPSPWTLYSQSKIGDAYLAYLWSKHHPDSGVLSVSLDPGNLASDLSRHTSWLSSIKNYVLYPPKYGAYTELSALLNPSVKNNEHLIPWGIEGHLRQDVDDGRRGKDGEELWQGLNKDVEGFFKEE

SEQ ID NO: 19450 - protein, 433 aa, Unknown [sequence omitted]

SEQ ID NO: 19451 - protein, 367 aa, Unknown
  Synechococcus sp. WH 8102
MSATPTEEQLQDVQTAATEEVSQDAAAAVASVDEAFEAAEDLGIPEDVPTADDPGSRASSRNLDDAGFTIDEFAALLSKYDYNFKPGDIVNGTVFALEAKGAMIDIGAKTAAFMPLQEVSINRVEGLSDVLQPGEIREFFIMSEENEDGQLALSVRRIEYQRAWERVRQLQKEDATIYSEVFATNRGGALVRVEGLRGFIPGSHISTRKPKEELVADFLPLKFLEVDEERNRLVLSHRRALVERKMNRLEVGEVVVGTVRGIKPYGAFIDIGGVSGLLHISEISHEHIETPHSVLNVNDQMKVMIIDLDAERGRISLSTKALEPEPGDMLTDPQKVFEKAEEMAARYKQMLLEQAEEGEDPIGSMMI

SEQ ID NO: 19452 - protein, 538 aa, Haemophilus influenzae
MKIYLRFVWILIIILNFLLNLFITTNGVIIVNAFKKSLIVAASFASLSLFNSATAELVYKPLEQPVEPAKPDLKIESVNEKFAEKYPNQYNSWRSTANGDGENIIYADEENPRLIVLWGGYAFAKEYNAPRGHFYAVTDVRNILRTGAPKTANDGPQAMACWTCKGPDVPRLIAEWGEKDYFNAKWAKGGPEIVNSIGCADCHDTTSKDFAEGKPALRIARPHVLRALDALEKATAEKDKAEGRPHNNLSFNTAARTEKRAEICANCHVEYYFAGDIKQVTFPWDNGQTVDDIEKYYDDIGFTDWTHSLSKAPMLKAQHPDFEIWSLGMHGKNGVTCVDCHMPKVQGADGKVYTDHQIQNPFEAFDSTCANCHDQSKEKLRDIVTSRKKEVKDVMGRLEDQVVKAHFEAKEAWDAGATKKEMEAALMDIRHAQWRWDYTAASHGGHMHAPEVVLRVLASGLDKVADARTKLAVILTKHGVKTPVQIPDISTADKAWKVMGIDIEKERKAKEEFLKTVVPQWEQQAREKGLLVDPPAQK

SEQ ID NO: 19453 - protein, 416 aa, Triticum aestivum
MDPVPSLVKEEEEEEGAHGRGDSPGARAAPRPMEGLHDAGPPPFLTKTYDMVDDPNTDSIMSWSAGNNSFVVWDPHAFATVLLPRHFKHSNFSSFVRQLNTYGFRKVDPDRWEFANEGFLRGQRHLLKNIRRRKPPAHTASNQQSLGSYLEVGHFGYDAEIDRLKRDKQLLMAEVVKLRQEQQNMKVHLKAMEDRLRGTEQKQQQMTSFMARILRNPEFLKQLIAKNEMSKELHDAISKKRRRRIDGGPEAYAVGASSSNLEQESPVVFDSHGSVELLAEGSVPVPVELLADGIPPDLEGSVDLLGDEIPPGLEGSVALLADGLEGSVELLVDGIPADLNGSGIDANGVTEPQDFGLGTCEAQQNRVPGLFHDNFWEELLNKGLSGENDEPVNADGMDVLSEKMGYFIPNSPTLST

SEQ ID NO: 19454 - protein, 303 aa, Haloarcula marismortui
MKDSILDTIGSPLVSVRAPEGATVAAKIESFNPGGSAKDRPAKYMIDDAERNGSLQPDDTLVEPTSGNTGIGMAMVGATKGYDVVLVMPSSKSPERRQIMKAYGAEIELVEGDISDAKERANELCERDDYVQLRQFENPANPTAHYETTGEEILEQVGDRTVDALVAGVGTGGTLTGTGRRLQDAFPGMDIVAVEPADNAVLSGMEPGTGEDSFQGMGPGFVSDNLDTDLLDDVMTVELPDAEDECRRLAHEEGILVGQSSGASNLAAREFAEQLIRDGVDDPLVVTVYWDSGERYMSTGMFD

SEQ ID NO: 19455 - protein, 208 aa, Desulfovibrio vulgaris
MTAIETLLLTGLLLATALLPPALAHAAQPAPPPPAGMQVAVFAGGCFWCMEKPFDAVEGVLETTSGYTGGTVESPTYEQVSNGGTGHAEALRVVYDPAKVSYTALLDTFWHNVDPFDAGGQFCDRGSQYRSAIFPQDASQRADAESSLKALEERFGRPVATRIEPAGAFWPAEEYHQDYYKKNPLRYSFYRSNCGRDRKLKEVWGSPK

SEQ ID NO: 19456 - protein, 289 aa, Zea mays
  misc_feature (248)..(248): Xaa can be any naturally occurring amino acid
  misc_feature (270)..(270): Xaa can be any naturally occurring amino acid
  misc_feature (282)..(282): Xaa can be any naturally occurring amino acid
ENAASEYLLSNHPVVREFIVDCLRYWVSELHVDGFRFDLASILTRGCSLWDPVNVYGSPMEGDMITTGTPLVAPPLIDMISNDPILGNVKLIAEAWDAGGLYQVGQFPHWNVWSEWNGKYRDTVRQFIKGTDGFAGAFAECLCAHDGFTLADLVTYNSKYNLSNGEDNRDGENHNLSWNCGEEGEFASLSVRRLRKRQMRNFFVCLMVSQGVPMFYMGDEYGHTKGGNNNTYCHDHYVNYFRWDKKEXQSSDLYRFCRLMTKFRKECESXLGLEDFPTSERXKWHGHQP

SEQ ID NO: 19457 - protein, 396 aa, Solibacter usitatus
MATPKHEYYETLGVPRKADAEEIRKAYRKLARKYHPDLNPGDKSSEERFKNVQEAYDILSDPKKRQMYDQFGFYSENGGYPGAGPGGQPGGGPQGAHFDGFDFSDYMSGQGGAAGGRRTQGTSSQGGGGFRDIFSQFFGGGAAAEQAEPERGADLEYVMNIDFWQAIKGTTARVNITRYDVCTTCNGTGSTGSGEVTCPQCKGVGQVTQMAGAMKFNLTCPRCGGAGKLRNACPTCGGDGRVPKTETVEIRIPPGARDGSRLRVAGKGNAGTMGAAPGDLYITTKVEPHQFFHREGDNIEIKAPIAIWEASLGAKIEVPTIDGRTLLKIPQGTVNGQKFRLREKGVLNSRTNQRGDQIVEVQLTTPDPRDEKTRQLLRDLAELHPEDPRAEMWSKV

SEQ ID NO: 19458 - protein, 908 aa, Thermobifida fusca
MLENEPNNGVDSTEGTTEIETSTRSNGSTVVGMSGTVRLAQPVRRGRAASRPAGPPPEPDPIPVTARTTVAATSIELVTDPAPSKSAAEDTAEEEPKRRSRKTTARTSRTRTRSRTATTDDTEPTGQDTTPGAERSSGESAAQAAPAGNTLAPAAQDTRPADPSAVAAVTFQPPMVVFQPPVVESVEPDSPQDAGEELDEAEDLSAEIELAVEERPTRRRRRRRRNRSRSGDDGEAADTSDTTDDAETTADETEKGSAGEAPAAAAADTTEETEATTTGTRRRRRRRRRSGVEVTTEPEADDQSSTAARTRPARAERPIEEEVQAVRGSTRLEAKRQRRREGREQGRRRPTIITESEFLARRESVKRDLIVRRIGERTQIAVLEDNVLVEHYVDRADHKSYVGNVYLGRVQNVLPSMEAAFVDIGKGRNAVLYAGEVNWDATGLEGQPRRIESVLKSGQSVLVQVTKDPVGHKGARLTSQISLPGRYLVYVPDGSMTGISRKLPDKERARLKQILKKVMPNGAGVIVRTAAEGASEEELERDIARLSQQWESIKRKAKSATAPALLSSEPDLTIRVVRDIFNEDFSSLVVSGDDAWETIRDYVNQVAPHLADRLSHWTEDRDIFEAYRIDEQIAKALERKVWLPSGGSLIIDRTEAMTVIDVNTGKFTGQGGNLEETVTKNNLEAAEEIVRQLRLRDIGGIIVIDFIDMVLESNRDLVLRRMLECLSRDRTKHQVAEVTSLGLVQMTRKRVGQGLLEAFSHTCEHCNGRGLILQTDLLESKSGGRKKKNKNNGANKNGAGAEKTSADQGKATDKARAGGDAETAAQAEANGGATRTAKDVAGSPEKQEDSVPSISESGSESSAQANAVPETKEAAEQPAETVAERPRRRRIRRRAGVVVSETAVAEAG

SEQ ID NO: 19459 - protein, 466 aa, Xylella fastidiosa
MMSHPLSSLRDLEYHGAFVERHIGPNDVEIAQMLRVVGYDSLESLTDAIVPEKIRSTVALDLPKGITEEEALAKIRVIANKNQVFRSFIGQGYYGTHTPKVILRNILENPAWYTAYTPYQAEISQGRMEALINFQTMCADLTGMEIANASLLDEATAAAEAMSLAKRSAKSRSDLFFVHDAVHPQTLELLRTRAEPLGIVLRVGTPEEALQADVFGILLQYPDTFGRIGDHRVLADAVHARGGLVAVASDLLALTLITPPGEWGADIVVGNSQRFGVPFGFGGPHAGFMACRDIYKRSIPGRLIGVSVDAAGHPAYRLALQTREQHIRREKATSNICTAQVLLAVMASMYAVYHGPQGLLRIAWRTHRMAAILAAALRGAGLTVGEYFFDTLHIVGIDALAIHCAAAAAGMNLRMIDNAQLGISLDETVTRSDVVALGQVFGVQVDVEALDAITADALPAGLLRSS

SEQ ID NO: 19460 - protein, 969 aa, Prochlorococcus marinus
MTSKFGSDLFVDRHLGLGDNDERIMLNKLGFNNIDQFINQVIPEDIQLKDKSSEILPQGCSEIEALNELEEIANKNTKMRSLIGLGYYDNHMPKVIQRHVLENPRWYTSYTPYQAEIAQGRLEALFNFQTIVCELTGFPVANASLLDEGTAAAESMAMSFSARKNKSSKVYLVESNVFDHTFNVLQTRAKPLGISLKRFTQSNLPNHDDVFGMLLQLPGKNGQLYDPTFLISQAHRSEIIVTACIDPLAQVLIKPISEFGVDVAVGSMQRFGVPMGFGGPHAAYFACSEQYKRLIPGRIVGQTLSKNGEKSLRLALQTREQHIRREKATSNICTAQSLLAIISSFYAIYHGPSGLTQIAKRLVELRINLESSLAALGFDIPDGIRFDSVDVYSEHSQRIHNEALKNGYNLRILPLGSTIENSTGFGISLDELSNEKEIKDILTFIANLLEKEDDLEHIKFDKEFHLESLALRSSEWMQQDIFTNYQSETELMRYIFRLAEKDFSLVDGMMPLGSCTMKLNSAAELNPVSWANLSSMHPFSPLDQTKGYSKIISDLEKWISEIVGLKSVSFQPNAGSQGEFAGLLAINSYFESRGELLRKKCLIPKSAHGTNPASAVMAGFDVLTVECDDEGNIDYQDLSIKVKKFDNQIGALMLTYPSTHGVFELQIRKICDLIHSVGGFVYLDGANLNAQVGLCKPGNYGVDVCHLNLHKTFCIPHGGGGPGVGPVAASETLSPYLPTHSLMDNNLSNSLNFVSSAKHGSASILPISWMYIKMAGLSGLRKATSHAILSANYIAHSLKHKFKILYKGKNNFVAHECILDFRDLKSKTGLSVNDLAKRLIDYSFHAPTISWPVPETIMIEPTESESLAEVDRFCEAMLLIGEEISEIENNYELKNNNVISNSPHTLKELIADNWQYPYSKEKASFPYKTPTTIKFWSSVSRINNAYGDRNLICSCNVNQDETLEEKKCA

SEQ ID NO: 19461 - protein, 320 aa, Mycoplasma penetrans
MRIDSNYLNNPNFFDVLIVGAGPAGLTAALYCKRANLKVAFYEKETPGGKVVKTSFVENYPGFTSVSGPDLAMNFFKQVSELGVKFIFGEVTKIRKVGDIFHVFSADGQARYAKAVIIATGMTEKKIGVKNEAEYYGRGVSYCAICDAALYKDKPVAVIGGGNTALEESLYLADIVSKVYLIHRRQGFRADAMVVEKVKANKKIELVLDAIPHEFLGDGKTINGIIIKNVNDNRLLKINVDCIFPFIGFVPTNKMVEGLEITDPNTGFILVNEKMETSIPGLFSTGDVNNKTVRQISTAVGDGTIAAIEAKRYIENNFSE

SEQ ID NO: 19462 - protein, 578 aa, Arabidopsis thaliana
MCGILAVLGCVDNSQAKRSRIIELSRRLRHRGPDWSGLHCYEDCYLAHERLAIVDPTSGDQPLYNEDKTIAVTVNGEIYNHKALRENLKSHQFRTGSDCEVIAHLYEEHGEEFVDMLDGMFAFVLLDTRDKSFIAARDAIGITPLYIGWGLDGSVWFASEMKALSDDCEQFMCFPPGHIYSSKQGGLRRWYNPPWFSEVVPSTPYDPLVVRNTFEKAVIKRLMTDVPFGVLLSGGLDSSLVASVALRHLEKSEAACQWGSKLHTFCIGLKGSPDLKAGREVADYLGTRHHELHFTVQDGIDAIEEVIYHVETYDVTTIRASTPMFLMSRKIKSLGVKMVLSGEGSDEIFGGYLYFHKAPNKKEFHEETCRKIKALHQYDCLRANKSTSAWGVEARVPFLDKEFINVAMSIDPEWKMIRPDLGRIEKWVLRNAFDDEKNPYLPKHILYRQKEQFSDGVGYSWIDGLKDHANKHVSETMLMNASFVFPDNTPLTKEAYYYRTIFEKFFPKSAARATVPGGPSVACSTAKAVEWDAAWSQNLDPSGRAALGVHVSAYGEDKTEDSRPEKLQKLAEKTPAIV

SEQ ID NO: 19463 - protein, 443 aa, Mycoplasma penetrans
MHKVFLIYFYYLNIKYIIYIVFLIKQSNGGNMKNLILKEILNNELKRQQGYIELIASENYVSEQILEATGSVFTNKYCEGYPNRRYYGGCEYADQIEQLAIDKAKEIFNAKFANVQPHSGTQANVAAYLSVLKPNDKILAMGLNEGGHLSHGSKVNISGKTYEADHYGVDKETQCLDYDAILKQAQEVKPKLIVCGASNYSRVVDFKKFGEIAKSVGAYLLADVAHISGLIVAGYHPNPLPYADIVTTTTHKTLRGPRSGLILTNNEELIKKINSAVFPGSQGGPLMHVIAAKYLCFDEASKPEFKTYIKNVIDNIAILSQTLKELGYKIIADGSDNHLLSVDLYSSKQITGDLVEQWLEQAKIVVNKNLIPYDINSAKSPSGIRIGSAAMTTRGFTTKEFKQIGLWIHEIIESKGNPNTINKIRNEVDLLVKKFPIYQDIKY

SEQ ID NO: 19464 - protein, 652 aa, Unknown
  Rhodococcus sp. RHA1
MKAAQQVQEAGAATDDRINPDRLTESEIRTAVARANVPSLLMVVFQTTGDEKWLAAPYRPTRGKGLGDHDSGGLEEPIQDEIREAAVKAILDLQNGALPAVETPSPELTVRMISVCTGEEVGEEYGPMLSLELARRAAPDAPSLALEPVDAPEGYSVVVIGTGVAGIAAAQQLEDMGIDYVILEKQPEAGGNWWQNTYPGAGVDTPSHLYSFSFAKNDWTTHFELRNELQAYFGAVLKDLGAGERVRYGTEVRSTRYDEAAAQWSVDMINPDGSSSTLRADVVISAVGVLNRPKTPNVPGMDSFTGTSFHSAAWPDDLDLDGKRVAIVGTGASSMQIAPAIADRVAHLSIYQRSPQWVAPFEKFRAPIPMELRRLMQTCPIYHSWYWIRLFWQFGDKVIESLRVDPEWEHPERSVNARNDAHREYFTRYITSQVGDRTDLLDKVMPDYPPFGKRILLDNGWYSTLRKDNVDLVDRSVTAVRPEGLVDDQGAENDVDVIVWATGFEAARFVSSMDVVGMDGRTLREVWNDDDPKAYLGVSVPGFPNFFMLGGPNSFPGSGSFMFFMEVQMRYIRGLLTEMFKKGIKAIDARPEANEEYNELVDSTHARTVWTHRGMSTYYRNSHGRVVFVMPFLNVEYWQMTRRPDLENYTAR

SEQ ID NO: 19465 - protein, 413 aa, Methanosarcina mazei
MSEDSAIRSSLEDIKSRVEFQLECGEIIPEDVKTLLTEIEILKVQNENMKARLLEASVATGRHLQEINKLKAHLEQLTEPPLFIATILEVNGEIALIRQHGNNQEVLTQIPEECLGKIEPGMRVAVNGAYSIISIVSRAADVRAQVMELINSPGIDYSMIGGLDDVLQEVRESVELPLTEPELFEDLGIEPPSGVLLHGAPGTGKTLIAKAIASQAKATFIRMSGSDLVQKFVGEGSRLVKDIFQLARDKSPSILFIDEIDAVGSMRTYDGTSGSAEVNRTMLQLLAEMDGFDPKGNVKVVAATNRIDLLDPALLRPGRFDRSIEVPLPDDKGRIEILKIHTRKMKLADDVDFEKLAKVMSGRSGAEISVIVKEAGIFVLRRRGKEITMADFMKAYDKVVNVQEPTIPQAMFV

SEQ ID NO: 19466 - protein, 379 aa, Nepenthes alata
AVIGSGVLSLAWAIAQLGWVAGPAVLIAFSAITYFTSTMLADCYRAPDPVTGKRNYTYMDVVKAYLGGRKVQLCGLAQYGNLVGVTIGYTITASISMVAVKRSNCFHKHGHRDGCHTSNNPFMIAFACIQIVFSQIPNFHELFMASPIVAAAMSFAYSSIGIGLSIAKVAGGAHARTSLTGVAVGIDVTSTEKVWRTLQAIGDIAFAYAYANVLVEIQDTLKSSPPENKVMRRASLIGGRPPHSFYVLCGCMGYAAFVYDAPGNFLTGFGFYEPFWLIDFANVCIAIHLIGAYQVFGQPIFAFVEGWCRDMWPENKFITREHPIEVPFVGVYYLNLFRLVWRTTYVIITAIVAMLFPFFNDFLGLIGAASFWPLTVYFP

SEQ ID NO: 19467 - protein, 308 aa, Geobacillus stearothermophilus
MARTVNSITELIGDTPAVKLNRIVDEDSADVYLKLEFMNPGSSVKDRIALAMIEAAEKEGKLKPGDTIIEPTSGNTGIGLAMVAAAKGYKAILVMPDTMSLERRNLLRAYGAELVLTPGSQGMRGAIEKAEELVREHGYFMPQQFKNEANPEIHRLTTGKEIVEQMGDQLDAFIAGVGTGGTITGAGQVLREKYPNIKIYAVEPADSPVLSGGKPGPHKIQGIGAGFVPDVLDTNIYDEVITVTTEEAFAAARRAAREEGILGGISSGAAIHAALKVAKQLGKGKKVLAIIPSNGERYLSTPLYQFED

SEQ ID NO: 19468 - protein, 492 aa, Saccharomyces cerevisiae
MFHAFTFLKGGRFYSSLTVKSLYEQVHHTSHDPISINGWIKSIRLLKRIAFLDLQDGTSVNPLRIVIPLTNTDEVQFLKILKTGQTLSISNATWQSTPNRKQPFELQIKNPVKSIKLVGPVSENYPLQKKYQTLRYLRSLPTLKYRTAYLSAILRLRSFVEFQFMLYFQKNHFTKVSPPILTSNDCEGAGELFQVSTNTSPTASSYFGKPTYLTVSTQLHLEILALSLSRCWTLSPCFRAEKSDTPRHLSEFWMLEVEMCFVNSVNELTSFVETTIKHIIKACIDNQQELLPKQFISSQENNASSELSINQETQQIKTRWEDLINEKWHNITYTNAIEILKKRHNEVSHFKYEPKWGQPLQTEHEKFLAGEYFKSPVFVTDYPRLCKPFYMKQNSTPDDTVGCFDLLVPGMGEIIGGSLREDDYDKLCREMKARGMNRSGELDWYVSLRKEGSAPHGGFGLGFERFISYLYGNHNIKDAIPFYRTSAESIDF

SEQ ID NO: 19469 - protein, 118 aa, Triticum aestivum
  misc_feature (56)..(56): Xaa can be any naturally occurring amino acid
  misc_feature (64)..(64): Xaa can be any naturally occurring amino acid
  misc_feature (73)..(73): Xaa can be any naturally occurring amino acid
  misc_feature (91)..(91): Xaa can be any naturally occurring amino acid
  misc_feature (110)..(110): Xaa can be any naturally occurring amino acid
MGRRPARCYRQIKNKPYPKSRYCRGVPDPKIRIYDVGMKRKGVDEFPYCVHLVSWXEKENVSSXEALEAARYXPCNNYMTNPARKGSFHLXRVPGHPFHVPSVSTNLSCXGADRSQTG

SEQ ID NO: 19470 - protein, 104 aa, Triticum aestivum
  misc_feature (2)..(2): Xaa can be any naturally occurring amino acid
  misc_feature (56)..(56): Xaa can be any naturally occurring amino acid
  misc_feature (90)..(90): Xaa can be any naturally occurring amino acid
CXVPIAQSSISAKRGGQFVIDPATFPEGSAGAAWPFAGGFVMGSTVEGEGKASRPXVQVGVQHVACMGDVAVFIALSAAVDLCMDACKLXSHRLRKELCQDQDD

SEQ ID NO: 19471 - protein, 470 aa, Unknown
  Burkholderia sp. 383
MGKQAIGVIGLAVMGRNLALNIESRGYAVSVYNRSREKTDELIAEFPGRNLVPTYTLEEFVASLETPRRILMMVKAGEATDATIASLKPLLEKGDVLIDGGNTHFTDTIRRNQELAQSGLHFIGTGVSGGEEGALRGPSIMPGGQRDAYDLVEPILKQIAAKAPSDGEPCVAYMGPDGAGHYVKMVHNGIEYGDMQLIAESYAVLKDVAGLTNDELGAVYTEWNQGELDSYLMEITSKIFGKKDEETGKHLVDVILDRAAQKGTGKWTSQNALDLGVPLPLITESVFARVLSSLKTERVAASKVLSGPAAAPFDGDRAAFVEAVRRALYLSKVISYAQGFAQLRTASEEYGWNLDLGTIAKIFRAGCIIRARFLQKITDAYAKDPALANLLLDPYFKDIAANYQASLRDVVVAAVKAGVPVPAFASAVAYFDSYRSERLPANLVQAQRDFFGAHTFERTDKPGSFHANWS

SEQ ID NO: 19472 - protein, 297 aa, Nepenthes alata
DQFDDTDPREKIKKGSFFNWFYFSVNIGALISSSLIVWVQENLGWALGFGIPAISMGIAIASFFSGTALYRLQKPGGSPLTRMCQVLVASFRKSKLALPEDSNLLYETSDENSVIEGGRKLEHTNDLKCLDKAAVVSDKEIKCEDFSNPWRLCTVTQIEELKILIRMFPIWATGIVFSAIYAQMSTMFVEQGEVMDRTIGSFTIPAASLSMFDTISVIFWVPVYDKILVPLARKSTGKQRGFSELQRMGIGLFISILSMAAAALVEMKRLQLAKELGLVDEDVAVPLSIFWQIPPYF

SEQ ID NO: 19473 - protein, 234 aa, Hyphomonas neptunium
MSDDDRRRWKGPGPERQDSGRRSTERKVIARNARTESSKRWIERQLQDPYVRKAKDEGYRSRAAYKLLEIDAAAKILRKGMRVVDLGCAPGGWIQVSLQQGAAEVVGIDLLPLDPIEGATIIEGDVNNPDDVARMMAGLSGTPDLILSDMAANTTGHKQTDHLRTVALVEMAVAFAIEHLDDGGAFCAKVFQGGATKDVLNLLKQHFRTVKHIKPAASRAGSPEIYVVAKGFRR

SEQ ID NO: 19474 - protein, 288 aa, Zymomonas mobilis
MESKDDLPKGRENRQKDSVMTNLLDPDARGRVILVGAGPGNPELLTLRAVEVLRQADVVVYDAEIDEGILAYIPKTAQAISVCSESEGEKNERQPLTQGEINALVIAHVRTGSIVVRLKGGDPFVFGRGGEEVEAVRAAGMPVEVVPGVSAALGCAADAMLPLTHRGLSDVVSFVSTPEQETASSVNWKGLAGSGHTLVVYMDIKKARFITQCLIHEGIESHIPVVIIERGTCKDSRIIRSVLINLENTIQNEKVVGPAILIVGDVALFAKPKNTLHQDYEELDAMAD

SEQ ID NO: 19475 - protein, 574 aa, Ostreococcus tauri
MSRTAFEAKTNARRAGRAGVRARAKESTTTIAEIAKSTRPMKIVFVSAECSPWSKTGGLGDVVGSLPVELAKRGHKVMTVSPRYDQYAGAWDTSVHVEALGKSVGFFHEKKQGVDRIFVDHPDFLAKVWGKTGSKLYGEKSGHDFADNQERFAMFCHAALKAPMALTDLGYGEDVIFVANDWHSALVPVILNKVLKPAGMFAKAKCAMTIHNIAFQGRFFPQPMSKYGLPEDAADDFFFEDGYSKVYDENTPAKEQGKEDFDGKIYRKVNWLKAGFMNSDRNLTVSENYAKEIASSKAKGVELDHVIREFGMEGIVNGMDPAEWNPAKDKFIDVPYDKTTVVEGKAAAKQALQAEVGLPLDPTAPVFGYIGRLEEQKGCDIMFEAVPKLLKAVPNAQVVILGTGKKVMETALEKLDAAEPNCAGVVKFSAPLAHFINAGADFLMVPSRFEPCGLIQLHAMQYGTVPIVSSTGGLVDTVKEGVTGYHMGAMDADDLLPADVDAMVETCASAAADFSTPLYKKMSATCISQDLTWAEPAKKWEGVLEEMYFGTPETTKKAEVVVPIAKADALAAQT

SEQ ID NO: 19476 - protein, 475 aa, Ostreococcus tauri
MSERRIARGRDARARVVTRMDASAAEAPMRSPNAIANTKTVAAVILGGGAGTRLYPLTKSRAKPAVPIGGAYRLIDVPMSNCLNSGISKVYILTQFNSASLNRHLARTYNFGNGIMYGGNGFVEVLAATQTPGQGGKEWFQGTADAVRQYSWLFNDVKNKDVEDIVILAGDHLYRMDYMKFVEAHRESNADISVGTLPIDEARASDFGLMKIDSTGRIVEFTEKPKGDALQAMKVDTTVLGLTADEAKEKPFIASMGIYVFKKSALVKFLEKDYPEDNDFGGEIIPRAAADGAKVQAYLFNDYWEDIGTMKSFFEANLNLAKDPPNFEFYNAEAPIYTSPRFLPPAKVERCHVKESIISHGASLADCQVEESIIGLRSVVNKGCRIKRAMIIGADFYESDEKKASLLASGEVPVGIGEGTIIENAIIDKNARVGKNCVITNAAGVEDLADEERGVFIRNGIITILRNCTIPDGTI

SEQ ID NO: 19477 - protein, 173 aa, Prunus avium
RRLVSHHRHGHHHQQQHLNAQMPDHLLHQQHTRLVGNAANLNCANSVPLQANPGNWFYWATATAAPSPSPAMMPSITPEAAPPPPVQQMDRPASTQAQNYNQGRSAAQERQERRQGWKSEKNLKFLLQKVLKQSDVGSLGRIVLPKKEAETHLPELEARDGISIPMEDIGTSR

SEQ ID NO: 19478 - protein, 251 aa, Geobacter metallireducens
MSSVTMKELLEAGVHFGHQTKRWNPKMKPYIFGARNGIYIIDLQKTVRLFKNAYSFVRECAQSGETILFVGTKKQAQDAIGEEASRCNMYYVNQRWLGGMLTNFATVKQSIDRLKRLDAMFADGTVEAYTKKEALQLEKERQKLEKTLGGIKGMGKVPGALFVIDPKNETIAINEAKKLGIPVVAVVDTNCDPDPIDYVIPGNDDAIRAIRLLTSKMADAVLEGAQARDAQLQTGEEEMAAAEGESEQVEA

SEQ ID NO: 19479 - protein, 95 aa, Protea effusa
LYAGINISGTNGEVMPGQWEYQVGPSVGIEAGDHIWCSRYLLERITEQAGVVLTLDPKPIEGDWNGAGCHTNYSTKSMREDGGFEVIKKAILNLS

SEQ ID NO: 19480 - protein, 201 aa, Brachypodium sylvaticum
MDPTKSSTPPPPPVLGAPVGYPPGAYPPQPGAAAAAYAPQLYAPPPAAAAQQAAAAQQHLQMFWAEQYREIEATTDFKNHNLPLARIKKIMKADEDVRMIAAEAPVVFARACEMFILELAHRGWAHAEENKRRTLQKSDIAAAIARTEVFDFLVDIVPRDDAKDADAAAAAAAAAAAAGIPRPAAGVPATDPMAYYYVPQQ

SEQ ID NO: 19481 - protein, 137 aa, Arabidopsis thaliana
  misc_feature (50)..(50): Xaa can be any naturally occurring amino acid
SRAGHTRPENPKRVRNQQEEVWVSFMSSSTVGVTSRVKATMVVPLTGWKXSVFFRVTRRANNDFTSLTGNGGGVSCMKGGPPIGKKKLGTLFYLPDLRDVEWVKEVDYLFRTKGIPGVEFKWEHGFWYREHGNTPGS

SEQ ID NO: 19482 - protein, 455 aa, Guillardia theta
MAPWMAVVAMVAIGMQVALAVPTHSRRRAGGGLAEPLAPGATDEITDLPGLPKEVSKFKQYAGYIPVGGGKSLFYWFVEAQKNPASSPLVLWTNGGPGCSGLTGFLSEQGPFRAEKGGQLSLNKYSWNRVANMIFIEQPAGVGFSQGPSNMTYGDAEAAKDNRAFVLGFLSRYPMYKDNDLYLTSESYGGHYIPTLAMLLLDLPNFKGFAVGNPLTWMPYRDYGQYAAYASRQLIPKPLWDRFVALGCFLFPSANQTDCDSMTASMDAMTANMDPYALDFPICQTPSLASGRTERYLLLKKIASADKKQRKTLSGYFPKYKPCVDDYMTQYLNRKDVQKAIHVSNPGSVTWSVCSDVVNEAYNPKDVAAPMMGVYNELIKHGGLKMMIYSGDDDSICSTAGAQMWIWGLGKPIEEWQQWSSKGQVAGFTVKFPGLRFTTVHGAGHMVPSTAQAGI

SEQ ID NO: 19483 - protein, 446 aa, Oryza sativa
MATADVSRPSSSALTAAAAGADGHGAKGSAFRGDGLRPYYQSRIHDLELQIRQGTDNLSRLEAQRNVLNSQVITLGEELKVLHEPGSYVGEVVKVMGKSKVLVKCCVLVFVHMSVALEIIGEDNILLVHPEGKYVVDVDKSIDITKLSPSTRVALRNDSYMLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMQSGSGGGDSEVQRTMLELLNQLDGFEASNKIKVLMATNRMDILDQALLRPGRIDRKIEFPNPNEDSRFDILKIHSRKMNLMRGIDLKKIAEKMNGASGAELKAVCTEAGMFALRERRVHVNQEDFLMAVAKVMKKDTEKNMSLRKLWK

SEQ ID NO: 19484 - protein, 63 aa, Protea holosericea
MPGQWEYQVGPSVGIEAGDHIWCSRYLLERITEQAGVVLTLDPKPIEGDWNGAGCHTNYSTKS

SEQ ID NO: 19485 - protein, 310 aa, Gibberella zeae
MSLTNCRFYEEKYPEIDSFVMVNVKQIAEMGAYVKLLEYDDIDGMILLSELSRRRIRSIQKLIRVGRNEVVVVLRVDKEKGYIDLSKRRVSPEDIVKCEERYNKSKMVHSVMIHLAKATEIPLETLYQAIAWPLNKKFGHALDAFKLSITNPEVWNDITFPDEVTAQELKTYIGKRLTPQPTKVRADVEVTCFGYDGIDAIKTALHTAEAKNTEETQVKVRLVSPPLYVLNSTCLDKSLGITRLQEAIVDIRASIEAAGGHLTVKMEPKAVTESDDAELQALMEKRERENAEVSGDESMSDSDENIPETM

SEQ ID NO: 19486 - protein, 143 aa, Brachypodium sylvaticum
MATSTAAVLSPPSVAGLRLAPSPRAAVSFRAAPPTARRSVAARAALEPSVVISLSTGLSLFLGRFVFFNFQRENVAKQVPAQNGKTHFEAGDQRAKEFAGILKSNDPVGFNIVDVLAWGSIGHIVAYYILATTSNGYDPSFFG

SEQ ID NO: 19487 - protein, 296 aa, Brevibacillus agri
MADKVTIGLIQAKNDVHGDEPVHLHKEKAIEKHVKMVREAAGKGAQIICLQEIFYGPYFCAEQSTKWYEAAEEVPNGPTVQQFSALGKELGTVLILPVYEKVGIGTYYNTAAVIDADGTYLGKYRKQHIPHVGVGSSGCGFWEKYYFKPGNLGYPVFDTAFAKVGVYICYDRHFPEGARLLGLGGAEIVFNPSATVAGLSEYLWKLEQPAHAVANGYYVAAINRVGTEAPWNMGEFYGQSYLVDPRGQFVAVGSRDQDEVIVAEMDREKIREVRDTWQFYRDRRPETYDDMVKLLP

SEQ ID NO: 19488 - protein, 206 aa, Schizosaccharomyces pombe
MNANINRYDYLFKLLLIGDSGVGKSCLLLRFADDTYTESYISTIGVDFKIRTFELEGKTVKLQIWDTAGQERFRTITSSYYRGAHGIIIVYDVTDQDSFNNVKQWLQEIDRYAVEGVNRLLVGNKSDMVDKKVVEYSVAKEFADSLNIPFLETSAKDSTNVEQAFLTMSRQIKERMGNNTFASSNAKSSVKVGQGTNVSQSSSNCC

SEQ ID NO: 19489 - protein, 154 aa, Debaryomyces hansenii
MSADHTRDPCPIVILNDFGGAFSMGVIGGCVWHGIKGFRNSPYGERGYGSISAIKSRAPVVGGNFGVWGGLFSTFDCSVKAVRKREDAWNAVIAGFFTGGALAIRGGWRHTRNSAITCACLLGVFEGVGMMMQRVMAQPTVAPAYPEEAAPLAA

SEQ ID NO: 19490 - protein, 130 aa, Unknown
  Oceanospirillum sp. MED92
MPFQLEFKVRDYECDMQGIVNNGVYFNYLEHARHEFLLDKGIDFADLTTKKIHLVVIRSEMDYKHSLTSGDRFAVQVEVEQISKVKFGFRQKVIRLSDEKIALEALVTGTALNEKGRPFVLPEIEALISG

SEQ ID NO: 19491 - protein, 425 aa, Bacillus subtilis
MSAKQVSKDEEKEALNLFLSTQTIIKEALRKLGYPGDMYELMKEPQRMLTVRIPVKMDNGSVKVFTGYRSQHNDAVGPTKGGVRFHPEVNEEEVKALSIWMTLKCGIANLPYGGGKGGIICDPRTMSFGELERLSRGYVRAISQIVGPTKDIPAPDVYTNSQIMAWMMDEYSRLREFDSPGFITGKPLVLGGSQGRETATAQGVTICIEEAVKKKGIKLQNARIIIQGFGNAGSFLAKFMHDAGAKVIGISDANGGLYNPDGLDIPYLLDKRDSFGMVTNLFTDVITNEELLEKDCDILVPAAISNQITAKNAHNIQASIVVERANGPTTIDATKILNERGVLLVPDILASAGGVTVSYFEWVQNNQGYYWSEEEVAEKLRSVMVSSFETIYQTAATHKVDMRLAAYMTGIRKSAEASFPRMGLI

SEQ ID NO: 19492 - protein, 699 aa, Adiantum capillus-veneris
MAKPCTIVWLRRDLRLEDNPALCAAGRIGNVVPVFIWSPEEERQFHPGRVSRWWLKQSLIQLDVSLRSFGVPLVMRKSTDTLGTLQELIKATGATQVFYNHLYDPISLVRDHHVKQGLTQSGIQVQSFNGDLLYEPWEVLNDDGKPFTSFESYWQKCLNMPFEPDSPLLPPRRLTSIAGSIPTYTPEELGLEDETEKSSNALLARAWAPGWSNADRALEAFLAGPLLEYSRNRHKIDGPTTSLLSPHMHFGEVSVRKVYHSVRRLQLLWAKDGSKLGEESIYFFMRSIGFREYSRYLSFNFPFTHERSLLSNLKSFPWRVDEGFFKAWRQGRTGYPLVDAGMRELWATGWLHNRVRVIVSSFCVKFLQLPWRWGMKYFWDTLLDADLESDVLGWQYISGSLPDGHELDRMDNPQTEGYKHDPVGEYVRRWLPELVRLPTEWIHHPWDAPPAVLRAAGVELGSNYPRPIVEVAAARERLRQAVAQMWEQEAALKAAGVATDAEALDENLEVKVVTPPLVSTHSLKTAVAGTLSRSSLRDQRVPTCGKQLSMENGVPHEGDNSPDIAMSPQQDNLLATTAPPEAHSTAEKCDNKSMNCDQTPEPKHNVPPPAVSDGNSTAESSSSPKQVNDELRNGVPLVWVPSIVNQQPVVEPSCVPYAGDAGQLRKHLLALQNSRTENKMEEKSPLSEWRRRTKRKAKA

SEQ ID NO: 19493 - protein, 226 aa, Glycine max
MLQCLEGLKPLFASILRCCDLDIYNQPRGLEDPELLARETVFSVSEIEALYELFKKISSAVIDDGLINKEEFQLALFKTNKNESLFADRVFDLFDTKHNGILGFEEFARALSVFHPNAPIDDKIEFSFQLYDLKQQGFIERQEVKQMVVATLAESGMNLSDDVIESIIDKTFEEADTKHDGKIDKEEWRNLVLRHPSLLKNMTLQYLKDITTTFPSFVFHSQVDDT

SEQ ID NO: 19494 - protein, 98 aa, Anabaena variabilis
ATFKVTLINEAEGTKHEIEVPDDEYILDAAEEEGYDLPFSCRAGACSTCAGKLVSGTVDQSDQSFLDDDQIEAGYVLTCVAYPTSDCVIQTHKEEDLY

SEQ ID NO: 19495 - protein, 170 aa, Nocardia farcinica
MTDTRRAILAGGCFWGMQDLIRRQPGVVSTRVGYTGGTNDHPTYRNHPGHAEAVEIVYDPERTDYRALLEFFFQIHDPTTKDRQGNDIGTSYRSAIFYLDDEQRRVAEDTIADVDASGLWPGKVVTEVTPASEFWEAEPEHQDYLLRYPNGYTCHYPRPDWKLPKRQATA

SEQ ID NO: 19496 - protein, 228 aa, Arabidopsis thaliana
MPTLYKKAGCQFQLTTMEENNGNNNHYLPQPSSSQLPPPPLYYQSMPLPSYSLPLPYSPQMRNYWIAQMGNATDVKHHAFPLTRIKKIMKSNPEVNMVTAEAPVLISKACEMLILDLTMRSWLHTVEGGRQTLKRSDTLTRSDISAATTRSFKFTFLGDVVPRDPSVVTDDPVLHPDGEVLPPGTVIGYPVFDCNGVYASPPQMQEWPAVPGDGEEAAGEIGGSSGGN

SEQ ID NO: 19497 - protein, 588 aa, Oryza sativa
MSSPPDSATTCNFLFSPPAAQMVAPSPGYYYVGGAYGDGTSTAGVYYSHLPVMPIKSDGSLCIMEGMMPSSSPKLEDFLGCGNGSGHDPATYYSQGQEAEDASRAAYQHHQLVPYNYQPLTEAEMLQEAAAAPMEDAMAAAKNFLVTSYGACYGNQEMPQPLSLSMSPGSQSSSCVSAAPQQHQQMAVVAAAAAAGDGQGSNSNDGGEQRVGKKRGTGKGGQKQPVHRKSIDTFGQRTSQYRGVTRHRWTGRYEAHLWDNSCKKDGQTRKGRQGGYDTEDKAARAYDLAALKYWGLSTHINFPLENYRDEIEEMERMTRQEYVAHLRRRSSGFSRGASIYRGVTRHHQHGRWQARIGRVAGNKDLYLGTFSTQEEAAEAYDIAAIKFRGLNAVTNFDITRYDVDKIMESSSLLPGEAARKVKAIEAAPDHVPIGRELGATEEASAATVTGTDWRMVLHGSQQQQAAACTEATADLQKGFMGDAHSALHGIVGFDVESAAADEIDVPGGKISGINFSNSSSLVTSLSNSREGSPERLGLAMLYAKHHPTAVSLAAMNPWMPMPAPAAAHVMRPPSAIAHLPVFAAWTDA

SEQ ID NO: 19498 - protein, 159 aa, Prochlorococcus marinus
MQVDVQNTTVLSADGSSIQLGEYSGEVILVVNVASYCGNTAQYEDLQKLHDLYSTKGLRILAFPCNDFGKQEPDSLSEIKDFCTTKYGIKFEIYEKVHAKGNTTEPYTTLNKVEPEGDVEWNFEKFLIGKDSKVIARFKPTVKPFDENLIAAIEVALDS

SEQ ID NO: 19499 - protein, 72 aa, Bartonella quintana
MSKEEVLEFSGIVTELLPNAMFRVKLENDHEIIAHTAGRMRKNRIRVLAGDKIMVEMTPYDLTKGRITYRYK

SEQ ID NO: 19500 - protein, 456 aa, Oryza sativa
MAAAGASALRPHLALLPAGGGGGGGGGTRSYALQALSFVSPLLPHCGRRRRCVLRSKASSSPSPPPSPGKEAVAVPTAESCVNLGLELFSKGRGMVKLNPKIFDHILMSILSLNIRLGLNEHLGLEQVGPGINSIKMRETFSPYAPSNSALSKAAIKSREESNKAADCLRTALRDYNLKFGTILNDPDLAPFRASPEFKELQEEALRGGEDIGSGFRRDLKLISEVQAPFRGVRRFFYVALTAAAGISTFFTIPRLILAVQGGDGAPDLLETVGNAAINIGGIVVLVALYFWENKKEEQQITQISRNETLSRLPVRLSTNRIIELVQLRDITRPVILAGSKASITRAMQRAERYRTELLKRGVLLIPVIFGASQKAQTKSRLKAEERFKADIVSPEQWESWIRDQQESEGVTPGEDVYIILRLDGRVRRSGRGMPNWNDILQELPRLEELLSKLER

SEQ ID NO: 19501 - protein, 209 aa, Vibrio cholerae
MSKQKHSASSTRWLKEHFDDKYVNEAKKKGYRSRAIFKIEEIQNKDKLLKAGMTVVDLGAAPGGWSQFAAKVVGEGGRVIACDLLPMESIAGVSFLQGDFREEAVLNALLDRIQPDMVDVVMSDMAPNMAGNLSVDQPRAMYLVELALDMCRQVLAPNGSFVVKVFQGEGFDDYVKAVRDLFKVVKIRKPDSSRSRSREVFIVATGYKG

SEQ ID NO: 19502 - protein, 386 aa, Hyphomonas neptunium
MSKRDYYEVLGVERGVDEKALKSAYRKLAMKYHPDQNAGDTAAEDKFKEVGEAYAILSDPQKRAAYDRYGHGAFENGGMGGGSPFGGQGGNPEDIFQDLFSQVFGAGGFAGGRRRSGPQRGADLRYDLEITLEEAFYGKDETIHVPQAVACRPCEGTGAAPGTKPETCETCGGHGRVRAQQGFFTMERTCHICQGRGQIIRKPCKTCGGHGQVKEERKLQVKIPAGVESGMRIRLSGEGEPGTSGGPKGDLYIFVEVVEHDIFERDGPNLYCRAPVPMTTAALGGEIDIPTIDGGRARVAIPEGAQTGRKLRLRSKGMPSVRANGQTGDLYVEMFVETPQNLTARQKDLLRQFCDCSGADCHPESEGFLGKIKRFWGGEGDEKRPV

SEQ ID NO: 19503 - protein, 467 aa, Rhodopseudomonas palustris
MLQVTGIPDACDNLAPIPMECDAPFLSIKGELPRELNGTLYRNGANPQFVSPNAHWFFGDGMLHAFHLENGRASYRNRWVRTPKWLAEHEAGRPLYGEFNLKLPDAPRSVPDDGNVANTNIVFHAGRLLALEEAHLPMQIERDTLETRCYCDYGGALKGPFTAHPKIDPVTGEMLFFGYNASGPLTRTMSFGAIDASGNVTRLEHFKAPFAAMVHDFIVTEHHVLFPILPLTGSIWRAMRGRPPYAWDPRKGSYVGVMKRSGSTRDVRWFRGEACFVFHVMNAWEDGTRIVADVMQSEEAPLFTHPDGRRTDPEKGRARLCRWSFDLAGNTNAFKRSYLDEISGEFPRIDERRAGLRSGHGWYACASPETPMLGMLTGLVHVDGNGHRRTRYLLPTGDTIGEPVFVPRAADANEAEGWLLAVVWRGCENRSDLAVFNATDIAAGPIALVQLGHRIPDGFHGNWVPAG

SEQ ID NO: 19504 - protein, 276 aa, Bordetella bronchiseptica
MTPTGKIAAIQFDVRQGENDANRARSCELARQAAAAGANLIVLPECCVGGLVFDSRDEIRAVSETVPGPSTRAWSQVSRETGAWIVAGLSETDGAKIYNTAVLVGPNGELHRHRKLHVRGIEQRLFDVGDALTCVDTPLGRIGLAICYDMWFPEVCRNYALDGVDVVAAPANWSKSVRTADAFDAYGLPQGYHLMAATAVSNELVVVAADRVGTERGVAFLGTSCIFGPSGEALCPAASRGEEQILLADWPDIAAVRAQGGPHLGQRQPAVYPVTR

SEQ ID NO: 19505 - protein, 532 aa, Yarrowia lipolytica
MSYGTAPIDYPPDRQRRSSILIPSIPSSPFTGVNSLGRFASSFQRAQSFLNLDPPQGLNRERTYFDDDEFSPYRRGDHTGDDESVFDESDFLDEPSFAYTESVQPRSRLDSLVSQDAPLLVKRVENADGTIVTSVEGQSTAPQTVFNSVNVLIGVGLLSLPLGFKYAGWGIGMVLLLASAYSTHYTAKLLAKCMDTDPSLVTYADIGYAAFGSKARVLVSLLFSLELVAACVSLVVLFADSLNALVPQVTKTEWKVVAFFVLTPPTFLPLSVLSISSIMGIMSVVGLVVIVFIDGLVKPTAPGSLLDPMPTSMFPHAWILVPLSFGIFMAPWGGHAVFPNIYRDMRHPQKYTKCLKTTYRITLGLDLAMGVLGFLMFGDQIQDEVTKNILTTEGYPAVLNVIVTVLIALIPLSKTPLNARPIISTLDALFNIQASQTPGAKIARVSTRCICVATFVILSMVFPSFDKIIALMGSGFCVSICLILPLSFYLKIFRHDIKGGERFFIYALLLIYSAVAVVGTIWSFLGVEPPHV

SEQ ID NO: 19506 - protein, 165 aa, Triticum aestivum
VAGSAQGGYLKDLSAPSGFKYVEGSRPWKLVERVDVALPSATQNELDEEDAKALVAAGCGFVAEGANMPCTLEAINVFEAARKEKGSKGVWYGPGKAANCGGVAVSGLEMAQNSARLQWTEEEVDAKLKNIMQTAFKTCYETAQEFAGEGELPSLVSGANIAGFL

SEQ ID NO: 19507 - protein, 399 aa, Ostreococcus tauri
MVRSGMRYGYRINGEGGWDTGQRFDATKVLMDPYAPLVEARRKVFGEWSKHKVSGDTNDPDMLSGYDFESAPFDWRGVESPQIDEKDMIVYEMTVRAFTADASSGLDADARGSYAGVAAKVEHLKSLGVNVVELLPVFEYDEMEFQRIPNPRDHMVNTWGYSTMSFFAPMTRFGKKGCSAREASREFKEMVRALHAAGIQVILDVVYNHTGEMNDELPNTCSMRGIEYKTYYMTDTNQYVQMLNFTGCGNTLNANNPYVSQFILDSLKHWVKEYHVDGFRFDLASALCRDEQGHPMNSPPLIRAIAKDPELAHVKLIAEPWDCGGLYQVGSFPNWDRWSEWNGAYRDVLRRFIKGDEGMKSDFARRISGSSDMYHHNNRKPYHSVNFITAHDGFTLRDL

SEQ ID NO: 19508 - protein, 501 aa, Geobacter metallireducens
MKIKRIALITPPYHAGVVESAGTWLNVGFVYIAGALRAAGYEVDYYDAMSLWHKWPDIQKRIEAFRPDMVATTAYTASIVEAVKLLRFAKSINPRIVTALGNVHAAFCYDEVLTHDHDAVDYIVRGEGEETLPMLCHCLNAGDDPKKVLGIAYWRDGGVVVTPKAPYIHDLDNLPTAWDLVEWPIYTYRAKKNARLAIVSSSRGCKSQCSFCSQQLFWAQSWRARSAENFVAELEMLHNVHGVQVAMLSDELPTFDRERWVRILDLMVEREVPVKLLMETRVDDILRDADIMDKYREGGVEHIYVGVEAGSQETLDLFKKDTEVAQSKQAIDLINGADIVSETSFVLGMPDDTPESIEQTIELAKHYNPDMAFFLAIAPWPYAELYPELEPYVATKDYRKYNLVEPVIKPKNMTMEELERQLGKASQKFFMHKFQNLDKLSPWKQEFMLSVLDLLINHSYLAGQMKAMLKEGKEMPAEVKALLKTVSQHKHVPHQTIAPIP

SEQ ID NO: 19509 - protein, 469 aa, Brachypodium sylvaticum
MATGAFAAAAPHQRLGPLAGGVVDEQQAAGVGILLQISMLVLSFVLGHLLRRRKFYYLPEASASLLIGMIVGAFANISNTQKSTRRWFNFREDFFLLFLLPPIILYPLRKPFFSNFGAIITFAILGTFIASIVTGLLVYYLGGLIYIIYRLPLVECMMFGALVSATDPVTVLSIFQVSAIPLSTIILTFASSIIVELGTDVNLYALVFGESVLNDAVAISLYRTMASMRTNSSGQNFLLVILRFLENFVGSMSSGIGVGLISALISSTLFFLFKYAELGVENLHNLESCLFVLFPYFSYMLAEGLGLSGIVSILFTGIVMKRYTFYNLSEDSQRFTARFFHLLSSLAEAFMAANVFSCAYILNLARPPHSQIPRQYQLALWYSGLRGAMAFALALQSVHDLPEGHGETIFTATTSIVVLTVLLIGGSTGTMLEALQVVGDSNRYRHPYEASAFAVLKSNTNNFVYKIQP

SEQ ID NO: 19510 - protein, 163 aa, Brassica napus
  misc_feature (151)..(151): Xaa can be any naturally occurring amino acid
FSSSSSSSPPSVPPPKASLKNGHEEDTFEYKTTEDVEVIDDWEEEEYEVEAKLGDGGDGGGVVLRGVPWGERVLSIASQVLKESEKDLQLFAFRTSPRGYIYIRLDKPSHEYGCPSMDELEEFSREYKKRLDDAGDAQVVPEDLALEVSSXGAERLLKVPEDL

SEQ ID NO: 19511 - protein, 173 aa, Methanosarcina mazei
MVRKPGSMYRNVRQRSFTRRKYMGGVPGSQVIHYDMGDKANTTFPVKISLVAEEKCQIRHTALEAARITANRHLVADAGKMGFYMKLRVYPHEVLRENKQATGAGADRVSSGMRRAFGKNVGTAARVNSMQKLFTVAVEKQNFPAAKKALWHAGQKLPTPVRIVIDEGAELVQ

SEQ ID NO: 19512 - protein, 280 aa, Vernicia fordii
MDLEFLQTLDVQILVGVAVAVLAIGIGAVFLFSSKKPKGCLDPENFKDFKLVNRTQLSHNVAKFSFALPTPTSVLGLPIGQHISCRGKDSQGEEVIKPYTPTTLDSDVGHFELVIKMYPQGRMSHHFREMRVGDYLSVKGPKGRFRYQPGQVRAFGMLAGGSGITPMFQVARAILENPNDKTKVYLIYANVTYEDILLKQELDGLAANYPDRFKVYYVLNQPPEVWDGGVGFVSKEMIENHCPAPASDIQILRCGPPPMNKAMAAHLEALDYTSDMQFQF

SEQ ID NO: 19513 - protein, 279 aa, Vernicia fordii
MESIQSHRAEMITIAVALFAIGAGTAYYFYITSKKPKGCLDPEKFKEFKLVKRTELSHNVAKFKFALPTPTSVLGLPIGQHMSCRGKDSLGEEVIKPYTPTTLDSDLGYFELVIKMYPQGRMSHHFREMCEGDCLAVKGPKGRFKYQPNQVRAFGMLAGGTGITPMFQVARAILENPIDKTNIQLIYANVTFEDILLKEELDNLANNFPNLFSVYYVLNQPPEGWDGGIGFVSKEMIQNHCPPLAPDVQILRCGPPPMNKAMAAHLDALGYTSQMQFQF

SEQ ID NO: 19514 - protein, 410 aa, Aspergillus nidulans
MFITSAAAFVWANLNPTNYIGSVSFCPERDIPDLAGKVVLVTGETIRQIIKHNPEQVFLAARSEEKAQNAIRELESTAPNIKITWLPLDLASTKSIHDAAETFRAHASRLDILILNAGVMSLPPGETDLGHEIQLGTNHTGHFLLTKLLLPVLLETAQKPDSDVRVISLSSIGHNLAPDFETILHQDELKKCNTNARYGASKAANIIFAAELARRYPSLTAVSVHPGIIVTELYAATSASNPIAALAVKLLGLIATKVEQGAWNQLWAAVGAKKGELVNGAYYTPVGIVKQRNRYVVDQKMGRRLWEWTETELKRDHKEGFIERMLQPHPHHQRRRSSVGEGEIEKPDLAIGLERQSSTERNEQGQNQAESGGQNVLRPQRRNSRLQRLKEFMHSEEELDDAGKTYAKLM

SEQ ID NO: 19515 - protein, 328 aa, Rhodococcus erythropolis
MTIPSAVHDVIIVGSGPAGYTAGVYTARAELQPLLFEGTQFGGALMTTTEVENFPGFREGIMGPDLMEQMREQALRFDTDIRTEDVEEIDLSGPIKTVVANGETYAAHAIILAMGAAARYLGIPGEERLLGRGVSACATCDGFFFRDQDIVVVGGGDSAMEEATFLTRFARSVTLVHRREEFRASRIMLERAKANEKIRFLTNAEPVEVLGENSVTGLVVRDTVTGETSTLEITGMFVAIGHDPRSELVKGQVDLDDAGYVRVAPGSTATSVDGVFAAGDLVDHTYRQAITAAGTGCSAAIDAERWLADRGDITANTLDAAGHTVDAV

SEQ ID NO: 19516 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQVTIFYRSAAGEELQ

SEQ ID NO: 19517 - protein, 467 aa, Prosthecochloris aestuarii
MQIEHPDTNASAPPTQYSSERLDRLVAERKTRKKWLLIQPKSTTSMMVDSGTVSMPLNLLMVATLAAELFDVTFIDERLGDPIPEDFSGYDVIAITSRTLNASKAYAIGDAAKAQGKIVILGGVHPTMLHDEAREHCSSVVYGEIESVWTELATDIILGKMQPVYKAESLKPMGSMRRADFSYALQTKNAKKYSSLIPILATKGCPVGCNFCTTPTIYGKNYRYREIDFVIDEMRYHQERLGKQKINFSFMDDNISFRPAYFMELLEEMAKLGIRWNANISMNFLHKPEIAELAGRSGCDLMSIGFESLNPETLKSVHKGSNRLDNYETVVSNLHKNGVAIQGYFMFGFDNDSEESFQLTYDFIMKNQIEFPVFSLVTPFPGTPYFDEMKPRIRHFDWDKYDTYHYMFEPNTMTGEKLLENFVKLQKEVYKGRAIMQRMKGKPLNWVWFVNYMMHRFTKKLTPEIYL

SEQ ID NO: 19518 - protein, 529 aa, Unknown
  Magnetococcus sp. MC-1
MQNNLEHAPHGDAARSLDLATLVYAVFTAGLCSIIYELLIATTVVYFLGDSVRYFSLTIGLYMASMGAGAYLSKYMQGVLLHKLIVAEIILGLVGGFCVPLLYLAFTYEALFLPLYVVLTLTVGFLIGLEVPLLTRILEGYDSLRVSIAHVLSLDYLGALVATVAFPLLLLPLFGIFRSGLFFGLVNMSIAVLLLWRFGSRLGSHRIKSYRLAAWSITLAIGAGLLFAQVLLQAWNQSVYRDRILHTEHTAYQEVVLTKRRDDLRLYLNGALQFSTSDEFRYHEALVHLPMAYVQAAKARGPLSVLVLGGGDGMAVRELLRYNRIERITLVDLDERVLKLATENPYLRQANAASLSRDERVKIRVGDAMRFLQERAALFDLIVADLPDPSSTETARLYSRAFYRLARSNLAPAGVFVTQATSPFHAREAFWTTHATVADVFAQARPYHLLVPSFGDWGFVMAGGAVLQTPLEQVVKDFPPGLRHLRPAMATGMFMFGKDVEDPGQLGISTLDQPQVLERYRAGWRHWGG

SEQ ID NO: 19519 - protein, 424 aa, Thermus thermophilus
MKSEPLSYLGKDGGPWEIFTEQVDRVVPYLGRLAPLAESLKRPKRVLIVDVPVRLDDGSVAYFEGYRVHHNTARGPAKGGVRYHPEVTLSEVMALAGWMTIKNAAVGLPYGGGKGGIRVDPRKLSPGELERLTRRYTSEIGILLGPDRDIPAPDVNTGEREMAWMMDTYSMNVGRTVPGVVTGKPIALGGSLGRRDATGRGVFITAAAAAEKIGLQVEGARVAIQGFGNVGNAAARAFHDHGARVVAVQDHTGTVYNEAGIDPYDLLRHVQEFGGVRGYPKAEPLPAADFWGLPVEFLVPAALEKQITEQNAWRIRARIVAEGANGPTTPAADDILLEKGVLVVPDVIANAGGVTVSYFEWVQDFNSYFWTEEEINARLERVLRNAFEAVWQVAQEKKIPLRTAAYVVAATRVLEARALRGLYP

SEQ ID NO: 19520 - protein, 624 aa, Methylococcus capsulatus
MCGISGLVQLEGVADTSAMRRSVETMVKALAHRGPDDSGVAGDGSAVFGMARLAIRGCHDGRQPMVDAETGVMMVCNGEIDNHAELRGWLAERGRAVEHATDVAVIPGLYLELGDGFVERLVGAFALAVWDPRRGRLLLARDRAGERPLFYACRDGRVSFASQAAALVAGSPEPYPADEAAVQAFLKAGYFEAPASPFAGMRKVLPGERIAIDVKGVERSRYWRLNFTRGPARKNPLDEFDAVFREAVRRQSEVEVDFGAFLSGGVDSSLVTAVMRSVHPDRKLKAFGLRFSESSYDEGVFAERVAESLGVDYTPIWVRPEDFPETLADLVRQSGEPLADPAWVPTALLARRASDEVRVALVGEGADELFGGYPTYFGARLAERYSRLPGGLRALIRKAVEAWPVSDKKVTVSFLLKRFVQGDELDFLARHVLWTSSIPPALLRRLGVTPPETPHVAGPQETMLDRLQQHDLETSLAEGLLTKADRASMRSALELRAPFLDKDVIEFAATLPERERVQGLETKVFLKRVALRYLPKDIVYRKKRGLSVPLSAWLRGPLHDWAEARISSPRLEELGINRAAALELLREHERRSADHARALWTLIVVSEWLEWKAGMEAHPAAFTA

SEQ ID NO: 19521 - protein, 486 aa, Solibacter usitatus
MRTLFLNPPSFEGFDGGASSRWPASREIESYWYPVWLCYPAGMLPDSRVVDAPPHKISIEQTVEMGKDFELLVLYTSTPGFNIDVKMATMMKDVNPKLKVAFVGPPVTTEPDKTLIGTKAIDFVVRREFDHQIVDYAKGKPLEELPGVSFRKNGHIVNNPEGPAIEDLDALPWVTKVYKRDLDITRYNVPFLLNPFVSLYTSRGCPALCTFCLWPQTHSGHRWRLRSSDDVANEVRYALEQFPQMKEIFFDDDTFNYRKERTIELCKKLKPLNFTWSCTSRVTTDYETLKAMKEAGCRLLIVGYESGDQQILKNIKKGATVDMAERFTANCKKLGLLVHGDFIIGLPGETRESIRKTIDFAKRLDNETIQVSIAHPYPGTEFYDYVKQNGLITIDSMTDENGHQLPNVVYPGLDRGELVEWVERFYGEYFFRPKVVWRIVRKAIFNSDERRRLTKEAREYMALRSKRRKFVADQAAAKTATPVASR

SEQ ID NO: 19522 - protein, 249 aa, Solibacter usitatus
MASMAKVYLVGAGPGDPDLLTRKALRLLEQADVILHDRLVSDGILALASPRARLIDVGKQQGQQEEIQSEIYTWILRLGRSARTIVRLKSGDPMVFGRGGEELEFLARHGIDAEVVPGLSSALAAPALAGIPVTYRGVAASFSVIAGHRQSLTTLDWSVYQGVDTLIILMGVEYRDIIAHTLIEQGRPASQPVAFLENASTSRERVVESTLELVARRQVEVKAPAVMVIGEVVRHRTAVRRAMLQEAVA

SEQ ID NO: 19523 - protein, 743 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQDTTGNR

SEQ ID NO: 19524 - protein, 282 aa, Waldsteinia geoides
GLPPAMAANGHRVMTVSPRYDQYRDAWDTGVTIELQVGDKIETVRFFHCFKRGVDRVFVDHPLFLEKVWGKTASKIYGPATGEDYKDNQLRFSLLCLAALEAPRVLNLNSNKYFSGPYGEDIIFVGNDWHTGLLPCYLKAKYQSKGIFMSAKVAFCIHNIAYQGRFAFADFSLLNLPDSFKSSFDFIDGYNKPVKGRKINWMKAGMLESNIVLTVSPYYAKELVSSSDKGVELDNIGRKVGVHGIVNGMDVQEWNPLTDKYTDVKYDATTVMDAKPILKEAL

SEQ ID NO: 19525 - protein, 419 aa, Thermus thermophilus
MPLKAYRPPEDPGLWDTYLEWLERALKVAGVHPTTLEYLAHPKRLVTLSLPVVMDDGKVRIFQGYRVVHDIARGPAKGGVRLDPGVTLGQTAGLAAWMTLKAAVYDLPFGGAAGGIAVDPKGLSPQELERLVRRYTAELVGLIGPDSDILGPDLGADQQVMAWIMDTYSMTVGSTVPGVVTGKPHALGGSEGRDDAAGLGALLVLEALAKRRGLDLRGARVVVQGLGQVGAAVALHAERLGMRVVAVATSMGGMYAPEGLDVAEVLSAYEATGSLPRLDLAPEEVFGLEAEVLVLAAREGALDGDRARQVQAQAVVEVANFGLNPEAEAYLLGKGALVVPDLLSGGGGLLASYLEWVQDLNMFFWSPEEVRERFETRVARVVDAVCRRAERGGLDLRMGALALALERLDEATRLRGVYP

SEQ ID NO: 19526 - protein, 381 aa, Bacteroides thetaiotaomicron
MDDKGNIQTNMGYRVQHNNAIGPYKGGIRFHASVNLSILKFLAFEQTFKNSLTTLPMGGGKGGSDFSPRGKSNAEVMRFVQAFMLELWRHIGPETDVPAGDIGVGGREVGFMFGMYKKLAHEFTGTFTGKGREFGGSLIRPEATGYGNIYFLMEMLKTKGTDLKGKVCLVSGSGNVAQYTIEKVIELGGKVVTCSDSDGYIYDPDGIDREKLDYIMELKNLYRGRIREYAEKYGCKYVEGAKPWGEKCDIALPSATQNELNGDHARQLVANGCIAVSEGANMPSTPEAVRVFQDAKILYAPGKAANAGGVSVSGLEMTQNSIKLSWSAEEVDEKLKSIMKNIHEACVQYGTEADGYVNYVKGANVAGFMKVAKAMMAQGIV

SEQ ID NO: 19527 - protein, 143 aa, Glycine max
VAFTEKQDALVSSSFEAFKANIPQYSVVFYTSILEKAPAAKDLFSFLANGVDPTNPKLTGHAEKLFALVRDSAGQLKASGTVVADAALGSVHAQKAVTDPQFVVVKEALLKTIKAAVGDKWSDELSRAWEVAYDELAAAIKKA

SEQ ID NO: 19528 - protein, 727 aa, Solibacter usitatus
MNFKRMIGLDNLATEYTFARDSETGYTAASRIPAKWIATTCGYCSVGCGMEIGVRDNHAVAARPLAGHPVNRGKLCPKGLSEHHTIDTENRLKRPLLRKKGKLAEIGWDEATALLVEKFRATQQRYGANALGVISTGQLVTEEFYTLGKLVQLGFGTSNYDGNTTLCMATAVSGYKLSFGSDGPPGAYEDLEKADVILLIGANIAENHPILCQYIDSNPRKTLIVADPRVTKTAMIADLHLPLKPRSDLALLNGIAHVLVRHNLINRDYIDRHTTGFDDLSRFLENYPPAKVCEITGLTEDQLYKTAFLYARAKAGFIGWTMGVNHSTKGTETVNAICNLALLTGHVGRAGASPFSITGQCNAMGTRETGFASSLPGYRKFEDAQDRAELARLWKIDESRIPRKRGLAYPDIVEAAVGGTVRAMWIIATNPLVSFPNQSVLRQALSNLDFLVVQDGYHPTPTTELADLVLPAAIWGEKEGTYTNSERRVSKVNKAVEPVGEARSDFDIFLSVAAKLGCRDELFPGWQTPRDAFDEWREVSRGRLCDYSGITYELLAEQGAVQWPFPEGATFTQSSRLYADGRFPTADGRARLICGAWEAFPEQPNPQYPLVLNTGRTVEHWHTRTKTREVPILERLSPAAWLEMNPRDAGRMGLRSHDRVDVISRRGRVRSVELRLTEITAPGQVFMPFHYFESNANEVTQSAFDPVSREPNYKQCAVRVERTGAAV

SEQ ID NO: 19529 - protein, 282 aa, Coluria geoides
GLPPAMSANGHRVMTVSPRYDQYKDAWDTEVTVELQVGDKIETVRFFHCFKRGVDRVFVDHPLFLEKVWGKTASKIYGPVTGEDYKDNQLRFSLLCLAALEAPRVLNLNSNKYFSGPYGEDIIFVGNDWHTGLLPCYLKAKYQSKGIYMSAKVAFCIHNIAYQGRFAFEDFSLLNLPDSFKSSFDFIDGYDKPVEGRKINWMKAGMLESNIVLTVSPYYAKELVSSSDKGVELDNIGRKVGVHGIVNGMDVQEWNPLTDKYTDVKYDATTVMDAKPILKEAL

SEQ ID NO: 19530 - protein, 412 aa, Rhodococcus opacus
MTSDIVVIGGGVAGVSAVQSLRSEGYDGRLFLIGKERELPYDRTSLSKAVLAGDLADPPPLSPADWYDELQVETVLDRTVLQVDVTRKEVLLDGGRSLEVDRVLLATGASARVPSFSGADLPGVTTLRTVDDAQRLRQDWEPGQRLVVVGGGLIGCEVATTARKLGLEVSILEASDELLQRVLGRRIGGWCRARLEELGISVMVNTGVAEFDGVDRITAVIGTDGRRFPADSAIVCVGAEPETAIAEQAGLACSRGIIVNDSGGTALEGVFAAGDAASWPLRTGGRRSLETYINSQKEATAVASAMLGKAVHAPQLPLSWTEIAGHRIQMIGDIEGSGEYVMRGAPDDGPALLFRLTDGKLTAALSVDAPREFAMATRLVESGAQVGRDVLADTSVELRELNRAARERTTAA

SEQ ID NO: 19531 - protein, 801 aa, Solibacter usitatus
MKKLVVVGNGMAGVACVEQILKYRHEFQITIIGDETHVNYNRILLSSVLAGEKSADDIVLNDIEWYRANHITPRLGLRVAAIEAGERIVRGTDGSAIPFDKLILATGSTAFVPPVPGTDKQNVHVFRTLDDTRALLEKSRPGRKAVVIGGGLLGLEAARGLQVQGCDVTVVHLAPTLMERQLDAGGGAYLARKMENLGVKVLLGRQTQAMLGNGRVEGLRFKGGEEVEAELVVVAAGIRPNIELGRTAGLEVRRGIVVNDYMETSNPDIFAVGECTEHRGQIFGLVAPLMEQGKVLAATITGNRGPVFLGASTAAKLKIMGVEVFSAGSIDDTERGVETVRYEDPALGIYKKLLIKDNRLHGVILVGDASDDHRYKAWLTEATDLTPHRRHLLFPPPAQDAGLDVAQIPDRETICGCMGVTKGELITAIHQHGIATMTELKDRTRASTGCGSCGNLCARLLKAVAPEFEEEKQKVLCACVPFPQEKLREIVRSQQLRSVQDVLDVYGNGRGCEICKPALSYMVDMVWCGDHEEDRSARFINDRVHANIQKDGTFSVVPRMRGGVTTPAELRRIADVAEKYHVPLVKVTGSQRIDLLGVHKSDLPAIWSELGMPSGQAYTKGVRMVKTCVGSQFCRFGTQDAIAAGVDLETRLENLYSPHKFKMAVVGCPRNCAEATVKDVGLVGNEGSWQVVVGGAAGKSVRKADLLVTVETTDAALEAAEVFFQYYRENANYLERSYDFVERLGIEKVRKETVYSLPEVRRALLDRLHKSKDKSSDAWLERINPRPTQFVKIQPMETVSL

SEQ ID NO: 19532 - protein, 282 aa, Geum heterocarpum
GLPPAMSANGHRVMTVSPRYDQYKDAWDTGVTVELQVGDNIEIVRFFHCFKRGVDRVFVDHPLFLEKVWGKTASKIYGPVTGEDYKDNQLRFSLLCLAALEAPRVLNLNSNKYFSGPYGEDVIFVANDWHTALLPCYLKAKYQSKGIYMSAKVAFCIPNIAYQGRFAFADFSLLNLPDSFKSSFDFIDGYDKPVKGRKINWMKAGMLESNIVLTVSPYYAKELVSSIDKGVELDNIGRKVGVHGIVNGMDVQEWNPLTDKYTDVKYDATTVMDAKPILKEAL

SEQ ID NO: 19533 - protein, 69 aa, Zea mays
MVVDQVQILDRHHLFGKFASVDGGVSTRTDQNLAFFGGYNMVTTHIVLLHKNPSEDIHALVEQYYDHFH

SEQ ID NO: 19534 - protein, 283 aa, Prochlorococcus marinus
MTDITTWIDEYHKGSRFGLNGKILFKKTSKYQEIIVIENEYYGKALMLDGCWMTSLKDEKYYHECLVHPALSSIDEKSNVLIIGGGDGGTVRECVKYSKISKIDLVEIDEEVIKISKKFLKEIAGEAWNDKRLEIHIDDGVKWVEKTKDNFYDVIFIDCSDPSEFSNLLFSHSFYKECERILAPSGILATQSESPESFKNIHINILKSLKNIFKVSETMYSFVPIYPSGIWSWTFASSEDLSLSKQNYDEVVKIEKGCEIWNLNFQNAAFKMMPNKIVKELDS

SEQ ID NO: 19535 - protein, 448 aa, Solibacter usitatus
MNIRNKATAIRLLDFRSVPMRAFHMSWLSFFLCFFGWFGLAPLMPVIRQELHLTREQIGNSIIASVAITVLARLLIGWLCDRVGPRRAYTGLLILGSLPVIGVGLAHDYTTFLLFRLAIGAIGASFVITQFHTSVMFAPNIVGSANATAAGWGNLGGGVTQMVMPLLFAAFLSLGVGSWWGWRLAMIVPGIALFLAGIAYYRLTRDTPDGDFEELRAQGRMPGRASANGAFREACSDPRVWALAVLYAACFGMELTVDNIAALYFVDYFKLSLQAAGIAAGAFGMMNLFARALGGIVSDRCYFRWGLRGRSLLLGATIALEGFAFTCFSQARSLPLAIACMLLTGLFIKMSNGATYAIVPFVNKRALGAVAGIVGAGGNLGAVAAGFLFKTKTLTWPQALLILGALVFASAGLAVLVRFSQRDEVSARAEMEARLNTDLIPVLTGAGD

SEQ ID NO: 19536 - protein, 282 aa, Geum reptans
GLPPAMSANGHRVMTVSPRYDQYKDAWDTGITVELQVGDKIETVRFFHCFKRGVDRVFVDHPLFLERVWGKTASKIYGPVTGEDYKDNQLRFSLLCLAALEAPRVLNLNSNKYFSGPYGEDVMFVANDWHTALLPCYLKAKYQSKGIYMSAKVAFCIHNIAYQGRFAFADFSLLNLPDSFKSSFEFIDGCDKPVKGRKINWMKAGMLESNIVLTVSPYYAKELVSSIDKGVELDNIGRKVGAHGIVNGMDVQEWNPLTDKYTDVKYDATTVMDAKPILKEAL

SEQ ID NO: 19537 - protein, 296 aa, Symploca atlantica
NSRLCMSSAVSGYIQSFGSDGPPCCYEDLELTDCAFLIGTNAAECHPIVFNRLRKHHKKNRHVKMIVVDPRRTETAEAADLHLAIRPGTDIDLLNGIAHLLMRWGLMDTLFIDECTADFPAYAEVIGHYSPELVARKCGISLDELETAARYWGKSQRVLSLWSMGINQSSEGTAKVRTLINLHLMTGNVGKPGAGPFSLTGQPNAMGGREAGGLAHILPGYRLVKNSQDRREVEDFWGLKPGQISPFSGRSAWEMITGLEQGDVGLLWIAATNPAVSMPDLERTKAALKQSPFTVY

SEQ ID NO: 19538 - protein, 314 aa, Unknown
  Candidatus Blochmannia floridanus
MNKIYQDNSYTIGHTPLVRLNKIGNQFIMAKIESRNPSFSVKCRIGSNMIWDAEKKNILNPNITIIEATSGNTGIALAYVTAARNYKLLLTMPETMSIERQKLIRALGADIILTEGHLGMKGAINRATEIANDNPSKYLLLQQFSNPANPNIHERTTGPEIWYDTHGNIDIFVAGVGTGGTITGVGRFFKQIQNKKITIVAVEPKDSPVITQTLSGQSIKPAPHKIQGIGAGFIPKNLDLNLIDQVVTVETDAAISYAKFLMQKEGILAGISSGAALAAAVQLQQQEKHTNKNIVIILPSSGERYLSTILFSDS

SEQ ID NO: 19539 - protein, 1533 aa, Aspergillus nidulans
MDGQRQQPYVPAPPPSASQPSQAHIMPLPPPPPRYPPAQPQNVMPPPPPGPPPGSAYGTSKLTNPQLQSQSTLGWSNWGGRGIPQYLPPPPPPPMTHANQSSFARPSAVQNNNATSATYVPQPGTFGPGVGIPPFDVPSHSYDAPNTMVASERPRPPPNAPYGHGTSNASAYQLDGTIPSTPLTHTAPFSHETSHDVPSSAVPTGSPFKSVPQSASQANDLTKSSSHRHNNSNTTVGGMSASEAAVQWPLDRVLLWLAKNGFSHEWQETFKTLEIEGADFLELGHGQNGRPNLGKMHTVVYPQLAKECEANGTAFDLTRERDEGKRMRKLIRLIHDDAGPDNGGTFNKQHDFDDGHGSVPDEGPEFSPNINNVAQAPGSPSLNATNVSNSPNLKAPKYSHKPRSFTTPGSISHDSTTAELAMTEGSSTMLPRSDFSRNVLGTIGIDHQRKSPSMSSDNGVFAIPPHRPHEGSPKSGSPAAQHATLYAAPVSSATDLNAKYDARFGHNRVNSGERRYYETLKHDGSRPSPQTTQTAGDNASSYPKDHRMGFLNFFKKKSARNSDPNNPSPDDNTPDSPIYSKYHFNSSDVSVNERPLSASLSDYERMMMVRTKPAHRGKRFIFATMDGWNYRLIDTTDIDSVEKLRASICQNLGIYDWPDAQIFLTEPGQLEHDEPLNDTFLTLCQRSKSDSIGSLKLFVKTPHNVAGLGVSMPDRSAVSPTSAIPRKPLDGEAASRLSPLKPSSPQQLKPPASRLPLRDIQNSAAGTSPVDGEPDGSLQDQERKPQKSYRPTPAPLPRPDAYSETGYRRKEVINFDKPRISPYEDKKSEVLVPFRKPPSAPQESNTLSKVNSLRKKDGDRPRPHRSNQPPGIKEMMADMGMMSSLIGKPSSPNSGNTTATEDAHSSIDSAVDKSSQSTPPLTNTSYSPTTTATTTTTTTTASSSLSRSASQKRKSVGPEFDFEETQVSFQRSPALEEDSDDDSDDGLFAIPLANTKNSVKPGSPDTQARPRKPSLTVDTEAKPRTGLSVSFKSPSATRETFASSGGDASNSTAPYFIASNSPEEEKTPIRRNSLRNSFATGDVWASRPPVEGVIDQLDDFFPDIDLDAPYLDEQGTSPPSSPASKVAIDNELNRKDKQENSHHGMQPPPAPEDNTLGSSEPTMTSHGQGIVARRNVSRSGGGLTRMKSIREVAKGANQATRQRSVAASSGNKRSGDVHRRKSTKMFGAKIMQISPRRGSQLSQLDPIPQNSISSSSKPQRQPTFRIIRGQLIGKGTYGRVYLGMNADNGEVLAVKQVEINPRLAGQDTDKIKEMVAALDQEIDTMQHLEHPNIVQYLGCERGELSISIYLEYISGGSIGSCLRKHGKFEESVVKSLTRQTLEGLSYLHNQGILHRDLKADNILLDLDGTCKISDFGISKKSNDIYGNDSSNSMQGSVFWMAPEVIQSQGQGYSAKVDIWSLGCVVLEMFAGRRPWSKEEAIGAIFKLGSLSQAPPIPDDVSMNVTPAALAFMWDCFTVSNPSYSSFLRARSEV

SEQ ID NO: 19540 - protein, 296 aa, Symploca atlantica
NSRLCMSSAVSGYIQSFGSDGPPCCYEDLELTDCAFLIGTNAAECHPIVFNRLRKHHKKNRHVKMIVVDPRRTETAEAADLHLAIRPGTDIDLLNGIAHLLMRWGLMDTLFIDECTADFPAYAEVIGHYSPELVARKCGISLDELETAARYWGKSQRVLSLWSMGINHSSEGTAKVRTLINLHLMTGNVGKPGAGPFSLTGQPNAMGGREAGGLAHILPGYRLVKNSQDRREVEDFWGLKPGQISPFSGRSAWEMITGLEQGDVGLLWIAATNPAVSMPDLERTKAALKQSPFTVY

SEQ ID NO: 19541 - protein, 125 aa, Klebsiella pneumoniae
REVMTTLWPFLEENPRYRQLALLERLVEPERVIQFRVVWVDDRNQVQVNRAWRVQFNSAIGPYKGGMRFHPSVNLSILKFLGFEQTFKNALTTLPMGGGKGGSDFDPKGKSDGEVMRFCQALMTE

SEQ ID NO: 19542 - protein, 948 aa, Unknown
  Mesorhizobium sp. BNC1
MSYTPTGYAPYDFANRRHIGPSPREMAEMLETVGAESLDAFIDAIVPADIRQTRPLAWGKALSERGVLERLRNVAKKNKPNASFIGQGYHGTFTPPAIQRNIFENPAWYTAYTPYQPEISQGRLEALLNYQTMMTNLTGLDIANASLLDEGTAAAEAMALCERASRTKARAFFVDHHCHPQTIAVVATRAEPLGWEVIVGDPFTYLDPSRVFGALFQYPGTYGHVHDFTAPIAALKDAGALAVVAADPLALTLLKPPGEMGADIAIGSSQRFGVPLGYGGPHAAYMTVRANLARSMPGRIVGVSIDARGNRAYRLSLQTREQHIRREKATSNVCTAQALLAVMASMYGVFHGPDGLRAIAERIHRKIVRLVKGLETLGFPIEPVSFFDTVTVECGPRRDAILASALREGINLRPIGETRIGITFDETVRRSHTEAIWRAFGGGMADDDMTPDYRLPEALLRTSSFMTHPVFHMNRAEAEMTRYMRRLADRDLALDRAMIPLGSCTMKLNATAEMMALSWPEFANMHPYAPADQAQGYAEMLSDLEAKLCQITGYDAFSMQPNSGAQGEYAGLLTIRRYHEVQGDGHRNICLIPTSAHGTNPASAQMAGMKVVVVGVAADGNIDVADFRAKAEAHAENLAACMITYPSTHGVFETTVREICDITHANGGQVYIDGANMNAMVGLARPGDIGGDVSHLNLHKTFAIPHGGGGPGMGPIGVKAHLVPHLPGNPPAGKFAISAAPFGSASILLISWAYCLLMGGEGLTQATKTAILSANYIARRLASAYPILYSSAAGHVAHECILDTRVLKERAGVTVDDIAKRLVDCGFHAPTMSWPVAGTLMVEPTESEPKAELDRFIEAMLGIAAEAEAIAAGTLDAQDNPLKRAPHTVEDLVGEWDRLYSREAACFPAGSFRTDKYWPPVNRIDNVHGDRNLVCTCPPLESYAEAAE

SEQ ID NO: 19543 - protein, 346 aa, Ostreococcus tauri
MKLRGREKSANEKTKEEPVTPVIAEPARGQSEEAVVPSDDFLCLFDESTREAATLANQTTHWEEVFAQHGGDVVGEHFPHFEDLKYKPLSGRTLASTSTGRVSKRRSGTRKPKAQLNRLQLPQNQLQLQPPLPPPVPVPMYRSSTGKPRSSKYNGVCRHAKSGRYEAHVWLRESRRQVYLGGYLEEEFAAEAFDIIVLKLARIGSRSRTGSRPLKMNFPEGRYANLLQLIDSLTLDELIMEVRRHSEGFARGSSGYRGVTRHANSKFEARLGVPRSNHMYLGLYDSAEKAAVAYDQALVQVRGRRASTNFPLYNYDEHIRQYEMTKARQNVSQGKQHVTFQQLDDY

SEQ ID NO: 19544 - protein, 585 aa, Aspergillus nidulans
MADIATRELRQPIDIAEYLFRRLHEVGIRSVHGVPGDYNLAALDYLPKCGLHWVGNCNELNAGYAADGYARVNGIAALVTTFGVGELSAINAIAGAYSEFVPIIHIVGQPHSRSQKDGLLLHHTLGNGDYNVFSSMNKGISVTTANLNDTYDAATLIDNAIRECWIHSRPVYLALPTDMITKKIEGERLKTPIDLSLPANDPEKEDYVVDVVLKYLHAAKNPVILVDACAIRHRVLEEVHDLIEVSGLPTFVAPMGKGAVNETHRCYGGVYAGTGSNPGVREQVESSDLILSIGAIKSDFNTAGFSYRIGQLNTIDFHSTYVRVRYSEYPDTNMKGVLRKVIQRLGFIKADPVPHISNALPEHEKNSSEQRITHAWMWPMVGQWLKENDIVITETGTANFGIWDTRFPSGVTAISQVLWGSIGYSVGACQGAALAAKEQGNRRTVLWVGDGSLQLTLQEISTMIRNNLNPIIFVICNEGYTIERFIHGWDESYNDIQTWDIKGLPVAFGGKGRYKGYKVTTRDELTKLFASEEFSSAPCLQVSLCDLTHYLSDANFEQLVEVHMPREDAPASLKITAEAAASRNK

SEQ ID NO: 19545 - protein, 296 aa, Symploca atlantica
NSRLCMSSAVSGYIQSFGSDGPPCCYEDLELTDCAFLIGTNAAECHPIVFNRLRKHHKKNRHVKMIVVDPRRTETAEAADLHLAIRPGTDIDLLNGIAHLLMRWGLMDTLFIDECTADFPAYAEVVGHYSPELVARKCGISLDELETAARYWGKSQRVLSLWSMGINQSSEGTAKVRTLINLHLMTGNVGKPGAGPFSLTGQPNAMGGREAGGLAHILPGYRLVKNSQDRREVEDFWGLKPGQISPFSGRSAWEMITGLEQGDVGLLWIAATNPAVSMPDLERTKAALKQSPFTVY

SEQ ID NO: 19546 - protein, 253 aa, Unknown
  Rhodococcus sp. RHA1
MQVPELFQLSGRVAVVTGASSGLGTGFARTLASAGATVFAAARRVERLAALADEVEGVVPVECDITVDADRRSLVDRVLAEAGRIDVLVNNAGRPGRPNAEDESPEEFSSILDVNLAAGFHLATSVASTTPAGEAASIINISSVVGLVSTAPIGGASYAASKAGVLGLTRELAGQWGRRGIRVNAIVPGWFDTEMTDGLFSNQRSADWVRRNTMLARGGRPGEVDGAVLFLASDASSYVTGQTLVVDGGWTAR

SEQ ID NO: 19547 - protein, 194 aa, Brassica napus
MEILDLLDHPFLPALYASFQTKTHICLITDYYPGGELFMLLDRQPRKVLKEDAVKFYAAQVVVALEYLHCQGIIYRDLKPENVLIQGNGDISLTDFDLSCLTSCRPQLLIPSIDEKKKKKQQKSQQSPVFMAEPMRASNSFVGTEEYIAPEIITGAGHTCAVDWWALGILMYEMLYGYTPFRGKTRQKTFANVL

SEQ ID NO: 19548 - protein, 332 aa, Rhodopseudomonas palustris
MSSAATASIKAVAEAPAHRPGRGRVYESIADAYGDTPLVRLNRLPQQHGVKATIYAKLEYFNPASSVKDRIGAAMIAALEQEGIIKPDTVLIEPTSGNTGIALAFVAAAKGYRLKLVMPESMSIERRKMLAFLGAELVLTEAAKGMKGAVAKAEELVAATPNAVMPQQFKNLANPAVHRRTTAEEIWNDTDGAVDIFVAGVGTGGTVSGVGQVLKPRKASLKVVAVEPEESPVLSGGAPGPHKIQGIGAGFVPDILDRSVIDEVVKIPSATAIETSRALARHEGIPGGISSGAAIAAAIELGKRPENAGKTIVAIVPSFSERYLSTVLFEGV

SEQ ID NO: 19549 - protein, 219 aa, Unknown
  Synechococcus sp. WH 7803
NSRLCMSSAVAGYTRSLGSDGPPCCYEDLDHCSVVILIGTNTAECHPVLFQRLLKRKKRDPNGLTIVVVDPRSTDTAKIADYHLVLAPGTDLALLHGLARLIIQDNGFDSDSIDTATEGFAGFTQTIKTWTPGKTSKFCGIAEKDLRAVARLWSRKERILSLWSMGVNQRREGTAVVGGLINLHLLTGEIGKAGAGPFSLTGQPNAMGGREAGGLAHLL

SEQ ID NO: 19550 - protein, 385 aa, Methanosarcina mazei
MTEREQFFRDVNKIVIKIGTSSITRKGCDHTRENCNIDPAFMESIAFQVSELRKQGKEVIIVSSGAIGVGLNELGIAPKPREIPIRQAAAAVGQSMLMQDWSRAFSRYGMKVAQILLTYEFYSDRVTYLNLRNSISTLLEYGVVPIINENDCTCTNEIEAIFGDNDKLSAMVASKIDADLLIILSDIDGLFDRNPKTHIDAKLLTIVKKITPEIESYGGDPTSFKGVGGMRTKIKAAKICSMAGCYVVIANSDVEDVILKIASGEEIGTLFLAERHIQKNRARWIILARASGTVRVDAGAKAAVLGKNSLLPAGVVDVEGTFDRGDVVKLECDGKIFAKGITDYTSEELIKIKGVHTDQIENVLGYSNYNNVIKKENIGILEELN

SEQ ID NO: 19551 - protein, 423 aa, Unknown
  Mesorhizobium sp. BNC1
MTNGTAPLSVFDPALWAAIQAEGRRQEGEIELIASENHASPRVMAAQGSVLTNKYAEGYPGKRYYGGCGEVDVVEQLAIDRVKQLFGAQFANVQPHSGAQANGAVMLALLLPGDTILGMSLDAGGHLTHGARPALSGKWFRAIAYGLTPDGLIDYDQVAALAEAERPKLIIAGASAYSRVIDFARFRAIADGVGATLMVDMAHIAGLVATGHHPSPMPHADVVTSTTHKTLRGPRGGIILTNDEAIAKKINAAVFPGLQGGPLMHVIAAKAVAFAEALEPDFTEYAGRVVASAKALAEVLVERGAAIVSGGTDNHLMLVDLRPLGLKGNEAAEALERAGITCNKNGVPDDPEKPTVTSGIRLGTAAGCSRGFGPGEFRQIGHLIGDVLDSLRDGPNAVVEDAVHQKVAALCLAFPIYGGEADV

SEQ ID NO: 19552 - protein, 428 aa, Oryza sativa
MAAAGAGSSEVAARVLLQRYQPFAPPPGEYHQFGSGGAAAAGDMTEAVLIRTPLKRKHDREENEAAESNDWMMSPGYTNPAGSPVPTPLSGKGSKAFAKSKAAKGQKSCPQTPLCASSPGNPVTPVGGCRYDSSLGLLTKKFLNLLKGAPGGIVDLNNAAETLEVQKRRIYDITNVLEGIGLIEKKLKNNIRWKGIDDSRPGEVSDDMSILQADIEALSLQEHSVDQQISEMRDKLRGLTEDENNQKWLYVTEDDIKSLPCFQNQTLIAIKAPHGTTLEVPDPDEVNDYPQRRYRIVLRSTMGPIDVYLVSQFEEMSGMETPPRTVQPVSMDSLENPRTPLAAEPNKAAESQPNIQDGLLMPSDAPSSSQDIGGMMKIVPSELDTDADYWLLSDAGVSITDMWKTARILFQTVYHSCILPFWLSSIIM

SEQ ID NO: 19553 - protein, 447 aa, Methanosarcina mazei
MANDIESKVIKAKKASIELASVSSEVKNRALEAMAEALDKERKIILEANLKDLEYAAQLKKAGKLTQALVDRLKVTDSKVDGMIAGIRDVIKLKDPVGETLSTLELDDDLILYQVSCPIGLIGVIFESRPDVVPQVMSLCLKSGNATIFKGGSEARESNRTIFDILVRAIESTGGMPEGAFQLMETREEIMSLLSLDAYVDLLIPRGSNEFVKFIQDNTKIPVLGHTSGICHIYVDEFADPDTAWQVCFDAKVQYPAVCNAIETLLVNRNIAEVFLPKMAEMYLKAGVELRCDEGSYSLLSEKGLSPLSRATDEDWSLEYNDLILSIKLVDTIKEAVDHINTFGSHHTDGIITENASRRKEFIGLVDSSSVMVNASTRFADGYRYGKGAEVGISTNKIHSRGPVGMEGLLIYKYILMGKGQVVADYAGKNAKPYTHRKLDLKFEDVN

SEQ ID NO: 19554 - protein, 887 aa, Bdellovibrio bacteriovorus
MKSFRFCSLLLICSFVLSCTLLLGQIAEAKAPARAQWVDNSRIVFRLPQGFRVHQNLLFSLGERISLHQQDSILLPVIRTDSSHVELSTQHLSSTQIDQLIRRPLRLFVSNKNGQILDSTALQYSGILDQMYFYDGDDLGAHVRSTSVGVKLWAPTARNVELLLYKDAQDTNPAAVLPMSRQQGVWFADLPGKYVNYFYLYQVEAYQPLSDQVETHTVTDPYSFSLTADGAKSQIVNLNDSSLKPQGWDRLHKPALRSFNDIVIYELHIRDFSVADFTVPFPYRGGYEAFAQTNSESSKYLQSLADAGMTHVHLLPFNDFGSVPENKDAWENYDSESSDLQEAQAYLGRIKAKDPFNWGYDPVHFMTPEGSYATDPNGSRRVYETRNMVQALNKMNLRVVQDVVFNHTYEAGLEPYSVFDKIVPLYYYRVNDEGDIQKSSCCNDTASEHRMMEKLMIDSVLHWARTYKIDAFRFDLMSFHSRNTMEKIKSELRGLTEREDGIDGSKIYLYGEGWAFGSFYDRYPAESLHMLNSYGSGYGFFNDRLRDAVRGGTTNSAEKSDQGFATGLYFDFNKEPANRNTPTDINGQREKLLHLGDVIKAGLAGNLRDFKFKEHWGSFVTAGQLHYRGAPTGTSAEALETVSYVSAHDGYTLWDAVQAKAPFYTNGRFPSLSKSEDRQRMHQLALALPMLSQGIPFIESGSELLRSKNGDQDSYNSGDFFNRIDWSRQQNFWGAGLPPAWKNVEDWSFWQPRLQEPGMKVTPELITRTEKYFKALLRVRQSSNLFKLNDLSEIQKSLTFIDNDKQTEPGLIAMHLQSSSEKLLIFFNAAREARSFEHRVLGQNWELHPLLDEKVDATLSQVLLAPSDKRIQIPGRSTVILIQKAGH

SEQ ID NO: 19555 - protein, 449 aa, Unknown
  Oceanobacter sp. RED65
MSDLDSFYQWLEERNPGQEEFIQAVKEVVCDVHGLVEDEERYQNWNILERLTEPDRIISFRVTWQDDDGRIRVNRGWRVQYCGVIGPYKGGLRFHPSVNESILKFLGFEQTFKNALTTLPMGGAKGGSDFDPRNCSDGEIMRFCQAFMNELYRHIGENTDIPAGDINVSSREIGYLFGQYRRLANSFSGTLTGKDIEFGGSHVRLEATGYGLVYFISEMLKQDDEELKDKTIAISGAGNVALHAAKKAIQMGGKVITLSSSKGYLYVEQGLEEYHINELIERQGKCYSDSTELLKSINGDSNAKWHDDKTPWEVECDIALPCATQNELKLDDAKKLVKNKVKYVAEGSNMPCTQDAIDCFEESSIKHAPGKASNAGGVALSGFEMAQNASFTPMGYDDLDEKLKAIMTNIHTQCCEEGQQDNGFIHYRKGANLAAFKRVADAIVSQGVG

SEQ ID NO: 19556 - protein, 548 aa, Bacteroides thetaiotaomicron
MTKSALQIARAAYQPKLPKALATGAVKAVAGAATQSVADQEAIKALFPNTYGMPLITFEAGEAVQLPAMNVGVILSGGQAPGGHNVISGLFDGIKKLNPESKLYGFILGPGGLVDHNYMELTADIIDEYRNTGGFDIIGSGRTKLETEAQFEKGFEIIKELGIKALVIIGGDDSNTNACVLAEYYAAKKYGVQVIGCPKTIDGDLKNDMIETSFGFDTACKTYAEVIGNIQRDCNSARKYWHFIKLMGRSASHIALECALQVQPNVCIVSEEVEEKDMSLDDVVTSIAKVVADRAAQGNNFGTVLIPEGLVEFIPAMKRLIAELNDFLAANAEEFSQIKKSHQRDYIIRKLSPENSAIYASLPEGVARQLTLDRDPHGNVQVSLIETEKLLSEMVATKLAAWKEDGKYVGKFAAQHHFFGYEGRCAAPSNFDADYCYSLGYTASMLIADGKTGYMSSVRNTTAPAAEWIAGGVPITMMMNMERRHGEMKPVIQKALVKLDGAPFKAFAAQRDRWAVETDYVYPGPIQYFGPTEVCDQATKTLQLEQAK

SEQ ID NO: 19557 - protein, 184 aa, Clostridium thermocellum
MINQIKEILVTREELKNNAKELGKRISSDYEGKELVLIGVLKGGVVFFADLIREITIPIDVDFISVSSYGNSTKSSGVVRIIKDIDIDITNKHVLIVEDLVDTGLTLHYLKSMFEARGPKDVKICTALDKPSRRKVDLEIDYKGITIPDKFVVGYGLDYAEKYRNLPDVCVLDSSVYTDKEDMD

SEQ ID NO: 19558 - protein, 149 aa, Oryza sativa
MLRGFPQARRLLRRMGLEKEDAYFWKQMGKGMLCTYALFGAAWLWNETSPLGWWTLKPRPKEEREMAHLYERRMFPYPGDEEAVEEFIKSGGALGTTIGPKGFADSNMDSDNMQKQLQSKKFDQEAQKLWFRMRNEVVQELQEKGFDVE

SEQ ID NO: 19559 - protein, 709 aa, Vibrio cholerae
MFEKPVVKTFQYGNHTVTLETGVMARQATAAVMATMDDTAVFVSVVGKKEAVVGQDFFPLTVNYQERTYAAGKIPGGFFKREGRPSEGETLIARLIDRPIRPLFPDGFTNEVQVIATVVSVNPDVQPDIISMIGTSAALAISGLPFNGPIGAARVGHIDGQLVLNPSEKELKQSRLDLVVAGTDNAVLMVESEAQILTEEEMLAAVVFGHDQQQAVIKAINEFAAEVATPAWEWVAPAENTELKAKVAALAETRLVEAYQITEKMARYDRIHEISAEVTAALLAENEALDTKEIHTIFHDLEKTVVRRSIIAGNPRIDGREKDMVRALDVRTGVLPRTHGSALFTRGETQALVTATLGTQRDAQIIDELTGEKKDHFLLHYNFPPYCVGETGFVGSPKRREIGHGRLAKRGIAAVMPSPEEFPYTVRVVSEITESNGSSSMASVCGSSLALMDAGVPIKASVAGIAMGLVKEENDFVVLSDILGDEDHLGDMDFKVAGTATGVTALQMDIKIEGITKEIMQIALNQAKGARLHILSVMDQAISAARSDISEFAPRIHTMKISVEKIKDVIGKGGAVIRQLTEETGTTIEIEDDGTIKIAATDGDQAKEAIRRIQEITAEVEVGVIYTGKVARLADFGAFVTILPGKDGLVHISQIADKRVEKVSDYLTEGQEVQVKVLEIDRQGRVRLSMKEAVETSDAAAAEVAPQAE

SEQ ID NO: 19560 - protein, 340 aa, Streptococcus thermophilus
MRNIPKSVTLKAWRCKYLVKGVLKMSNPNNHVIYLAGGCFWGVEEYFSRVPGVLDAVSGYANGSSETTRYELISQTGHAETVQVTYDAGKVTLREILLHFFRIINPLSKNKQGNDVGTQYRTGVYYTDVNDLPIIEKVFQEMSEQYGQPLAVELLPLQHFIPAEEYHQDYLKKNPNGYCHINVNQAVNPVIDSSSYHKPSQEELKVSLSPEAYAVTQENRTERAFTSPLWNHFEPGIYVDVVTGEPLFSSRDKFYSACGWPSFSRPISPEVANYKEDHSHNMDRIEVRSRVGDSHLGHVFPDGPSDKGGLRYCINGVATRFVPKADMEKEGYAYLLDQVD

SEQ ID NO: 19561 - protein, 329 aa, Bacteroides fragilis
MIVMGTVKCVGILTSGGDAPGMNAAIRAVTRAAIYNGLQVKGIYRGYRGLVTGEIKEFKSQNVSNIIQLGGTILKTARCKEFTTPEGRKMAYDNMVKEGIDALVVIGGDGSLTGARIFAQEYDIPCIGLPGTIDNDLYGTDTTIGYDTALNTILDAVDKIRDTATSHERLFFVEVMGRDAGFLALNGAIASGAEAAIIPEFSTEVDQLEEFIKSGFRKSKNSSIVLVAESELTGGAMHYAERVKNEYPQYDVRVTILGHLQRGGSPTAHDRILASRLGAAAIDAIMEDQRNVMIGIEHDEIVYVPFSKAIKNDKPVKRDLVNVLRELSI

SEQ ID NO: 19562 - protein, 131 aa, Saccharomyces cerevisiae
MSAKAEKKPASKAPAEKKPAAKKTSTSTDGKKRSKARKETYSSYIYKVLKQTHPDTGISQKSMSILNSFVNDIFERIATEASKLAAYNKKSTISAREIQTAVRLILPGELAKHAVSEGTRAVTKYSSSTQA

SEQ ID NO: 19563 - protein, 290 aa, Bacteroides fragilis
MMERKLAVITGADGGMGTEITRAVACAGYDVIMACYSSSKAETKCRELVKETGNEKIEVWQIDLASLASVRAFADRMLRQKTPVALLMNNAGTMETGLHITEDGLERTVSVNYVGPYLLTRLLLPLMGEGTRIVNMVSCTYAIGKLDFPDFFLRGRKGSFWRIPIYSNTKLALLLFTIELAERLRARGITVNAADPGIVSTNIIRMDQWFDPLTDIFFRPFIRTPLQGAATAIGLLLDAEVEGRTATFNLNNHCRLLPEKYTRPDRRAQLWEETERILSEKGFLPINDKR

SEQ ID NO: 19564 - protein, 309 aa, Zea mays
  misc_feature (188)..(188): Xaa can be any naturally occurring amino acid
  misc_feature (215)..(215): Xaa can be any naturally occurring amino acid
MAEHLASIFGTEKDRVNCPFYFKIGACRHGDRCSRLHNRPTISPTLVLANMYQRPDMITPGVDAQGQPIDPEKMQEHFEDFYEDIYEELGKFGEIENLNVCDNLADHMIGNVYVQFREEEQAAAAYNALQGRFYSGRPIIVEYSPVTDFREATCRQFEENSCNRGGYCNFMHVKQIGRDLRRKLYGAXASRRYHGRSRSRSPPPQRRGHRDRDDXDYHHRDRDDYRGGGGGGRGRGSRYDRYDDGAGRGGRHGRYDDGAGRGGRHDRYDDGGRRRHGSPSRRARSPVRESSEERRAKIEQWNREREGKQ

SEQ ID NO: 19565 - protein, 1128 aa, Brachypodium sylvaticum
MPPRPRAVALAPPRRLALLVSSAFAALLLIVSPCHCVNEQGQALLEWKRSLRPAGGALDSWKATDAAPCRWFGVSCDARGDVVSLSVTGVDLRGPLPASLPATLATLVLSGTNLTGPIPPELGAYSELTTVDLSKNQLTGAIPPELCRLSKLETLALNTNSLRGAIPDDLGDLASLTHLTLYDNELSGTIPGSIGKLKQLQVIRAGGNVALKGPLPSEIGGCTNLTMLGLAETGMSGSLPETIGRLEKLQTLAIYTTLLSGRIPESIGNCTELANIYLYQNSLSGPIPPQLGRLRKLQTLLLWQNQLVGAIPPEIGQCEELTLMDLSLNSLSGSIPASFGRLKNLQQLQLSTNRLTGAIPPELSNCTSLTDIEVDNNALSGDIRLDFPKLPSLTLFYAWKNGLTGGVPASLAECASLQSVDLSYNNLTGPIPRELFALQNLTKLLLLENELSGFVPPDIGNCTSLYRLRLNGNRLSGTIPAEIGNLKSLNFLDMSSNRLVGPVPAAISGCASLEFLDLHSNALSGALPDVMPRTLQLVDVSDNQLAGPLRPSSIVSMQELTKLYLGKNRLTGGIPPELGSCEKLQLLDLGENAFSGGIPAELGELPSLEISLNLSCNRLSGEIPPQFAGLDKLGSLDLSHNQLSGSLDPLAALQNLVALNVSFNGFSGELPNTPFFQKLPLSDLAGNRHLVVGDGSGDSSRRGAITTLKAAMSVLAVVSAALLVAAAYILARARRRGGTGGSTAVHGHGTWEVTLYQKLDISMDDVLRGLTTANVIGTGSSGVVYRVETPNGYTLAVKKMWSPSPDETAAAAAAFRSEIAALGSIRHRNIVRLLGWAAANNGSTATRLLFYSYLPNGNLSGVLHGSGGASVAKQSAQPGSDWAARYDVALGVAHAVAYLHHDCVPAILHGDIKSMNVLLGPAYEPYLADFGLARVLSAAQSKLDDDSSKPRPIAGSYGYMAPEYASMQRISEKSDVYSFGVVLLEILTGRHPLDPTLPGGAHLVQWVTQARRRACDGDDALLDARLRERSAGEADAQHEMRQVLAVAALCVSQRADDRPAMKDIVALLEEIRRPGTAAADDVKPAPAPAASLPAAVAAAPVLSPARGGAHSRGVSSSCSFAGVSDYSA

SEQ ID NO: 19566 - protein, 63 aa, Protea piscina
  misc_feature (40)..(46): Xaa can be any naturally occurring amino acid
MPGQWEYQVGPSVGIEAGDHIWCSRYLLERITEQAGVVLXXXXXXXEGDWNGAGCHTNYSTKS

SEQ ID NO: 19567 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQYAYYSRSTTKNMLQ

SEQ ID NO: 19568 - protein, 840 aa, Zea mays
MVAAVALRGGSSDSGGFDKVPGMDSGKYVRYTPEQVEVLERLYIDCPKPSSSRRQQLLRECPILSNIEPKQIKVWFQNRRCRDKQRKESSRLQAVNRKLTAMNKLLMEENERLQKQVSQLVHENAHMRQQLQNTSLANDTSCESNVTTPPNPIRDASNPSGLLAIAEETFTEFLSKATGTAIDWVQMPGMKPGPDSVGIVAISHGCRGVAARACGLVNLEPTKGIEILKDRPSWFRDCRSLEVFTRFPAGNGGTIELIYMQMYAPTTLVPARDFWTLRYTTTMEDGSLVVCERSLSGSGGGPNAASTQQFVRAEMLPSGYLVRPCEGGGSIVHIVDHLDLEAWSVPEVLRPLYESSRVVAQKMTTVALRHLRQIAQETSGEVVYALGRQPAVLRTFSQRLSRGFNDAISGFNDDGWSVMGGDGIEDVVIACNSTKKIRNTSNAGITFGAPGGIICAKASMLLQSVPPAVLVRFLREHRSEWADYNIDAYLASSLKTSACSLPGLRPMRFSEGQMIMPLAHTVENEEILEVVRLEGQPLTHDEALLSRDIHLLQLCTGIDEKSVGSSFQLVFAPIDEHFPDDAPLISSGFRVIPLDVKTDGVSSGRTLDLASSLDVGSAAPQASGDASPDDCSLRSVLTIAFQFPYEMHLQDSVAAMARQYVRSVISAVQRVSMAISPSQSGLNAGHRMLSGFPEAATLARWVCQSYHYHLGMELLNQSDGAGEALLKMLWHHPDAVLCCSFKEKPMFTFANKAGLDMLETSLVALQDLTLDKIFDESGRKALFSDISKLMEQGYAYLPSGVCMSGMGRHVSFDQAVAWKVLGEDSNIHCLAFCFVNWSFV

SEQ ID NO: 19569 - protein, 440 aa, Anabaena variabilis
MSNQGAFEGAANVESGSRVFVYEVVGMRQNEETDQTNYPIRKSGSVFIRVPYNRMNQEMQRITRLGGKIVSIQTVSALQQLNGKTTIATVTDASSETAKSEGNGKATPVKTDSGAKGFAKPPAEEQLKKKDNKGNTMTQAKAKHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPETGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADELWQLIKNEKTHTYICGLRGMEEGIDAALSAAAAKEGVTWSDYQKDLKKAGRWHVETY

SEQ ID NO: 19570 - protein, 744 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQTLILTPM

SEQ ID NO: 19571 - protein, 752 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQLIFHIRSKMVTAVSK

SEQ ID NO: 19572 - protein, 753 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQLSDESRSINEKTAVSK

SEQ ID NO: 19573 - protein, 282 aa, Geum reptans
GLPPAMSANGHRVMTVSPRYDQYKDAWDTGITVELQVGDKIETVRFFHCFKRGVDRVFVDHPLFLERVWGKTASKIYGPVTGEDYKDNQLRFSLLCLAALEAPRVLNLNSNKYFSGPYGEDVIFVANDWHTALLPCYLKARYQSKGIYMSAEVAFCIHNIAYQGRFTFADFSLLNLPDSFKSSFDFIDGYDKPVKGRKINWMQAGMLESNIVLTVSPYYAKELVSSIDKGVELDNIGRKVGVLGIVNGMDVQEWNPLTDKYTDVKYDATTVMDAKPILKEAL

SEQ ID NO: 19574 - protein, 448 aa, Prosthecochloris aestuarii
MSTTAYCLEPFMEWIQTKNPAEPEFHQAVFEVARSIIPFVNEHQKYQQACILERMCEPDRIISFRVVWEDDKGNIRMNRGHRVQFNNSIGPYKGGLRFHPSVNTGILKFLGFEQTFKNSLTTLPMGSAKGGSDFDPKGKSDREIMRFCQSFMTELSHYIGHFTDIPAGDIGVGAKEISYLFGEYKRLSHQFTGVLTGKSLEYGGSLIRKEATGYGCVYFMEEMLHEKGESIRGKTCTVSGSGNVALYCAQKINHLGGKVVTLSDSDGFIHIPQGISDEELDAIIELKTFKRGRLAEYAEKTACSYFAAEKPWGIECDLAFPCATENEITKSDAALLAGGGCIALAEGANMPTTQDALEVLRNSGILTAPGKAANAGGVAVSGLEMAQNSMRMAWTTQDLDSRLQAIMKSIHQQCTTYGRTNGYIDYVKGANIAGFIKVADAMLAYGIL

SEQ ID NO: 19575 - protein, 752 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQISRYPRSNTTIACSK

SEQ ID NO: 19576 - protein, 282 aa, Geum reptans
GLPPAMSANGHRVMTVSPRYDQYKDAWDTGVTVELQVGDKIETVRFFHCFKRGVDRVFVDHPLFLERVWGKTASKIYGPVTGEDYKDNQLRFSLLCLAALEAPRVLNLNSNKYFSGPYGEDVIFVANDWHTALLPCYLKARYQSKGIYMSAKVAFCIHNIAYQGRFAFADFSLLKLPDSFKSSFDFIDGYGKPVKGRKINWMKAGMLESNIVLTVSPYYAKELVSSIDKGVELDNIGRKVGVFGIVNGMDVQEWNPLTDKYTDVKYDATTGDGCKAYFERSP

SEQ ID NO: 19577 - protein, 136 aa, Triticum aestivum
  misc_feature (26)..(26): Xaa can be any naturally occurring amino acid
  misc_feature (43)..(43): Xaa can be any naturally occurring amino acid
VSPSEAAFSSALTCTMVYARRKKDPXTSIVAGAATGAFLSMRXGLGASAASEAFGGVLLALIEGAGIMLNKFLSAQQPMPMIMDEPQPQPPQSSEQPWLGGWFGGGNREETAGSGGSETKILESFDAPPVPNFEYK

SEQ ID NO: 19578 - protein, 282 aa, Geum vernum
GLPPAMAANGHRVMTVSPRYDQYKDAWDTGVTTELQVGDKIEMVRFFHCFKRGVDRVFVDHPLFLERVWGKTASKIYGPVTGEDYKDNQLRFSLLCLAALEAPRVLNLNSNKYFPGPYGEDVIFVANDWHTALLPCYLKAKYQSKGIYMSAKVAFCIPNIASQGRFAFADFSLLNLPDSFKSSFDFIDGYDKPVKGRKINWMKAGMLESNIVLTVSPYYAKELVSSIDKGVELDNIGRKVGVHGIVNGIDVQEWNPLTDKYTDVKYDATTVMDAKPILKEAL

SEQ ID NO: 19579 - protein, 418 aa, Unknown
  Oceanospirillum sp. MED92
MFSKDMTIADFDADLWSAMQAEAVRQEEHIELIASENYTSPRVMEAQGSELTNKYAEGYPSKRYYGGCEHVDVVEDLAIDRAKELFGATYANVQPHSGSQANAAVYMALCQPGDTVLGMSLAHGGHLTHGASVSFSGRIYNAVQYGLNPETGEIDYAEVERLAEEHKPKMIVAGFSAYSRVVDWQRFRDIADKVGAYLFVDMAHIAGLVAAGEYPSPIQIADVVTTTTHKTLGGPRGGLILSARADEDLQKKLNFAVFPESQGGPLMHVIAAKAVCFKEAMEPEWKAYQGQVVKNAQAMAETFKSRGIKIVSDGTDDHLFLVDLIGKEYTGKDADAALGRANITVNKNSVPNDPRSPFVTSGLRIGTPAVTRRGFKEAEVTELTNWICDVLDNIDNDEVIARVKGQVKEICARYPVYK

SEQ ID NO: 19580 - protein, 267 aa, Prochlorococcus marinus
MPGIVYLVGAGPGDPELLTLKALRLIKNCDALVHDALIPDEITKEAGKHTEIFHVGKRAGKCSVPQKETNALILKLAKEGKNVVRLKGGDPFVFSRGGEEVSILEKNGISVEIVPGITSGIAAPTYFGIPLTHRDAASSVTFVTGHERVDKEKKTVNWRDLAKSSDSLVIFMGIKNIEFIVEELILGGLDKSTKCAVIQEATLKNQKCLIEKLDNLPDKIKDKEFLAPSIIIIGKIVEFKVNNNITKVSDVYLPDINKVQLYNKSQK

SEQ ID NO: 19581 - protein, 282 aa, Erythrocoma triflora
GLPPAMAAYGHRVMTVSPRYDQYKDAWDTGVTVELQVGDKIETVRFFHCFKRGVDRVFVDHPLFLERVWGKTASKIYGPVTGEDYKDNQLRFSLLCLAAPEAPRVLNLNSNKYFSGPYGEDIIFVANDWHTALLPCYLKARYQSKGIYMSAKVAFCIHNIAYQGRFSFADFSLLNLPDSFKSSFDFIDGYDKPIKGRKINWMKAGMLESNIVLTVSPYYAKELVSSNDKGVELDNIGRKVGVLGIVNGMDVQEWNPFTDKYTDVKYDATAVVDAKPILKEAL

SEQ ID NO: 19582 - protein, 219 aa, Unknown
  Synechococcus sp. WH 7803
NSRLCMSSAVAGYTRSLGSDGPPCCYEDLDHCSVVILIGTNTAECHPVLFQRLLKRKKRDPNGLTIVVVDPRSTDTAKIADYHLALAPGTDLALLHGLARLIIQDNGFDSDFIDTATEGFAGFTQTIKTWTPGKTSKFCGIAEKDLRAVARLWSRKERILSLWSMGVNQRREGTAVVGGLINLHLLTGEIGKAGAGPFSLTGQPNAMGGREAGGLAHLL

SEQ ID NO: 19583 - protein, 276 aa, Geum montanum
GLPPAMAANGHRVMTVSPRYDQYKDAWDTGVTVELQVGDKIETVRFFHCFKRGVDRVFVDHPLFLERVWGKTASKIYGPVTGEDYKDNQLRFSLLCLAALEAPRVLNLNSNKYFSGPYGEDVIFVANDWHTALLPCYLKARYQSKGIYMSAKVAFCIHNIAYQGRFAFADFSLLDLPDSFKSSFDFIDGYEKPVKGRKINWMKAGMLESNIVLTVSPYYAKELVSSIDKGVELDNIGRKVGVLGIVNGMDVQEWNPLTDKYTDVKYDATTVMDAKP

SEQ ID NO: 19584 - protein, 939 aa, Wolinella succinogenes
MSEALSGRGNDRRKFLKMSALAGVAGVSQAVGSDQSKVLRPATKQELIEKYPVSKKVKTICTYCSVGCGIIAEVVDGVWVRQEVAQDHPISQGGHCCKGADMIDKARSETRLRYPIEKVGGKWRKTSWDSAMDKIAKQLQDLTQKYGPDSVMFIGGSKCSIEQSYYFRKFAAFFGTNNLDTIARICHAPTVAGVSNTLGYGGMTNHLADMMHSKAIFIIGGNPAVNHPVGMVHILRAKEAGAKIIVVDPHFSRTATKADHYVRLRNGTDVAFMYGMIRHIVKNGLEDKEFIRQRLFGYEEILKECEQYTPEVVEEVTGVPAQQLIEITEIFAKAKPASLIWGMGLTQHTTGTSNTRLAPILQMILGNIGKRGGGTNVLRGHDNVQGASDMGNLADSLPGYYGLDKNAWNHFCGIWKVDFEAMQKRFKTPDMMHKKGFSVSTWRYGVTEEENIPHNAGTKLRALIVVGSGISTIARVDTTKDALDKMDLVVFFDPYFNDAAALTNRKDNLYILPAATQMETSGSVAATNRSYQWRSMVMKPLFECRPDEEILFDLAKRLGFYEEYTRSLGDGKGNFVWPDDATREVAKAIRTVGFQGRTPERLKAHAENWHMFDKFTLRGKGGPVKGEYYGLPWPCWSEKHPGTPNLWDDSIPVMDGGLGFRVRWGDVSPTGESLLASQDSSLPGSKFKGGHSMITDKNVEAITGIALTEEEKAKVAGKTWATDTTNILVEKALAAGLSPMGNGRARAIVWEWTDQIPKHREPIYTIRHDLISQYPTFKDKPNHFRANIRYESRQKEKDWTKEFPLNMLSGRLVAQFGTGTETRSAHYLAEVQPEMFVEIHPETATDLGVKHGDMVWVHGTNGAKILVKARHSYKVNKTSVFLPQNFGGMYQGESLVPYHIAGTEPYVIGESCNTITSDAYDINTSTPETKCGLCRIEKA

SEQ ID NO: 19585 - protein, 219 aa, Unknown
  Synechococcus sp. WH 7803
NSRLCMSSAVAGYTRSLGSDGPPCCYEDLDHCSVVILIGTNTAECHPVLFQRLLKRKKRDPNGLTIVVVDPRSTDTAKIADYHLALAPGTDLALLHGLARLIIQDNGFDSDFIDTATEGFAGFTQTIKTWTPGKTSKFCSIAEKDLRAVARLWSRKERILSLWSMGVIQRREGTAVVGGLINLHLLTGEIGKAGAGPFSLTGQPNAMGGREAGGLAHLL

SEQ ID NO: 19586 - protein, 951 aa, Vibrio vulnificus
MKLIKRSDSVTKEQKQLGISRRVFMRNSSLAAGGAIAGASMFAPGMIRKAEAKSVDASAPIEVKRTICSHCSVGCGIYAEVQNGVWTGQEPAFDHPFNAGGHCAKGAALREHGHGERRLKYPMKLENGKWKKLSWDQAIEEIGNKVLEIREQSGPDSVYWLGSAKHNNEQAYTFRKMASMWGTNNVDHQARICHSTTVAGVANTWGYGAMTNSFNDMHNCKSMLFIGSNPAEAHPVAMQHILIAKEKNSCKIVVADPRRTRTAAKADHYVSLRPGTDVAFIWGVLWHVFNNKWEDKEFIRQRVFGMDEIRAEVAKWNPKEVERVTGVSEEDVYQTAKLLSDHRPGCIVWCMGGTQHTTGNNNTRAYCVLELALGNLGKSGGGANIFRGHDNVQGATDLGVLSHTLPGYYGLAEGSWKHWAKVWGIDFDWLKNRFDQNKYNGKQPMFNMGIPVSRWIDGVLENKDSIEQNDNIRAMFYWGHAVNSQTRGVEMKKAMEKLDMMVIVDPYPTVAAVMNDRTDGVYLLPATTQFETHGSVTASNRSIQWRDQVIEPLFESKPDHEIMYLLTKKLGFADQLFKNVRVVNNQPVIEDITREFNKGMWTIGYTGQSPERLKAHQQNWHTFHKTTLAAEGGPANGETYGLPWPCWGTPEMKHPGTHILYDTSKPVAQGGGTFRTRFGVEFEGKSLLADGSYSKDSDIQDGYPEFSDKLLKQLGWWDDLTAEEKALAEGKNWKTDLSGGIQRVAIKHGCIPFGNGKARTIVWEFPDRVPLHREPLYTPRRDLIADYPTWDDAASIYRLPTLYKSIQDQDKSQEYPIILTSGRLVEYEGGGEETRSNPWLAELQQEMFVEVNPKDANDLGFKDGDMVWVEGAEKGRIHVKAMVTRRVRPGMAFIPFHFGGKFQGEDLRNKYPEGTDPYVIGESANIATTYGYDPVTQMQETKVTLCNIRKA

SEQ ID NO: 19587 - protein, 491 aa, Coxiella burnetii
MLIFEKSRKNRRTLAHAIADKMDANDIPANLLRHDAPRLPELSELEVVRHFTRLSTQNFSIDTHFYPLGSCTMKYNPRAANRLASLPGYLKRHPLSPAPQSQAFLQCLYELQTMLTEITGMEKISLTSMAGAQGEFAGVAMIKAYHESRGDYDRTEMIVPDAAHGTNPASAAMCGFTVKEISTTKDGDIDLEKLRQMAGAKTAGIMLTNPSTLGVFERQISEVAKIIHNAGGLLYYDGANLNAILGKYRPGDMGFDVMHLNLHKTFATPHGGGGPGAGPVAAGPRLSKFLPVPMVGKNKEGYDWLTEKECPKSIGRLSAFMGNSGVLLRAYIYLRLLGKEGLSRVAEFSTLNANYLMKRLEQLGFTLAFPNRRASHEFIITLKPLTRAYGVTALDIAKRLLDYGFHAPTIYFPLLVPECLLIEPTETESKQTLDHFIEAMEKILTEIKTTPDLLRNAPHQQLINRLDEVKAARELDLRWYPIAKETEIFIQ

SEQ ID NO: 19588 - protein, 372 aa, Shewanella oneidensis
MNLSEIAYRRVVVKLGTSVLTSGSKQLDKAHMVELARQMAALMRSGVEVVLCTSGAIAAGREHLQYPALPDTMANKQLLAAVGQSQLILAWAQLFSIYGLHVGQLLLTRADLHDRERYLNARDTLNALLANNIIPIINENDAVATNEIKVGDNDNLSARAALLCDADLLILLTDQKGLFDADPRTNPNAKLISQVEKIDDSLRLLAGGSVSGLGTGGMSTKLEAADIARRAGIEVVIASGHHPDVIKKVVAKESIGTHFSAIENPLESRKQWILAGPAAQGSLVLDAGAVKAVTEKGRSLLSKGIIGVKGEFERGATLQLVDQNGKIIARGITRYCGEALGLIAGKHSDEIESVLGYDYGDAIVHRNDMVVL

SEQ ID NO: 19589 - protein, 446 aa, Coxiella burnetii
MPFIPHTPDDIEKMLAVIGAESIDQLFDEIPSALANIQQVPPGLNEAGITRLMEKREPNKQLCFIGAGAYEHHIPAAVWEIATRGEFYTAYTPYQAEASQGSLQLIYEYQTMMAELMAMDVSNASLYDGASALAEAALMAVRIKRGKAQRILVPASVNPFYRKVLSSIVEQQKINVEIIPFDPTMGIVNSELLKAKNAEGAAAIIIPQPNFFGCLEAVDVLTDWAHANDLLVIASVNPTAMALLKPPGQWGQKGADIVCGEGQPLGVPLASGGPYFGFMCCKKDYVRQLPGRIVGRTVDKKGREGFTLTLQAREQHIRRSKATSNICTNQGLAVVAATIYLSLLGATGLREVALASHTQSRDLFQRLSAVKGVSPVFSSPIFHEFVVRLEKPVEEVLAAMAEQGIQAGFSLKNDYPKLGNGLLICVTDTKTDDDLMAYENALRSIQ

SEQ ID NO: 19590 - protein, 425 aa, Shewanella oneidensis [sequence omitted]

SEQ ID NO: 19591 - protein, 485 aa, Pseudomonas fluorescens
MSEEILINITPMESRVAVVENGVLQEVHVERTQRRGIVGNIYKGKVVRVLPGMQAAFVDIGLDRAAFIHASEISTREGTAVESISALVHEGQSLVVQVTKDPIGSKGARLTTQLSIPSRYLVYMPRTAHVGISLKIEDEAERERLKQVVSDCVAQEGIKEAGGFILRTAAEGAGADEIMMDIRYLRRLWDQIGAQIKTIGAPNVIYEDLGLALRTLRDLVSPKIEKIRIDSRETFQKTTVFVAELMPEIADRLEHYPGERPIFDLYGVEDEIQKALERKVPLKSGGYLVVDPAEAMTTIDVNTGAFVGHRNLEETIFKTNLEAATAIARQLRLRNLGGIIIIDFIDMEDEEHQRQVLRTLEKQLERDHAKTNIIGITELGLVQMTRKRTRESLEQVLCEPCSSCQGRGKLKTPETVCYEIFREILREARAYQAEGYRVLANQKVVDRLLDEESGNVAELEGFIGRTIRFQVETMYSQEQYDVVLL

SEQ ID NO: 19592 - protein, 260 aa, Brassica napus
LDALTRLMSCAPQLVDLGVGSYENEPDQESFMKLMAAIKKCTELRSLSGFSEVAPLCLSAFYPICQNLTSLNLSYAAEIQGNHLIRFIQFCKRLQRLWILDSIGDKGLEVVASTCKELQELRVFPSDLHDEEDNDTAVTEIGLVAISAGCPKLHSILYFCKQMTNAALITVAKNCPNFIRFRLCILEPNKPDHTTSQSLDEGFGAIVQACKGLRRLSVSGLLTDKVFLYIGMYAEQLEMLSIAFAGDTDKGMLYVLNGCK

SEQ ID NO: 19593 - protein, 636 aa, Vigna radiata
MMESCDCIDTQYPPDELLVKYQYISDVLIALAYFSIPVELIYFVQKSAFFPYRWVLMQFGAFIVLCGATHFINLWTFSPHSKAVAVVMTIAKVSCAIVSCATALMLVHIIPDLLSVKTRELFLKNKAEELDREMGLILTQEETGRHVRMLTHEIRSTLDRHTILKTTLVELGRTLGLEECALWMPSRNGLNLQLSHTLTYHVQVGSTVQTNNPIVNEVFNSPRAMRIPPTCPLARIRPLVGRYVPPEVVAVRVPLLNLSNFQINDWPDISAKNYAIMVLILPTDSVRRWRDHELELVDVVADQVAVALSHAAILEESMRARDQLMEQNVALDLARREAEMAIHARNDFLAVMNHEMRTPMHAIIALSSLLLETELTPEQRVMIETVLKSSNVLATLINDVLDLSRLEDGSLELEMGKFNLHGVLGEIVELIKPIASVKKLPITLILAPDLPTHAIGDEKRLTQTLLNVVGNAVKFTKEGYVSIRASVAKPESLQDWRPPEFYPTSSDGHFYIRVQVKDSGCGIPPQDIPHLFTKFAQSRSGPARPSSGAGLGLAICKRFVNLMGGHIWIESEGPGKGSTATFIVKLGICGNPDPSDHQATTRSQAYSGSGGLARFKPFIKDEDDSGFSTRRNQRSF

SEQ ID NO: 19594 - protein, 113 aa, Xylella fastidiosa
MSDYVLHVSDANFDAVVLLSDQPVLVDFWAKWCSPCKIISTLLDDLAQSYKGRLKIAKVDIDENRALAIKYHVCSIPMLLLFKDGQVQITQIGAVGKGRLTQMIDKVLANTDS

SEQ ID NO: 19595 - protein, 287 aa, Unknown
  Streptomyces sp. C5
MTVPTPRHGTPHGGLPGRTVLITGATSGIGRAAALAIARQGARVVLVGRDPERLRTVTNEVARTAGPAPDAFRADFAELRQVRELGERLRDRYPRIDVMAGNAGGMFWSRTTTQDGFEATLQVNHLAGFLLARLLRERLAGGRLILTSSDAYTQGRIDPDDLNGDRHRYSAGQAYGTSKQANIMTATEAARRWPDVLTVSYHPGEVRTRIGRGTVASTYFRFNPFLRSAAKGADTLVWLAAAPAEELTTGGYYSDRRLSPVSGPTADAGLAAKLWEASAAAVGDTAR

SEQ ID NO: 19596 - protein, 329 aa, Burkholderia pseudomallei
MHAWSAQHVPPQGGKVAVVTGANSGLGWQIAQTLAAKGAQVVMGCRDTAKGELAAHAIRTRYPRARIEVEALDLADLASVCRFADAVADRHGRVDILCNNAGVMFLPLRHTRDGFEMQMGTNHLGHFALTGLLLPALRASHRARVVTMSSGFNRLGKIRLDNMLAERGYNKYRAYCDSKLANLMFTLELQRRFDQACLPILSVAAHPGYAATHLQFAGPEMANSSLGTFAMRLSNRLVAQSADVGALPAIHAATAVDVDGGAYIGPAHLCETRGYPAEARIPRQARDVRMGKRLWEKSEQLTGVRYLDTPPPPGSRRRASRDDATFGAL

SEQ ID NO: 19597 - protein, 262 aa, Unknown
  Synechococcus sp. WH 8102
MSIDLRASSLDPVQIPGWRWQPFLDEASAALKPFNPSPYPIAETFLQKEGSTGSKAKPVPVTTATWACSTDKLRQVRCACVEAGMAASVLNFVINPSCRFDLPFFGADLVTLPNGHLLALDLQPVDKADPDHTQPVWERLMPLFERWQAELPDGGPIPEEAQPYFSPAFLWTRIPLGEEGDELIERVIRPAFIDYLQLYLNLVAEAEPVSDDRAELLLSGQKRYTAYRAEKDPARGMLTRFYGSEWTESYIHGVLFDLEDAA

SEQ ID NO: 19598 - protein, 1418 aa, Burkholderia pseudomallei
MTSASVKTVCPYCGVGCGMVLHVEDGEVVKVSGDAEHPTNLGRLCTKGSSAHVALRNAGRLERAFVRDARELDPAPVPIADAIAETARRLRATLDAHGPDALAFYVSGQMSLEAQYLVNKLAKGYVRTPHIESNSRLCMASAGSGYKLSLGADGPPGSYQDFERADLFFVIGSNMADCHPILFLRMMERVKAGAKLVVVDPRRTATAQKADLFLKIRPGTDLALLNGLLHLLHANGRTDADFIAAHTEGWDAMPGFLADYTPQRVAALTGLAEADIRLAAQWIGDAREWTSCWTMGLNQSTHGTWNTNAICNLHLATGKICRPGSGPFSLTGQPNAMGGREMGYMGPGLPGQRSALDGDDRRFVEEIWGLPAGTIRPDAGGGTVDLFARMAAGDVKACWIICTNPVATVANRKNVIAGLQAADVVIVQDAFLDTETNRYADILLPGALWAEAEGVMINSERNLTLMRQALEPPGDAWPDWRIVAAVARGMGYGDAFDYGSAAEVFDEIRRFANPNTGYDLRGASHAALRATPLQWPCPPEDGRDRHPIRYLNDGASRPRVTLPDGCVPPLAFPTPSGKARFFARPHVAPAEMPTPEFPIVLNTGRLQHQWHTMTKTGKVAMLNKLDARPFVEIHPDDAAALSIAANDAVEIRSARGRAVLPAVVTDRVQPGACFAPMHWNDVYGDDLCVNAVTNDAVDPVSLQPELKFCAVALARVDAPDSADAGAHAGAHAAPLHETGSREAQAQAAPRAHEAACADAAPEEHDMSDIDTFAALLGVPAATSAPQLTDAQRVYVSGFVSGLRSAEGRRAGGVPMLPASAPFDAKARLWLDGLLAGLFSRAPLGAAARVDARAAAAAAVPAPSGAADAVSAPSGVRIVRTRPKVVLLWASQTGNVESLTERYATQLMDSGFEIRVACMSDYPAASLAKAQYALLMTSTFGDGDAPDNGQAFWTALAAAGAPRADGLRYAVLAFGDRNYDPFCGHGRRLDARLAELGATRLVERVDCDAEFQPAADAWLERAIARIKEEDAALHAVPADGMIPSGAIPTKTRPAASRLVANLRLNEPGAAKDTRCVSLSTDGAAIEYETGDALGVWPTNCPELVDELLALTRLKPDAPVTVAGMGELRLADALAKHLDITRPHPDALAFVASRSRAGDALARLLGDDRKTDLKHWLWGQQLADVLHEFPLELSAAELVGMLKRLQPRLYSIASSPSAHRGEIHLTVSAVRYGNGRRQRKGVASTFLADRAADAPVPVFVQKSAHFRPPASGDAPIVMVGPGTGIAPFRGFLHERRARGAKGRNWLFFGEQHADTDFYYRDELAQMRADGFLTRLDVAFSRDQTEKVYVQDRMLEQGAALWAWLEEGAHFYVCGDASRMAKDVDAALKTIVARHGGMTDEQAADYVARLAKDKRYARDVY

SEQ ID NO: 19599 - protein, 861 aa, Burkholderia pseudomallei
MSTGKQRASIMKIVVIGHGMVGHKLLECIAAGAPGALAAPRVAVVCEEPRPAYDRVHLSEFFAGKSADDLSLVEPGFFERHPNFRLLLNTKAVAIDRAARTVALSTGETLAYDKLVLATGSTPFVPNVPGRERAGCFVYRTIEDLEAMRACGARANSGVVVGGGLLGLECAKALRDMGLAAHVVEFAPRLMAVQVDEGGGRMLREKIEALGVQVHTGKNTLEIVDGETGAHRMAFADGTHLDADMIVFSAGIRPRDEIARACGLEIGPRGGVAIDERCRTSDEDIYAIGECAAWNGQTFGLVAPGYDMARVVARQLAGGEGAFAGADLSTKLKLMGVDVASIGDAHGRTPGSRAYQFADERRGVYKKLVVSECGKALLGAVMVGDAADYGTLLQMMLNRIELPRSPEFLILPQADGAAKPALGVDALPDAAQICSCNNVTKAQLREAVAGGATSLGALKGCTGAGTSCGGCVPLVTQVLKAEMKKQGLAVNNHLCEHFPYSRQELYHMVRVERFKTFGALLKKHGRGLGCDVCKPAVAGILASCWNEFVLKKEHAALQDSNDYYLANIQRDGTYSVVPRMPGGEVTPEGLIAVGEVARKYGLYTKITGGQRVDLFGARVEQLPLIWEELIAAGFESGHAYGKSVRTVKSCVGSTWCRYGVGDSVGLAIELENRYKGLRAPHKLKFGVSGCTRECAEAQGKDIGVIATEKGWNLYVCGNGGMKPRHAELLAADLDRATLVRYVDRFLMFYIRTADRLQRTSVWRDNLEGGLDYLIDVVVHDKLGLAAELEAEMQHVVDTYECEWKRAVTDPATRRRFRHFVNSDAPDSTIAFVEARGQIRPVTPDERDAEGQADRQPETETA

SEQ ID NO: 19600 - protein, 355 aa, Glycine max
MAMAVSAIGFEGFEKRLEISFFQPGLFADPEGRGLRALTKSQLGEILTPAACTIVSSLKNDNVDSYVLSESSLFVYAYKIIIKTCGTTKLLLAIPPILKFAEMLSLNVKSVNYTRGSFIFPSAQPYPHRNFSEEVAILDGYFGKLGAGSNAYILGGQDKAQNWHVYSASADSVTQCDNVYTLEMCMTGLDREKAQVFYKEQSASAAMMTVNSGIRKILPDSEICDFDFEPCGYSMNSVEGAAVSTIHVTPEDGFSYASFETVGYDFKAVNLNEMVQRVLACFLPTEFSVAVHVDGASKSFEQTCFLDVKGYCREERSHEGLGMGGSVVYQKFGKTSDCGSPRSTLKCWNEEDEEE

SEQ ID NO: 19601 - protein, 160 aa, Unknown
  Populus tremula x Populus tremuloides
MSTSEFKGFTEEQEALVVKSWSAMKKNASELSLKFFLKIFEIAPSAQKLFPFLRDSSVPLEQNPKLKPHAMSVFIMTCESAVQLRKAGKVTVRESSLKKLGAVHFKNGVVDEHYEVVKFALLETIKEAVPEMWSPEMKKAWGDAYDQLVAAIKTEMKPSS

SEQ ID NO: 19602 - protein, 226 aa, Petroselinum crispum
TSKSMATVKLLGFWASPFVNRVQIALNIKSISYELIEENLRAKSQLLLESNPVHKKVPVLIHGDKPISESLVIVEYIDEAWTHGPSILPSDPFARATARFWAAYITDKWWPLLTEYRTAEGEEAKAAAKEKFLEGLVLLEEAFVKSSQGKGYFGGDNIGYLDVVLGSLLAWLRVREVTQGVAFLDKAKAPELAAWADRFTSNPAVVDVLPKTEKVVDFLNSFNRAN

SEQ ID NO: 19603 - protein, 441 aa, Burkholderia pseudomallei
MSDKATRIELLDWRTVPMRAFHLTWIAFFVCFFAWFACAPLMPLIAREFRLSADQVANVNIAAVAATIAVRLVVGPLCDRFGPRRVYAGLLACGAIPVFAVTLSHDYLTFLLCRLGIGAIGASFVITQYHTSVMFAPNVVGTANAAAAGWGNAGAGAAQAAMPLVVAAALLLGLPDACAWRAALAVPGAAMLVMAIVYWRGTQDCPQGDFVALRARGVTIDSGKKGGFASFAAACGNYRVWMLFVTYGACFGVEVFMHNIAALYYVNHFALSLKDAGLAAGIFGLLALFARALGGWLSDRVAARRGLDVRATLLFALILGEGLGLLWFAHAGSVPVALVAMVAFGLFTHMACGATYALVPFIDRRALGGVAGIIGAGGNAGAVAAGFLMKGVGDIQQTLTLLGLFVTVSAFCALAVRFSAEHKAREAALRERALAASGFTH

SEQ ID NO: 19604 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQVYPYTRSKGVGVLQ

SEQ ID NO: 19605 - protein, 1502 aa, Yarrowia lipolytica
MPPNSLAKQYDADKERLIKSCFSKVDQTGQLLESYITHVRVTEDSHYPSARPPPDSPVANKKPRVIIIAVRKSGRVRMHKARENANGTFQIGKTWNLDDLTSVENDLQIPSGFTMHLGKPYYWMTGSPKEKTVFVSSAIRIYRKYRNGAVPTMIGWDASIGSPMVGQSPKFKGGQQQGGHGSPVGGSHGSPGNMGTPPLAGQSPLHPGQSPLLPGQSMPLQPGQSQPIKMGHSGSPVNANFSGSPGSAGFAGSPGNAAYAGSPSKTHTSPYKHARGRSTASVSSAVSIGSGSSAGNSIPGHGRRTSVISINDSPVPQSPVRSGISTSQSANNVRSMVDPEPGMKQTGISQSKSLGNVAAAAEPIPKLDDHLLEQQRQAEQQQRREQQQREQQRQAELRAEREAEQRLEQQRQAERQEQQRLAEQQRLAEKQRVEQQRIEQQRQAEAEHQHRLELDRLERERQEKARLDLQRQERERQERERKSSVSQAAEAAAAAAAASAAVAAAVSTTPGRKSSVADVSSAASAVTPRRKSSDVITIEDSPSPPTAAALENRQPTIPVISVDDDVVNVDEDDFDMDSPNPAPIAPVVPAALAHNRSFSQELAGAGFVEEKPAGGSRELTREPKLPEFVVIDDKPPPAVQRHQRNTSQMSFESNLEPVDENKQVTRHQKKVSLSEPSSEGLPIVGSTRRDSTGTGGHRRNRSNGSLGSSRRLSRDLSSGGNMAPITYVGTSQADSTLIEDTLIELNWSGNKDAKELEADINRELAQLEESNISHVIDLDTKFGDLTTDLDQAIAQCDELDAILTFFSVELGGLGSDIDYIESQGHGLQVQTTNQKILWEELNSILDTMSVPQREMEIIRRVRLDSAQDVAYAEAALVDLFAALASVRKMGSNSRDEEVFIGGMRALQERRSLYEQAAVDFIARAQVSLQEKVRDAVVSSSTQLSAASASPTIPGLISTVNSLYKFAGIILFIRDVDQTAYSAILKQYERSARDYYEAASTAFFAKWKQQFKASDKTDQQSMFSPGREHEPTEHKVSAVRQLTMKRSHSHQNVGQRKRDVSLSLSKNDKLQNSFSGIVEALQTALNSEQEILIQLFHMTSFGAANYGTYIKQYPAGQRLAFARHVKKRGVDPDRAQTRAFSTVLSGIFAPFSHECLTYFENVMESRPLECPTLFAVLDAHIEPMESTNQAFLLTLVHKIYDKSVNIWKTFVSRQIDMISNTHVSCKRRSGVLGFVATFPEFCEKVEQQISGEKNGAVRTLVNDSYDKLGKAILHNLQRAADDVSLKNSSSGGTGTAIKMAASLASSSGAKGDEHEDKEILNYHILMVENMNCLMDSLHENIISHSHVLIGHRDTAVSQYRTHLSEYSDNVLRRPFGKIIDYVQGVEALLKKDPSATPNQKHSYNKKALKAAISSCPQKDLRKVIDILRKRVEKHFGASPDDDLATVGNVPVYNDELLAKVWNALQAETISVFNRLTNIMNKYFSESSAQNDITKAEIQAAFAR

SEQ ID NO: 19606 - protein, 243 aa, Bradyrhizobium japonicum
MSGFVSFISAGPGDPELLTLKGAARLREADVVLYDDLASGAILDLARPGANLVAVGKRAGRPSTKQHHVNRLLVDYAATGARVVRLKSGDAGIFGRLEEELETLREAGIGYEIVPGVTSACVAAAQAGIPLTRRHTSRRVQFVTGADVTGELPQNLNWAALADPEATTVVYMGRRTFPALAAKLIAHGLAPTTPALFAESLGRPDERLVRTTIAELAEQLARGGAASTAAVILFGALAGEYPS

SEQ ID NO: 19607 - protein, 165 aa, Unknown
  Populus tremula x Populus tremuloides
MQSLQEKASEWSGVDSADAFAIDNTNLFQKLGLQTFINLSTNFYNRVYDDEEEWFRSIFVNSKKEEAIQNQYEFFVQRMGGPPLYSQRKGHPALIGRHRPFPVTHQAAERWLHHMEKAVDSTSDIDGDSKIKMMNFFRHTAFFLVAGDELKNQNGRVPCKHGASK

SEQ ID NO: 19608 - protein, 680 aa, Arabidopsis thaliana
MSSLISFNFLFLFSFLTSSFTASAQDPFYLNHYCPNTTTYSSNSTYSTNLRTLLSSLSSRNASYSTGFQNATAGKAPDRVTGLFLCRGDVSPEVCRNCVAFSVNQTLNLCPKVREAVFYYEQCILRYSHKNILSTAITNEGEFILSNTNTISPNQKQIDGFTSFVSSTMSEAAGKAANSSRKLYTVNTELTAYQNLYGLLQCTPDLTRADCLSCLQSSINGMALSRIGARLYWPSCTARYELYPFYNESAIETPPLPPPPPPPPPRESLVSTPPISSSSLPGKSGNSTVLVVAVVVLAVLLFIALVGYCFLAKKKKKTFDTASASEVGDDMATADSLQLDYRTIQTATNDFAESNKIGRGGFGEVYKGTFSNGKEVAVKRLSKNSRQGEAEFKTEVVVVAKLQHRNLVRLLGFSLQGEERILVYEYMPNKSLDCLLFDPTKQIQLDWMQRYNIIGGIARGILYLHQDSRLTIIHRDLKASNILLDADINPKIADFGMARIFGLDQTQDNTSRIVGTYFVVDSSGYMAPEYAMHGQFSMKSDVYSFGVLVLEIISGRKNSSFGESDGAQDLLTHAWRLWTNKKALDLVDPLIAENCQNSEVVRCIHIGLLCVQEDPAKRPAISTVFMMLTSNTVTLPVPRQPGFFIQCRAVKDPLDSDQSTTTKSFPASIDDESITDLYPR

SEQ ID NO: 19609 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQVSDGIRSMGTANLQ

SEQ ID NO: 19610 - protein, 579 aa, Methanosarcina barkeri
MEKLAKFKALGLSDSMLKALKKKGFEEPTPIQEKVIPLFLKGECDIIGQAQTGTGKTTAFGAPIIEKIPEKSGKVQAIVLTPTRELAIQVSEELNSLKGDKKLHIVPIYGGQSMTQQFRMLKSGVDIVVGTPGRVIDHLERKSLNLENIAYFVLDEADEMLNMGFIDDIKEILKATGPDKRMLFFSATMPKPILGIIKKHMKNYEYVAIKKEDLDVNLTEQIYFEVKESDKFEALCRIIDIEDEFYGLVFCRTKTDTSQLAQKLGDRGYAADALHGDLSQREREKILNRFRKQKINILVATDVAARGIDIMDLTHVINYSLPQDPESYVHRIGRTGRAGKQGTAITFVTSTEYRRLTYIKKTSKSAMKRGRIPEIKDVIKAKRARVKAELEETIKNEEYGDCLEMSEKFLEEYPAEKILAALLKYSFKEMFDESMYTEISGSSYVDRKGKTRLFIAMGKADGMTPEKLCEFIQEETGVSDLKIRDAEIFPHFSFVTVPFAQASALLEIFKDKKRGRKPFIELAQKSKRRSSKSADEYRGGTRNGSRSYSRNDSWNGSRNTNSKSYTRDTRTAKKKYSSY

SEQ ID NO: 19611 - protein, 352 aa, Campylobacter upsaliensis
MSEKILFIDRDGTLIKEPKEDFQVDSLEKLAFEKGAIPALLKLQKFGFKFVMISNQDGLGTTSFPKEDFEKAHFKMLEILQGCGIEFKDIFICPHFEKENCACRKPKAALLKDYIKYHLYDKGQSFVIGDRQSDMDLALNLGLSGLRYGELSWEEITEQILNSFRYASVKRKTKETDISVKVALNGGEVSVKSGVAFLDHMIEQIAVHSGIGLELSCRGDLEIDEHHSVEDIALALGEALKRALGDKIGIARYGFVLPMDESLASCALDFSNRPFLKFKAKFKKKKLGTLSTEMIEHFFYSLSYALGVSLHLKVKGKNDHHKCEALFKAFAKALKQAIKIESENLASSKGML

SEQ ID NO: 19612 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQCFNDARSVRTGTLQ

SEQ ID NO: 19613 - protein, 727 aa, Physcomitrella patens
MAACTIVWFRRDLRLEDNPALIAAARAGTVVPVFVWSPAEDGQFHPGRVSRWWLKQSLTHLELSLKKLGSPLILRKSPDTLSVLLEIAEATGATQVFYNHLYDPVSLVRDHRVKQGLSQRGIVVHTFNGDLLYEPWEVYDEEGQAFTVYEAFWKKCMSMPFEPEAPLLPPRRLTGPIGKIVGCNAEELGLEDEFEKSSNALLARAWCPGWGFANKSLDSFLRSPLIDYARDRQKADGASGTPTSLLSPHLHFGELSVRKIFHEVRKRQITWAREGNAGGEASVNMFLRALGFREYSRYLSFHFPFTHERSLLANLKSFPWRADEGYFKAWRQGRTGYPLVDAGMRELWATGWAHNRIRVVVASFSVKFLQLPWRWGMKYFWDVLLDADLECDVLGWQYISGSLPDGHELDRIENPEVEGYRFDPDGDYVRRWIPELARLPNEWVHHPWDAPPSALRAAGVELGTNYPRPIVEIGAARERLQASLAEMWERDAAMKAALANGLEEGLGETVEVAGTGGPEHERMDVPRVMVHMQRDADMSCNSSRRDQLVPEIVPNQFHIRAHESIMNRSAAMVEDGEEAGRAAVPMVFASVRRGMGGNYGGHHVEGNGGEVAQASAPIQWPTVTAVDYELDSTAESASVTGRGGSEGGTVPVWSQSVSARTPIQVREGLVPEVRRGPGLSRRQLQASVQRVNLEGMTSNKQAEEEDFYVPKLVKWTQPRKRRVKQDG

SEQ ID NO: 19614 - protein, 599 aa, Streptococcus agalactiae
MLYPLLTKTRNTYDLGGIWNFKLGEHNPNELLPSDEVMVIPTSFNDLMVSKEKRDYIGDFWYEKVIEVPKVSEDEEMVLRFGSVTHQAKIYVDGVLVGEHKGGFTPFEVLVPECKYNNEKIKVSICANNVLDYTTLPVGNYSEIIQEDGSIKKKVRENFDFFNYAGVHRPLKLMIRPKNHIFDITITSRLSDDLQSADLHFLVETNQKVDEVRISVFDEDNKLVGETKDSRLFLSDVHLWEVLNAYLYTARVEIFVDNQLQDVYEENFGLREIEVTNGQFLLNRKPIYFKGFGKHEDTFINGRGLNEAANLMDLNLLKDIGANSFRTSHYPYSEEMMRLADRMGVLVIDEVPAVGLFQNFNASLDLSPKDNGTWSLMQTKAAHEQAIQELVKRDKNHPSVVMWVVANEPASHEAGAHDYFEPLVKLYKDLDPQKRPVTLVNILMATPDRDQVMDLVDVVCLNRYYGWYVDHGDLTNAEVGLRKELLEWQDKFPDKPIIITEYGADTLPGLHSTWNIPYTEEFQCDFYEMSHRVFDGIPNLVGEQVWNFADFETNLMILRVQGNHKGLFSRNRQPKQVVKEFKKRWMTIPHYHNKKNSVK

SEQ ID NO: 19615 - protein, 1075 aa, Unknown
  Magnetococcus sp. MC-1
MSRLVKWLLVLVLLPVVADAQQGERPWPVTVAVLQDFPPLYSLDTHGKPQGLAIDLLQQVAQQAQLKITYKVVQNWGQAMQLVRQGEADFVPGIGITEVRRAEFLFSHPMESVPVSCFVRKQNRSIQGLQDLPGYSVGVIAQSAAHTRLSQIPNMRLKLYQSIDEAFFQLLAGELDAFVTSRPVMEKKARKIAPQEMIKVVGEPLMDLKRGYLLSTQNRALLQRIDPIIQHLTRSARYGEIYARWYGTAAPFWSVEQVFWIMSALLVAVLVVGGLYRVFAIARYNRELQRSIAAQQQAEQRLQRSEERFALAMRGSNDGLWDWDIPTDRVTFSPRWLEMLGYQGAPQDADMRHWQAHIHPDDQPRVEQALGRFLSGDQQHYHSEYRMRHKDGHTIAVLSRAFVLRDATGRAIRMVGTHADITALKEQARRLRESETRFRAYFEQSVVGMVMASLDRHFIDANHAFCHMLGYSRGELLKMNFPQITYPDDLERDLVQFEQLRSGQVSAFEMEKRYLHRDGHPVWGLLSATTVKDELGQASYLIAQVQNIDTQKKALEQLRQSESMMRGYFELGLIGMATTTAQHGWVQINQRLCEILGYPEMALRQKSWAEITHPQDRQADEVAIERLRKGLSEGYALEKRFIRQDGAFIYASISAGCLRKEGGEIGHFLTLVQDITARKRMELALQEQKEQAEAANRAKSTFLAVMSHEIRTPMNAILGMAELLRESDLTSRQHWCVETLNRSGESLLSLINDILDLSKIEAERLTLEHVVFDLVQLVGDVCSLFGYEAQSKGLALKHHIAPTLPRYVVGDPIRLRQIMMNLVGNAVKFTKQGHVSVELNPLADGRLSFVIRDTGIGVSVEQQRNIFKPFTQADSSITREHGGTGLGLTICMRLVALMGGEMQLESTLGEGSCFHFELELPAAPPGAESVVGTPRTLADVASALRLESAAHHNDPILVVDDAEDNRMLVNVFLKKTRYTLVMAENGLEAVNAFKQQPFALVLMDIQMPLMDGYEATRQIRQWEQQKGSGRTPIIALTAHALSEESQQILEAGCDIHLTKPIRKSKLLEVLAEVLA

SEQ ID NO: 19616 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQHCCHLRSSAETVLQ

SEQ ID NO: 19617 - protein, 282 aa, Geum montanum
GLPPAMAANGHRVMTVSPRYDQYKDAWDTGVTTELQVGDKIETVRFFHCFKRGVDRVFVDHPLFLERVWGKTASKLYGPVTGEDYKDNQLRFSLLCLAALEAPRVLNLNSNKYFSGPYGEDVVFVANDWHTALLPCYLKAKYQSKGIYMSAKVAFCIPNIAYQGRFAFVDFSLLNLPDSFKSSFDFIDDSDKPVKGRKINWMKAGMLESNIVLTVSPYYAKELVSSIDKGVELDNIGRKVGVHGIVNGMDVQEWNPLTDKYTDVKYDATTVMDAKPILKEAL

SEQ ID NO: 19618 - protein, 615 aa, Cytophaga hutchinsonii
MCGINIIIDKKGVLTSREIQSMNQAILYRGPDHSDFVSFQFKQQQIFIGNNRLKIIDRNTLSNQPYNSIDKRYSLTFNGAIYNYKELKQQLPAMEWQTESDTEVLLNWMIVHGLSGLPELNGMFAFAFYDRQQHALIIARDPSGIKPLYYYNDDDYFIASSEIKGILASGLVKKEFNSNQVSHYLQFKYVPKPFTFYKNIFELNEATFIKIDEYDFKIKRFESPSVIKPNTLTNQQLIETCDQLIENAVKHHLVADVPVGLYLSGGIDSTLLLSKIRKLGHLNFPTFTIANSSREQAFGTRDFEFARLASKLYNSDHHEVSVHAEMLQDLPAFVSMIDQPIGDSALFLTHILSKEAGQHVRVALNGAGADELFAGYNRHSAYKSYLNNLLHKNLAITLIKSTYNILPDGGNHSLKKVFRLWNKFTGMMDVDPIKTCHNFSSSEYFIEKNTSIEVDDKSYEDLSYYLYYCLRNDRTKYLISDILALTDKMTMRSSIEARVPYLDQELRRFVESLDPSVLLKNGRKWILKEVLLRNGGETFLNRPKEGFGMPFGYWLKLPVNKNFVEKLTNKNHPIYEWVPYQTIKNLVDWHLGSKRDCSSELWSVLLLMHWYEKEF

SEQ ID NO: 19619 - protein, 1070 aa, Unknown
  Synechocystis sp. PCC 6803
MNSILSPITVAVGGSLWWNGFTADFTITNTSTTSLSNWTYTFDTVHKISGNPWGATFTSVDLGNGITRYTLTGAGWASSIPPGGSVTIGFNGTQGTAIGNSGSLTSALLFTDVNANTGGTGGEHQHPDPIPPTDPVVDPTPNPGTGRVFAANPAAADIVGFNPAVDRLDFGDVSVHNLILGKTSTGKVAIINPWAWTPEFQIIRGVSFDDLTAANFGIVQNEHLRQDIGGVLSWELGLGARNSNTVYVRSHEYGVQERIENFNPATMKLSFLYYGTRERLTVSDTPEGLLIATQPTGQTLLLVGVTRSQLIPANLEFHHDQVVEDRLEDAFGVTVEQVTVVSRTGLATPQGPAGQITDGHQSRPGNGLTPIGGGEFSGGAGGHGSGHDHGDHDHGGGMDHGSDPGDGMGGGTTNPPVTDPVTPPPTDPVSPTSPFTVTVGGNRWWNGFTAELTVTNVSGTKLNSWSFTFDTVHKISGSPWGATVQSTDLGGGITRYVVTGSEWAASIAPGSSVKVGFNGTQGTAIANDGALTADLLFLGGGIVGQPSTGSGGNTGGTPTNPNPPTDPINPNPNPVDPVDPPAIANGDHNYGEALQKSFLFYEANRSGDLDESTKRIDWRGDSGLRDGRDGIYFGGQSSGNLQAGLSLDLTGGYHDAGDHGKFGLPLASTLTTLAWGGVEFTDGYQTSGQMDDLLATIRWGTDYLLKAHVTNANGETVFFVAQVGNASADHSLWSAPESQTIARPAMAVTANKPGSDVAAGSAAALAAASILFREAGDFAYADELLVNAQSLYRFADTYRGKYSDSIPEVRNYYNSWSGYEDELAYGAAWLSRAVNSAGGDGSAYLQKALNIYNSDIGGLSRGWTHNWDDASYGVAVILAQDTGNQAIKQDVTRWLDAWVNGTDGVQITDGGLRFISQWGSLRYAANTAMLAAVYSDGLTDPTGKYAQLAQDTVDYILGSNPRNASYMVGYGNDFPQQPHHRAASGVGWDGFRNGLPNEHILFGALVGGPTAANDFSYNDSRDDYISNEVAIDYNAGLTGALAWSVEQFGGNPLTAAQLNALPGISAPQGM

SEQ ID NO: 19620 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQGNGHNRSSIDEVLQ

SEQ ID NO: 19621 - protein, 282 aa, Geum rivale
GLPPAMAAYGHRVMTVSPRYDQYKDAWDTGVTVELQVGDKIETVRFFHCFKRGVDRVFVDHPLFLERVWGKTASKIYGPVTGEDYKDNQLRFSLLCLAALEAPRVLNLNSNKYFSGPYGEDIIFVANDWHTALLPCYLKDRYQSKGIYMSAKVAFCIHNIAYQGRFAFADFSLLDLPDSFKSSFDFIDGYDKPVKGRKINWMKAGMLESNIVLTVSPYYAKELVSSIDKGVELDNIGRKVGVLGIVNGMDVQEWNPLTDKYTDVKYDATTVMDAKPILKEAL

SEQ ID NO: 19622 - protein, 591 aa, Gibberella zeae
MATAHMAVRTDTFPHSTSRSHSHSHQSMGARIIPIPTPTIKMSPPSNGDPMEITSPAPSSNGNHNSDSEANGNGQSNDRPKNSPAPDSNTVTSNSVNNSNSMPAPPPAAAAVHQPKIVQTAFIHKLYNMLEDPNIQHLISWSASAESFVMSPSADFSKVLSQYFKHTNISSFVRQLNMYGFHKERDVFHTGNPDTTLWEFKHGNGNFKRGDLVGLREIKRRASRHALVHRESNYTKPVTSQPGTPAEPVPLPPDSADARLLNIEHTLFDLSNRLQRSEENAHYMHVKNQAAMETMNRLLHFNQELSRTMLSIVPAESPISRDVIALQGEIQRQVDVLRTIEEPPQEPPYTGRQQYFAGVENAPVSPRQLAQDDQRRGPTLNVPSARSQNFYKPPVPSNLSAGTRRQYGSISGGSTTQSSPLRTAPPPPPPAPHPLSNVETVPGPGSLARRHTAADIRAHGWQPTPSPFASGAPSGAWPPSPSRAAPEEQRIRDSLSTYSLQNASQAHPHSRPTTPPPPFVNGLGGGSDTFGGWSWGSAGRENKNLSVKDHSAPTTRRGSMAHILNPSDTAERSDEDEDPRGDDDRKRKRMQ

SEQ ID NO: 19623 - protein, 102 aa, Oryza sativa
MAPKAEKKPVEKKPKAEKRLSESKASSKEGGAGDKKGRKKAKKSVEIYIFKVLKQVHPDIGISSKAMSIMNSFINDIFEKLAQEAAHLARYNKKPIATSREI

SEQ ID NO: 19624 - protein, 282 aa, Geum urbanum
GLPPAMSANGHRVMTVSPRYDQYKDAWDTGVTTELQVGDKIETVRFFHCFKRGVDRVFVDHPLFLERVWGKTASKIYGPVTGEDYKDNQLRFSLLCLAALEAPRVLNLNSNKYFSGPYGEDVVFVANDWHTALLPCYLKAKYQSKGIYMSAKVAFCIHNIAYQGRFASADFSLLNLPGSFKSSFDFIDGSDKPVKGRKINWMKAGMLESNIVLTVSPYYAKELVSSIDKGVELDNIGRKVGVHGIVNGMDVQEWNPLTDKYTDVKYDATTVMDAKPILKEAL

SEQ ID NO: 19625 - protein, 363 aa, Thermobifida fusca
MTETIHEVDVAVIGGGQAGLASGYFLTKRGYRPHRDFVIFDRSPRPGGAWQHVWRSVRLISPPHYTRLPGLPWERPFHGPPSGDEVADYLAHYEQHFQLPVLRPATVHQVTNDGPDPTITRTTPLLITTDQGTWRARAIINATGTWDAPFIPAVPGIGDFRGRQLHAAHYDTPHEFAGHRVIVVGGGHSALQILAELSTVADTLWVTRRPPEFRTTPLTEAELVGITRAVAAHAASGRPLRSVVSYTKLIETPEVAAARERGALNPRPMFHRITPHGVAWNDGTTEHADTILWATGFRPVLAHLAPLRLRSPHGGIALADTHAAIDPRIHLVGYGPSASMISVHRAAATAARVLAASRPQPTT

SEQ ID NO: 19626 - protein, 73 aa, Mycobacterium tuberculosis
MAKKDGAIEVEGRVVEPLPNAMFRIELENGHKVLAHISGKMRQHYIRILPEDRVVVELSPYDLSRGRIVYRYK

SEQ ID NO: 19627 - protein, 750 aa, Coprinopsis cinerea
MAPLSHPTIVDGWFREISPQWQGQAMTLKVNKILHVEKSLYQDVLVFESETYGNVLVLDGVIQATERDEFSYQEMIAHLPLAAHPNPKKVLVIGGGDGGVVREVLKHETVEQVVLCDIDEAVIRVAKIFLPHMSKLLESPRVTVHIGDGFKFLAEHEGTYDVIITDSSDPVGPAEALFEKPYFQLLHDALTPGGHISTQGECMWLHLQLIKDMLKFTKEIFTNVEYAYTMIPTYPSGQIGHILAAKSPGRDLKTPVRDVPNCRYYNKGIHASAFVLPEFVDALLYQDRDIRPVFGRELKALDNKPAKKVLLLGSGFVARPCAEYIVRQPENKLTIACRTLSSAQALAENLPDTTPISLDVTNTAALEAAVAEHDLVISLIPYTYHADVIKAAIKGKTHVVTTSYVSPAMRALDEEAKAAGIVVLNEIGLDPGIDHLYAVKTIDEVHEKGGKIKQFLSYCGGLPAPECSDNPLGYKFSWSSRGVLLALLNSASYISGGQRLDITGTELMAHAKPYYITPAYAFVCYPNRDSVPFKEYYNIPEAETVVRGTLRYQGFPEFIKTLVDIGFLDATPKEWLNDNLTWAEVTQKAVSANDAEEATLVERIKAIAKFPNDSEANRIISGLRWIGLFSKDKVTPRAGNLLDTLCAQLEKLMKYEENERDLVMLQHKFFVEWADGSEQILTSTLEAYGAPGGHSAMALTVGLPCGIAVQLVLDGVITKTGVYAPYTKEICDPIREVLEKEGLGMIERVL

SEQ ID NO: 19628 - protein, 378 aa, Shewanella oneidensis
MSKRDYYEVLGVGRDASEREIKKAYKRLAMKFHPDRNPGDKAAEASFKEVKEAYEILTDANKKAAYDQFGHAGVDPNRGGGGGYGGAGDFGDIFGDVFGDIFGGGRRGGGQRQAARGSDLRYNLELSLEEAVKGLTKELRIPTLASCDVCDGSGAKKGTSATTCTTCHGQGQVQMRQGFFTVQQPCPTCHGRGKIIKDPCAKCHGDGRVEKTKTLSVKIPAGVDTGDRIRLAGEGEAGEFGAPAGDLYVQVSVREHAIFVRDGNNLYCEVPISFSKAALGGEIEVPTLDGKVSLKIPAETQTGRMFRLRGKGVKSVRSHAVGDLLCKVVMETPVNLNERQKELLREFEATLTGESKKHSPKAEGFFDGVKKFFQDLNS

SEQ ID NO: 19629 - protein, 282 aa, Mycobacterium smegmatis
MTVIRAAITQVEWTGDEESMVARHEALARRAAEAGAQIICFQELFHGPYFGIVQDAKYYEYAQAVPGPLTERFSVLAKDLGVVLILPVYEEEMPGVYYNTAAVIDSDGKYLGKYRKNHIPNVDRFWEKFYFKPGNLGYPIFDTAVGKVGVYICYDRHFPEGWREFGLAGAEIVFNPSATKPGLSNRLWELEQPAAAANNQYFVAANNRIGTESEEFGDDAVTFYGSSYFVDPRGNYVGEVASENAEEIVIRDLDLAMVRAVRNDWQFYRDRRPESYETIPAR

SEQ ID NO: 19630 - protein, 222 aa, Populus euphratica
MFQCVEGFITSLLRCCDIDLYKSRGLEDPELLARETVFSVSEIEALYELFKKISSAVIDDGLINKEEFQLALFKTNKKESLFADRVFDLFDTKHNGILGFEEFARALSVFHPNAPIEEKIEFSFQLYDLKQQGFIERQEVKQMVVATLAESGMNLSDDVIGSIIDKTFEEADTKHDGKIDKEEWRSLVLRHPSLLKNMTLQYLKDITTTFPSFVFHSQVDDT

SEQ ID NO: 19631 - protein, 219 aa, Unknown
  Synechococcus sp. WH 6501
NSRLCMSSAVAGYTRSLGSDGPPCSYEDLDHCTVAFLIGTNTAECHPVLFQRLLKRKRKNPGSVKIVVVDPRRTDTAKAADIHLPIAPGSDLALLHGIAHLVLRENGQDPAFIDDHTENYDAFFDVAARWTPRRVALFCNIPEKRLREVAALFHRREKVLSLWSMGVNQRREGTAVVQGLINLHLLTGQIGKQGAGPFSLTGQPNAMGGREAGGLAHLL

SEQ ID NO: 19632 - protein, 185 aa, Xanthomonas oryzae
MLRPYSTQETAMALNDLQHVPGAIAAPAETHGFVFNHTMLRVKDAKQSLDFYTRVLGFRLLDARDFADATFSLYFLALLPEGTAIPDDDAQRRLWMAGIPGVLELTHNHGTDTQDGPVYHDGNSDPRGFGHICVSVPDIHAACARFDSLNVPYQKRLEDGRMKHLAFIKDPDGYWVEIISNTPLA

SEQ ID NO: 19633 - protein, 219 aa, Unknown
  Synechococcus sp. WH 6501
NSRLCMSSAVAGYTRSLGSDGPPCSYEDLDHCTVAFLIGTNTAECHPVLFQRLLKRKRKNPGSVKIVVVDPRRTDTAKAADIHLPIAPGSDLAQLHGIAHLVLRENGQDPAFIDDHTENYDAFFDVAARWTPRRVALFCNIPEKRLREVAALFHRREKVLSLWSMGVNQRREGTAVVQGLINLHLLTGQIGKQGAGPFSLTGQPNAMGGREAGGLAHLL

SEQ ID NO: 19634 - protein, 149 aa, Sesbania rostrata
MGAFTESQEALVTSSYETFKQNASDLSVLFYTFILEKAPGAKNLFSFLKDSDGVPKDNPNLKAHAAKVFELVVDSAVQLRTKGAVVIADANLGPVHVQKGVTDAHFVVVKEALLKTVKEATGAKWSDELSNAWEVAYDELAAAIKKAMG

SEQ ID NO: 19635 - protein, 219 aa, Unknown
  Synechococcus sp. WH 8020
NSRLCMSSAVAGYTRSLGSDGPPCSYEDLDHCTVAFLIGTNTAECHPVLFQRLLERKKRHPGALTIVVVDPRQTDTAKAADIHLAVAPGSDLALLHGIAHLVMRENGQDPAFIDDCTDNYDSFFDVVARWTPRRVALFCGIPEKRLREVAQLFHRREKVLSLWSMGVNQRREGTAVVGGIINLHLLTGQIGKEGSGPFSLTGQPNAMGGREAGGLSRLL

SEQ ID NO: 19636 - protein, 446 aa, Tortula ruralis
MGQGQSGGLPKQGPGGERNKGDGQKKEKKYEPAAPPTRVGRKQRKQKGSEAAARLPVVTPATKCNLRLLKLDRAKDYLLMKEEFVRTQKRLNPQEDKTEKDRSKVDDLRGSPMSVGNLEEIIDENHAIVSSSVGPEYYVNILSFVDKDQPGPGCAILMHNKVLSVVGLLQDDVDPMVSVMKVEKAPLESYADIGGLDPQIQEIKEAVELPLTHPELYEDIGIKPLKGVILYGEPGTGKTLLAKAVANSTSATFLRVVGSELIQKYLGDGPKLVRELFRVADELSPTIVFIDEIDAIGTKRYDAHSGGEREIQRTMLELLNQLDGFDSRGDVKVILATNRIESLDPALLRPGRIDRKIEFPLPDTKTRRRIFQIHTSRMTMADDVNLEEFVMTKDEFSGADIKAICTEAGLLALRERRMKVTHADFKKAKEKVMYKKKEGVPEGLYM

SEQ ID NO: 19637 - protein, 201 aa, Zea mays
  misc_feature (32)..(32): Xaa can be any naturally occurring amino acid
  misc_feature (130)..(130): Xaa can be any naturally occurring amino acid
  misc_feature (151)..(151): Xaa can be any naturally occurring amino acid
  misc_feature (161)..(161): Xaa can be any naturally occurring amino acid
  misc_feature (171)..(171): Xaa can be any naturally occurring amino acid
MPHPGDDQPVKTCTTMSDTDIAAALIESLRAXLILLCDLPGLPQPTCPRGPLCLLLAPSMRKRIRIDAALEATDERRIKEVKPELVEGPDCAMDNAGKDFVDLVCPRGYVYDIMTSSKRFVLLTDAHFLXHYWLAINTAYCAENVECSTTXFLTGHLVYRXSSVGYSVLYXKDYVIIWQPARVIGANCPVFDCDLTNDYLT

SEQ ID NO: 19638 - protein, 219 aa, Unknown
  Synechococcus sp. WH 8020
NSRLCMSSAVAGYTRSLGSDGPPCSYEDLDHCTVAFLIGTNTAECHPVLFQRLLKRKKRHPGALTIVVVDPRQTDTAKAADIHLAVAPGSDLALLHGIAHLVMRENGQDPAFIDDCTDNYDSFFDVVARWTPRRVALFCGIPEKRLREVAQLFHRREKVLSLWSMGVNQRREGTAVVGGIINLHLLTGQIGKEGSGPFSLTGQPNAMGGREAGGLSHLL

SEQ ID NO: 19639 - protein, 341 aa, Streptomyces coelicolor
MRIGVLTSGGDCPGLNAVIRSVVHRAVVDHGDEVIGFRDGWKGLLECDYLKLDLDAVGGILARGGTILGSSRVRPEHLRDGVERARGHVEELGLDAIIPIGGEGTLKAARLLSDNGLPIVGVPKTIDNDIAVTDVTFGFDTAVTVATEALDRLKTTAESHQRVLIVEVMGRHTGWIALHSGMAAGAHAVVVPERPFDIDELTAKVGERFSAGKRFAIVVAAEGAKPKAGTMDFDEGGKDVYGHERFAGIARQLSIELEERLGKEARPVILGHVQRGGTPTAYDRVLATRFGWHAVEAVHRGEFGKMTALRGTDIEMVSLADAVESLKTVPDARYAEAECVL

SEQ ID NO: 19640 - protein, 1292 aa, Oryza sativa
MSGLDLREMLSSAARRHTWRRSGWGAEWGGGDDARSAALPARCPPPPPPRRPAAAGGRGDEGSGGVRGRGEEGTSRGGSGARREDAAGTGRNAVAVVAGGSATSGAERVAARAEDGRRSMDGPTLELSEMMLHAAQPWRSRCTQRDVRPGAVPPRPVAADGRGEGTSTVRGRVLEGTTRGGGRGGGMEREREVVAPARNAVAVAGDLATHGGERVAGPLVAKEKRNGGGELGTKRGLEKRAPLPPPKRRVVSAKRQFPPDFGRDSAVPLGRGRGRGGGVRPSDGAPARAVLGEKVASAGNGDSMANVHHHAVMDTVLMKSSHASDENLVAFKVGSPENGAEGAARGKGAHNGELLGKREVLAQAVNLLPMRRTVSATHRFTAGCGRDAAAPLARREEGKVGSGLEVMPVDVGGGVSKEVMATDGSKHSVNQCTANIVGAVGVLDGTVQYQELEEGEVADEAYCDVESQKVVGCDSFDDSAGERHEGVVPVTFAVTEVLTSHAYDEMMQIKALQEGGSDAAQETEHDLPMGGKCETILPDASPKCSFGGPSNEIVHGKRVLGSHGMKGEVPSLAIEDHGGIAQIDQELEDVEMTTGEYRVQDAQIATHVIPHESTTGRHEGGLCASAAAEDVKVMNKYKGTLPKAAAKSSMNIATGVFGDGIMRSKILSTARKVVKPPVRASHKPPLNTLHRPFSTNSASFGHKKLKVKRPDQSKDIPMKIASTSGLAGKDNLTDEKALSLEDDDILKALVVHDGKLEVYLNVPSCVQLHRQHGSGNADDRSKIRMLCRRFQFICRALLHAVEQGSLKIRRVDLAADKIIRKLPGFTKPGPTVGNVNGVEVGDEFMYRVELALVGLHRPYQGGIDTTDYNGVLVAISIVCSGGYPDELSSSGELIYTGSGGKPAGKKKDEDQKLERGNLALKNCIETKTPVRVIHGFKGQNREDNSHSRAKQILTFTYDGLYLVVDCWTEGLKGSRIFKYKLQRIPGQPELPLHIAKGLRRSLSRPGLCIADISQGKEMDPICVINDVSNVHPTSFQYISRIKYPSWLTKRHPQHHGCDCSDGCIDSTKCFCAVKNGGKIPFNSNGAIVHDKPLIFECGPSCRCHSSCHNRVSQKGMKIHLEVFRTANKGWGVRSLRSISSGSFICEYVGILLTDKEADKRTNDEYLFDISHNCDDEDCSKGRPSTISSLNSSGGCSQTMEDVCFTIDASEYGNIGRFINHSCSPNLYAQNVLWDHDDQRVPHIMFFAAENIPPLQELTYDYNYKIGEVRDLNGRVKVKDCHCGSPQCCGRLY

SEQ ID NO: 19641 - protein, 741 aa, Unknown
  Malus x domestica
  misc_feature (699)..(699): Xaa can be any naturally occurring amino acid
  misc_feature (702)..(702): Xaa can be any naturally occurring amino acid
  misc_feature (728)..(728): Xaa can be any naturally occurring amino acid
  misc_feature (738)..(738): Xaa can be any naturally occurring amino acid
MEACNCIEPQWPADELLMKYQYISDFFIALAYFSIPLELIYFVKKSAVFPYRWVLVQFGAFIVLCGATHLINLWTFNMHSRTVAIVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLRQQNPVGYTVPIHLPVVNQVFSSNCAVKISPNSPVARLRQLAGKHIPGEVVAVRVPLLHLSNFQINDWPELSTKRYALMVLMLPSDSARQWHVHELELVEVVADQVAVALSHAAILEESMRARDLLMEQNIALDLARREAETAIRARNDFLAVMNHEMRTPMHAIIALSSLLQETELTPEQRLMVETILKSSNLLATLINDVLDLSRLEDGSLQLDIATFNLHSIFREVHNLIKPVASVKKLSVALNIATDLPVYAIGDEKRLMQIILNVVGNAVKFSKEGSISITAYVAKSESLRDFRAPDFFPVQSDNHFYLRVQVKDSGLGINPQDIPNLFTKFAQTQTSASQNSGGSGLGLAICKRFVNLMEGHIWIESEGLGKGCTATFIVKLGFPERSNEFKQPFAPKLQANHVQTNFPGLKVLVMDDNGVSRSVTKGLLVHLGCDVTTVSNLDEFLHVISQEHKVVFVDVCMPGIDGYELAVRIHEKFAKRHERPVLVALTGSIXKMXKENCMRVGMDGVILKPVSVDKMRSVXSELLEHRVLXEAM

SEQ ID NO: 19642 - protein, 472 aa, Candida albicans
MSLSPKLEEIVSSIEKSFEIKDDFLVKATEYFIESMNVGLESPKPSKDVMPMIPTYVTSIPTGKEVGLYLAADLGGTNFRVCSIDLKGDHTFSMKQSKYRIPVDLMKAEKSNDLFGFLAKKVQSFLLENHSEACTAKNTEPLKLGFTFSFPVNQTALNRGTLIRWTKGFDIPDTVDRDVVELLQANLTILEVNVKVVAIANDTVGTLLTAAYSNDSAKTNRNTIIGCIFGTGTNGAYFESKIPKLSSSTGKSQGMVINTEWGSFDNGLKILPSTEFDEIVDSETANPGYHLFEKRISGMFLGEILRVALIHLFKKGLIFQELYKARGGSLPHRIEEPWLLDAEVLSYLQIDDSTDLKTSGLILQNVLRLETNKEEREVIQRLTRAISQRAAHLSAIPIAAIAKKVKDQYKDDDRDFEVGCDGSVIEFYPGFRQAVLESIEKINPLKGTNKKIHLKIAKDGSGVGAALCASTA

SEQ ID NO: 19643 - protein, 713 aa, Burkholderia thailandensis
MSLFNKIVKEFQWGQHKVRLETGEIARQASGAVLVDVEDTVVLATVVGAKSAKPGQDFFPLTVDYIEKTYSAGKIPGGFFRREGRPSEHETLTSRLIDRPLRPLFPEGFYNEVQVVIHVLSVNPEVPADIPALIGASAALAVSGLPFNGPVGAARVAYVNNEYVLNPTREQIKASRLDLVVAGTERAVLMVESEADQLPEDVMLGAVVFGHEQMQTAIDAIHELVREGGKPEWDWQPAPKDEALNARVTELAQPELLAAYQIRDKQARSTKLKEVYAATSAKLEEEALAAGTVAADKATVGNILFDLEAKIVRGQILSGEPRIDGRDTRTVRPIEIRTGVLPRTHGSALFTRGETQALVVATLGTKGDEQIIDALEGEYRDRFMLHYNMPPFATGETGRVGSPKRREIGHGRLAKRALVACLPSADEFGYSIRVVSEITESNGSSSMASVCGGCLALMDAGVPMKAHVAGIAMGLILEGNKFAVLTDILGDEDHLGDMDFKVAGTAEGVTALQMDIKIQGITKEIMQVALAQAKEGRMHILGKMKEAVAGANTQLSEFAPRMITIKINPEKIRDVIGKGGSVIRALTEETGTTIDISDDGVVTIASTNSEGMAEAKKRIENITAEIEVGQVYEGTVLKLLDFGAIVNLLPGKDGLLHISEIVNERVKDINDYLKEGQQVKVKVIQTDEKGRVRLSAKALLNEAAGQTDTPPQQ

SEQ ID NO: 19644 - protein, 517 aa, Ipomoea batatas
MEFCATLKSSAHLPRETEFFGGRIRGSLNNNVLLSQSRKSLRLDGNKRKIKPGVAFSVLTRENGTETLTVEAPILERRRANPKNVAAIILPGGAGTHLFPLTNRAATPAVPLGGCYRLIDIPMSNCINSGVNKIFVLTQFNSASLNRHISRTVFGNGVSFGDGFVEVLAATQTQGETGMKWFQGTADAVRQFSWVFEDAKNKDIDNIVILSGDQLYRMDYMDLVQNHIERNSDITLSCATVGDSRASDFGLVKIDRRGRVVQFCEKPKGTEHKAMQVDTTLLGLPRQDARLNPYIACMGVYVFKTDVLLRLLRWRYPTSNDFGSEILPAAVMEHNVQAYIFRDYWEDIGTIKSFYDANLALTEEFPKFEFYDPKTPFYTSPRFLPPTKIDNCKIKDAIISHGCFLRECTVEHSIIGERSRLDCGVELKDTLMMGADTYETESEIASLLADGKVPIGVGENTKIRNAIIDKNVRIGKHVVITNKDGVQESDRPDEGFYIRSGITIIMEKATIRDGTVV

SEQ ID NO: 19645 - protein, 603 aa, Aspergillus nidulans
MFTAASASHIRVIVKDDTLGLGARSKRDLLDEPTGLDAFKGLLGRLNGKTDVELQADQRKRDDVKLARYAATKWQAVRFISGGLLAQEKDESKETAECTLKSGAKNANPVDNNCADDKTCATDLSQDSKSKNRRAKDDEKSEKEKERKDGKDKKDKKDKKDKKDKKDKMDKKDKKDKKDKKDKKDTNDKKDTNDKNDKKRKRAEQQEDSDNPVPGPSHAVKEHRPPGRHMIRGRHIAQKRKALMDDKSLNETFMDTEKVAQHSVTEADSAGDYSSQTARKSHLRGNEVLGRVTGNAVNGLSETSNNASGSIRGIESGTSNQQSKGYEKYGSDFLRSLPIWSLYASYFPARLHRSAPLLPTRKYVFGYHPHGIISLGAFAAFCTEALRFSKLFPGITNTLLTLDSNFRIPFYREYALSMGLASVSRESCENLLSKGGIDGEGMGRAITIVIGGARESLNASPGSLRLVLKRRMGFIKLAIRTGADLVPVLAFGENDLYEQVRSDSHPLIHKFQMLVKQTLGFTIPLFHARGVFNYDVGLMPYRRPLNIVVGRPIHVVQQQDRNKINDDYIDQLHSEYVRELERLWEEWKDVYAKDRVSEIEIVA

SEQ ID NO: 19646 - protein, 197 aa, Unknown
  Marinobacter sp. ELB17
MAERKARVERNTLETQISVEVNLDGTGKTNFQTGVPFLDHMMDQIARHGMVDLDVVCDGDLHIDDHHTVEDVGITMGQAFAKAVGDKKGIRRYGHAYVPLDEALSRVVLDLSGRPGLHMDVPFTRATVGGFDVDLFAEFFQGFVNHALITLHIDNLKGKNTHHQIETVFKAFGRALRMAIELDDRMAGIMPSTKGTL

SEQ ID NO: 19647 - protein, 425 aa, Oryza sativa
MAAAAAATFLPHTPTPRRRLAVAVHSPTRRRLSLVFSGPPDGALSVAAAEEKADAGEEAAAAVSAPRGGGGGGGKERRRVVRKAWEKLVRWSRSWRRRNRSDVVETTRKVVVLGGGSFGTAMAAQVAAKKADLEVSMLLRDDLVCRSINHSHINCKYLRDHRLPENITATTSASDALAGADFCFHAVPVQFSSSFLEGISTHVDPKLPFISLSKGLELNTLRTMSQIIPQALGNPRQPFIVLSGPSFAIELMNKLPTGRNLIVIKLYMAAMVVASKDKKLAAAVQQLLASPNLRISTSNDVTGVEIAGALKNVLAIAAGIVEGMHLGNNCMAALVAQGCSEIRWLATKVAEGVSTAGAVIALAQKYHVKMPVLTAVARIIDNELTPKKAVMELMNLPQVQYLSENILFIQRKLAHGELENIEINE

SEQ ID NO: 19648 - protein, 410 aa, Bordetella bronchiseptica
MEQQHTIVIIGAGQAGGWAARTLRAEGYAGRVLLCGDETAPPYERPPLSKEQLAAQAPALPSLMDAAQLAELHIDWLGGAAATRIDRAGRRVLLGDGQALRYDALILCTGGRPRLPPLPGADLPCVHTLRTIDDAARLRAAFDGAPRVAVLGGGWIGLEVAAAARQRGCAVVLLEAADRLCARSGPGLLSETLARLHAGQGVDLRLNARVQRIDAHGRGCRLALADGQGIEADIVVAGVGLVRNDELARQAGLACDHGVIVDGACRTSDPDIYAAGDVAVMARPDGKLAGLESWQNAQDQGIAAARAALGQAVRYAPLPFFWSQQYDTLVQMAGASEPGAALVLRQGGPAQLLCVEMRADGRAAAVLGVNAAREFRQLRKYIAEGARLDARRLADPRSPLAGAVLGEAAA

SEQ ID NO: 19649 - protein, 341 aa, Williopsis saturnus
SGVAKFAKYPLTFGPSPISNLNRLSQHLGSKVNVYAKREDCNSGLAFGGNKLRKLEYIVPDIVEGDYTHLVSIGGRQSNQTRMVAALAAKLGKKCVLIQEDWVPIPEAEKDVYNRVGNIELSRIMGADVRVIEDGFDIGMRKSFANALQELEDAGHKPYPIPAGCSEHKYGGLGFVGFADEVINQEVELGIKFDKIVVCCVTGSTTAGILAGMAQYGRQDDVIAIDASFTSEKTKEQTLRIANNTAKLIGVEHEFKDFTLDTRFAYPCYGVPNEGTIEAIRTCAEQEGVLTDPVYEGKSMQGLIALIKEDYFKPGANVLYVHLGGAPALSAYSSFFPTKTA

SEQ ID NO: 19650 - protein, 144 aa, Unknown
  Oceanobacter sp. RED65
MFYFKCLLVPVLIIFLMACSTLPNSNEDSLYERIGGLPTIEKLVDAFIKNIARDEQVLPYFRKSDVTHFRNGFIAHFCTVVDGPCEYKGDSMVDIHTGMDINEADFNRTVELLVDAMEKVGISYRQQNEILARLASLRKDIIHL

SEQ ID NO: 19651 - protein, 355 aa, Oryza sativa
METTGGGGSPKEAVVPSAASGDTTLGRHLAHRLVQVGVSNVFAMPGDLNLTLLDHLIAEPGLHIVGCCNELNAGYAADGYAWARGVGACTVTFTVRGQLLHGRRRRSHRFWNQVTGDEAGAAFRNQECAGAAPSLPSAVARRSGSVVVDGGSASPSSPPSPSSETTASWDRHAVCSEPVALTNLNFKQEGNNVESAAAGCPEEPGHGCLVTVTTTRGRRATTSAATAADARGRALLASWRRGRRVMSARPPLLVGLWLVSSPYGDVDLLVETPTPAGPWHAARGEVKLSIAFAAAAPSLVSKYAPPRCHPSRMWGHLAIANRPSSRPCVRVRREVATTGTTGMEARVAPHTLSAA

SEQ ID NO: 19652 - protein, 622 aa, Zea mays
MGAPLASWPWASLGSYKYLLYGPLVAKVAHAWRETGSLPLGSWCLHLLLLLALRSLTFQLWFSYGNMLFFTRRRRVVKDGVDFRQIDAEWDWDNMVILQTLVAAVAMGSAAFPAVSELRAWDPRGWALALLLHVAVSEPVFYWTHRALHRGPLFSQYHARHHSSPVTQPFTAGFGTPLEALLLTLAMGAPLAGAFLAGAGSVSLVYGHVLLFDCLRCMGYSNVEVISHRAFAAFPPLRYLVYTATYLSLHHREKDCNFCLFMPLYDALGGTLSSRSWGLQREVDQGMNDRVPDFVFLAHVVDVVSSMHVPFAFRSCSSLPWAMRPVLLPLWPVAFAFMLLQWFFSKTFTVSFYFLRGRLHQTWSVPRYGFQYFIPSAKKGINRQIELAILRADKMGVKVISLAALNKNEALNGGGTLFVNKHPNLRVRVVHGNTLTAAVILNEIPSSVREVFLTGATSKLGRAIALYLCRKRIRVLMLTLSTERFLKIQREAPPEFQQYIVQVTKYQAAQGCKTWIVGKWLSPREQRWAPPGTHFHQFVVPPIIGFRRDCTYGKLAAMRLPKDVEGLGSCEYTMERGVVHACHAGGVVHCLEGWEHHEVGALEVDRIDVVWEAALKHGLTPA

SEQ ID NO: 19653 - protein, 184 aa, Unknown
  Magnetococcus sp. MC-1
MASHPRDVTPAPLITEAKIQRRVQALAKEIIARMGQEPVMVALLKGSFLFAADLLREMGRQGAKPKLDFLAVSSYGSGTQSTGQVQVQLAIKEPLQGRDVLLVDDILDTGNTFAHVIELLKAQGAQQVLTCTLLNKQARRQQPVVADFIGFEVPDAFVVGYGIDWDNHFRELPYVGVIPPEAYR

SEQ ID NO: 19654 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQTYCYPRSKSKENLQ

SEQ ID NO: 19655 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQSSRCFRSTDNAVLQ

SEQ ID NO: 19656 - protein, 748 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQYFISIRSKIAG

SEQ ID NO: 19657 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQGIASNRSINNKGLQ

SEQ ID NO: 19658 - protein, 499 aa, Unknown
  Synechocystis sp. PCC 6803
MRILILNPPHPAIGSRIPKEQLPPLGLLSIGGPLLDAGHDVTLLDAEFGPLTDSEIVERVCAHCPQLLLIGHSGSTSAHPIVCRLTLFLRERLPNLIIVYGGVFPTYHFHDILTKEPQIDFIVRGEGEATVAKLIAALENHNDLNKVDGIAFRRDEQIIETLPAPMIQDLDVYRVGWELVDLKKYSYYGGKQAVVIQFSRGCPHLCNYCGQRGFWARWRHRDPKKFAQEIVWLHRTHGVQLFNLADENPTVNKAIWQEFCEAIIAENISITIIGSTRADDIVRDADILHLYRRAGVERFLLGMENTNEATLKHIRKGSKTSTDREAIRLLRQHNILSLATWVTDFEEVRDRDFIQALKQLLYYDPDQIMSLYVTPHRWTSFYGIASERRVIQLDQTKWDYKHQVLAATHMPPWRIFLWVKLIEILLQTRPKALWRLLFQPNKASRRGMYWFTLMGRRVLVHELINFFFGDRRVKNGPTLQEFWGMPQEHQEIPLSITRK

SEQ ID NO: 19659 - protein, 292 aa, Colwellia psychrerythraea
MNTPSANQPNSLISADNDKISARGKSVLNQGEVALVGSGPGDAELLTIRAMRFIEQAEIAIYDRLVSDEILALLPDNCERFYVGKEQAKHCVPQDKINEILVHEARLGKRVLRLKGGDPFIFGRGGEEAEYMLQHGVSCHICPGITAASGCTTYAGIPLTHRGVAQGCTFITGHIQNNGQLNLPWQSLCCPTQTVVFYMGINTLSKIAEKLVEHGRDINTPAALIRKGTQPEQKTYRGTIGNLAELVEKHNITPPTLIVIGDVVNQLTEQQLKTPGFLDANDYVQPQAIKIA

SEQ ID NO: 19660 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQHVDYVRSGRVSALQ

SEQ ID NO: 19661 - protein, 152 aa, Geum rivale
GLPPAMSANGHRVMTVSPRYDQYKDAWDTGVTVELQVGDKIETVRFFHCFKRGVDRVFVDHPLFLERVWGKTASKIYGPVTGEDYKDNQLRLSLLCLAALEAPRVLKLNSNKYFSGPYGEDVIFIANDWHTALLPCYLKARYQSKGIYISAK

SEQ ID NO: 19662 - protein, 287 aa, Populus euphratica
MGTLIQGSNATSMSMDSTKKRKRASNKSVAETLQKWKEYNEYLDAQGDEGNKPVRKVPAKGSKKGCMKGKGGPENSVCNYRGVRQRTWGKWVAEIREPDRGPRLWLGTFPTAYEAALAYDNAARTMYGPRARLNIPDVVNSTSSSKDNFSAVTPSYYYSAASSADSVTTSTHSEVCAYEDPNQNVLSHAEDWMTNISSQAEVCEQNASSQTEVYEQNVSSQHVEDCSRGVEKNSKLSQDELKIQPENPSWANDCHDYGWDEIFSVEELLGDIDSGMTGAEGYFSLGF

SEQ ID NO: 19663 - protein, 681 aa, Arabidopsis thaliana
MSGSVSGCGSGGCSIVWFRRDLRVEDNPALAAAVRAGPVIALFVWAPEEEGHYHPGRVSRWWLKNSLAQLDSSLRSLGTCLITKRSTDSVASLLDVVKSTGASQIFFNHLYDPLSLVRDHRAKDVLTAQGIAVRSFNADLLYQPWEVTDELGRPFSMFAAFWERCLSMPYDPESPLLPPKKIISGDVSKCVADPLVFEDDSEKGSNALLARAWSPGWSNGDKALTTFINGPLLEYSKNRRKADSATTSFLSPHLHFGEVSVRKVFHLVRIKQVAWANEGNEAGEESVNLFLKSIGLREYSRYISFNHPYSHERPLLGHLKFFPWAVDENYFKAWRQGRTGYPLVDAGMRELWATGWLHDRIRVVVSSFFVKVLQLPWRWGMKYFWDTLLDADLESDALGWQYITGTLPDSREFDRIDNPQFEGYKFDPNGEYVRRWLPELSRLPTDWIHHPWNAPESVLQAAGIELGSNYPLPIVGLDEAKARLHEALSQMWQLEAASRAAIENGSEEGLGDSAEVEEAPIEFPRDITMEETEPTRLNPNRRYEDQMVPSITSSLIRPEEDEESSLNLRNSVGDSRAEVPRNMVNTNQAQQRRAEPASNQVTAMIPEFNIRIVAESTEDSTAESSSSGRRERSGGIVPEWSPGYSEQFPSEENRIGGGSTTSSYLQNHHEILNWRRLSQTG

SEQ ID NO: 19664 - protein, 286 aa, Brassica napus
MCGILAVLGCVDNSQATRSRIIKLSRRLRHRGPDWSGLHCYEDCYLAHERLAIIDPISGDQPLYSEDKTVVVTVNGEIYNHKALRESESLKSHKYHTGSDCEVLAHLYEEHGEEFINMLDGMFAFVLLDTKDKSYIAVRDAIGVIPLYIGWGLDGSVWFASEMKALSDDCEQFMAFPPGHIYSSKQGGLRRWYNPPWFSELVPSTPYDPLVLRDTFEKAVIKRLMTDVPFGVLLSGGLDSSLVASVAIRHLEKSDARQWGSKLHTFCIGLKGSPDLKAGKEVADYL

SEQ ID NO: 19665 - protein, 414 aa, Unknown
  Candidatus Blochmannia floridanus
MVYDIMDYDIELWDIVKKEINRQERHIDLVASENYISIQAMKAQGSQLTNKYAEGYPGKRYYGGCKYVDLIEQLAIDRAKVLFTAEYVNVQPHSGSQANFSVFNALLDPGDTILGMHLYHGGHLTHGSKVNFSGKLYKTIFYGVDKFGCIDYEQLCFLTERYRPKMIIGGFSAYSGIVDWARMRRIADSVGAYFFVDMAHIAGLVAAGVYPNPIPYAHVVTATTHKTLAGPRGGIILSNGDNDIEFYRKLDASVFPGSQGGPLMHVIAAKAVAFKEAMHVDFKRYQKQVIINSQKMAKEFLNNGFTVVSGIPYNHLFILDLTNHYITGKDASLVLERANIIVNKNCIPNDSHSPFITSGIRIGTAAVTRRGFNDNDVQEVARWICNILNDISNEKIILNAKKNVLDICYRHPVY

SEQ ID NO: 19666 - protein, 219 aa, Unknown
  Synechococcus sp. WH 8020
NSRLCMSSAVAGYTRSLGSDGPPCSYEDLDHCTVAFLIGTNTAECHPVLFQRLLKRKKRHPGVLTIVVVDPRQTDTAKAADIHLAVAPGSDLALLHGIAHLVMRENGQDPAFIDDCTDNYDSFFDVVARWTPRRVALFCGIPEKRLREVAQLFHRREKVLSLWSMGVNQRREGTAVVGGIINLHLLTGQIGKEGSGPFSLTGQPNAMGGREAGGLSHLL

SEQ ID NO: 19667 - protein, 301 aa, Bacillus anthracis
MMKRARIIYNPTSGRELFKKSLPEVLQKLEQAGYEASCHATTGPGDATVAARQAADRKFDVVIAAGGDGTLNEVVNGLVGHEHRPKFGIIPVGTTNDFARAIGVPRSIEEAADIICEGKTVPLDLGRANDTYFINIAGGGRITELTYEVPSKLKTVLGQLAYYLKGIEMLPSLHPTYVEIEYDGKLLQEEITMFLITNTRSVGGFEKVAPYASINDGLFDLLVLKKGSIADLIKAATQAQRGEHINNPKVLYTQANRIKVHSPDKLMINLDGEYGGDAPMEFENIYHCLELFVPEHQEDAL

SEQ ID NO: 19668 - protein, 329 aa, Medicago truncatula
MSIIFLLVGILSIGLQFTAVESIGVCYGMIGNNLPSRQDVVNLYKSRGINQMRIFFPDEPALQALRGSNIELILDVAKETLPSLRNANEATNWVNKYVRPYAQNVKIKYISVGNEIKPNDNEAQYILPAMQNIQNAISSANLQGQIKVSTAIDMTLIGKSFPPNDGVFSDQAKPYIQPIINFLNNNGAPLLANVYPYFAYIGDKVNIPLDYALFRQQGNNAVGYQNLFDAQLDSVYAALEKVGASGVKIVVSESGWPSAAGDSASTDNAATYYRNLINHVKNGTPKRPGAIETYLFAMFDENQKTGAATEQHFGLFNPDKSPKYQISFN

SEQ ID NO: 19669 - protein, 219 aa, Unknown
  Synechococcus sp. WH 8008
NSRLCMSSAVAGYTRSLGSDGPPCCYEDLDHCSVAFLIGTNTADCHPVLFQRLLKRKKRDPKGLTIVVIDPRCTDTAKIADYHLALAPGTDLALLHGLARLVLQDNGFDSDFIDSATEGFAAFTQTIKAWTPGKTSKFCGIAEKGLRSVARLWSRKEGILSLWSMGVNQRREGTAVVGGLINLHLLTGEIGKAGAGPFSLTGQPNAMGGREAGGLAHLL

SEQ ID NO: 19670 - protein, 313 aa, Medicago truncatula
MFAVESIGVCYGMIGNNLPSRQDVVNLYRSRGINQMRLYFPDEQALQALRGSNIELILDVARETLNSLRNANEATNWVNRYVKPYARDVKIKYITVGNEIKPYDSEAQSILPAMQNIQNAISAANLQGQIKVSIAIDMTLIGNSYPPNNGVFTDQAKPYIQPIINFLKNNGAPLLANVYPYFAYINNKQSISLDYALFRQQGNNQVGYRNLFDAQLDSVYAALEKVGASGVKIVVSESGWPSAGGDSASTDNAATYYRNLINHVRNGTPKRPGAIETYLFAMFDENQKTGAATEQHFGLFNPNRTPKYQISFN

SEQ ID NO: 19671 - protein, 354 aa, Candida albicans
MTPPTMLQTAPVESFNLNPKSTQQAINLKSDAKNGKVSFADWNEFKFAPIRESTVSRAMTRRYFADLDKFAESDIVIIGAGSAGLSAAYTLGKNRPDLKIAIIEASVSPGGGCWLGGQLFSAMVLRKPAHLFLDDMGLDYEDEGDYVVVKHAALFMSTLMSKVLQFPNIKLFNATAVEDLITRKDPATNLQRIAGVVVNWAQLDHDTQSCMDPNTINCNVVLSTSGHDGPFGAFTAKRLEQLGRAPRDVTAGFTKPSITTSKLQEPEPISNFQLGGMKGLDMNKAEDAIVKGTREVVPGLVIAGMELAEVDGSNRMGPTFGAMALSGVKAAESVLNVLELRKQQNEACYGATKG

SEQ ID NO: 19672 - protein, 215 aa, Hordeum vulgare
MSYAYLFKYIIIGDTGVGKSCLLLQFTDKRFQPVHDLTIGVEFGARMITIDNKPIKLQIWDTAGQESFRSITRSYYRGAAGALLVYDITRRETFNHLASWLEDARQHANANMTVMLIGNKCDLSHRRAVSYEEVEQFAKEHGLVFMEASAKTAQNVEEAFIKTAGTIYKKIQDGVFDVSNESYGIKVGYAVPNASGGGAGLVLSNQGRLLAIKQV

SEQ ID NO: 19673 - protein, 146 aa, Legionella pneumophila
MKYLHTMVRVSNLEQSLDFYCNKLGLIEVKRTENAKGRFTLVFLAAPADIEQVQTSYGPMLELTYNWDPEDYTEGRNFGHLAYHVDDIYKICQHLQECGVVINRPPRDGHMAFIRSPDNISIELLQKGGPLPKQEPWLSAPNIGHW

SEQ ID NO: 19674 - protein, 219 aa, Unknown
  Synechococcus sp. WH 8008
NSRLCMSSAVAGYTRSLGSDGPPCCYEDLDHCSVAFLIGTNTADCHPVLFQRLLKRKKRDPKGLTIVVIDPRCTDTAKIADYHLALAPGTDLALLHGLARLVLQDNGFDSDFIDSATEGFAAFTQTIKAWTPGKTSKFCGIAEKDLRSVARLWSRKEGILSLWSTGVNQRREGTAVVGGLINLHLLTGEIGKAGAGPFSLTGQPNAMGGREAGGLAHLL

SEQ ID NO: 19675 - protein, 329 aa, Medicago truncatula
MSIIFLLVGILSIGLKFTVVQSVGVCYGVLGNNLPSSQEVVDLYKSNGIDKMRIYFPDEQALQALKGSNIELILDVAKETLSSLTDGNEATNWVQKYVTPYAQDVKIKYITVGNEIKPNDNEAQYIATAMQNIQNAISSANLQGQIKVSTAIDMTLIGTSYPPNDGAFTDQAKQYLQPIIDFLKNNGAPLLANVYPYFAYIGNKQSISLDYALFKQQGNNDVGYQNLFDAQLDSVYAALEKVGGTDVKIVVSESGWPSDGGDSASTDNASTYYQNLINHVKNGTPKRPGAIETYLFAMFDENQKTGAATEQHFGLFNPDKSSKYQTSFN

SEQ ID NO: 19676 - protein, 438 aa, Arabidopsis thaliana
MANYISSVLKSLLLLLHLVFLIQQHVDSASIVKFLPGFEGSLPFELETGYIGIGEEEEVQLFYYFIKSERNPKEDPLLLWLSGGPGCSSISGLLFENGPLAMKLDVYNGTLPSLVPTTYSWTKTSSMIFLDQPVGTGFSYSRTQQYNKPSDSGEAKRIHEFLQKWLSKHQEFSSNPFYVAGDSYSGMVVPATVQEISKGNYQCCSPPINLQGYVLGNPITEHAIDYNYRIPFAHGMALISDELYESLKRVCKGEYVDPRDTECLKLVEEFSKCTKGVCQEVVIKPLCVTETPNCYIYRYLLTTYWVNDVNVRKALQINKESIGEWVRCYFGIPYTHDIKSSVPYHMNNSINGYRSLIYSGDHDLNVPFLATQAWVRSLNYSIIDNWRPWMIKDQIGGYTKTYANKMTFATVRASGHTAEYKPYETYIMFHRWINGQPL

SEQ ID NO: 19677 - protein, 297 aa, Rhodopseudomonas palustris
MSTSPEHKRTALVTGANSGLGKAIVTALAADGLRVGLVARDRGRGEAALADVRAATGNQDLHLFVADLADQESIRALAQDVRARFDRLHLLINNAGTAFPERRLSPQGIERAFAINHLGPFLLTNLLLDLIKASAPARIVNVGTRIDAAIDFDDLNWDKRPYGMMKGYAQSKLGNLHFTFELARRLEGSGVTVNCVFPGVFKSNLGGTDGAQGLFWKLLAKLGGWAIPKPESAAQRVLYLANAPELESVSGQYYANRKTIPAPAQALDAEANRRLWEISERMTGLTQSQTVGDQAAT

SEQ ID NO: 19678 - protein, 375 aa, Zymomonas mobilis
MSELDYYSLLEVERTADDKTIKTSYRRLAMRYHPDRNPGDSDAEERFKAISEAYDCLKDPQKRAAYDRYGKDAFQGGGGFGGFGGGAQDFGGFSDIFESVFGEFMGGRGQARSSVQRGADLRYDLKISLEEAFKGKTVDIEIDVASVCDACHGSGAKAGSGRKTCDTCHGSGRIRVQQGFFVVEQSCPVCQGKGEVISDPCPECHGEGRCEKHKTLSVNIPAGVDDGTRIRLSGEGEAGVHGGPAGDLYIFIHVTPHQVFQRESYNLFAHVPISFTKAALGGSIHVPSLDGEQYEISIPAGIQSGKQLKRRGAGMPVLNGRGRGDLIIQIDVETPTRLTAKQRELLEQFRETETGEECPKSSGFFSKLKTILTGE

SEQ ID NO: 19679 - protein, 543 aa, Ostreococcus tauri
MHTALTIARRCARRAVTSGRHLGRPYAAVPQGASGVNSNADAYAAIRAVNANVTVRSRRGLTIVPRRSPRSQWPEMINKPLEEIDPEMCEIIEHEKARQWKGLELIPSENFVSRSVMDAVGSIMTNKYSEGYPGARYYGGNEFIDMAETLCQERALKAFGLDPAKWGVNVQSLSGSPANFQVYTALLQPHDKIMALDLPHGGHLSHGYQTDTKKISATSIFFTSVPYRLNEETGFIDYEMCEKTATLVRPKLIVAGASAYAQLYDYKKMRDICDKTNSILLADMAHISGLVAAGVVPSPFEYADVVTTTTHKSLRGPRGAMIFYRKGEKGKDKKGNAIMYDYEDKINFAVFPGLQGGPHNHTITGLAVALKQAASPEFKAYQLQVLSNMQACAKRLQEHGVKLVSGGTVNHLALLDLRPMGVDGSRVERVLELAHIACNKNTVPGDVSAMVPGGLRIGTPALTSRGFLEKDFETVADLIVRGIHITKTINDSAKGTKLKDFREALASKEWPELTQLTKDVENLATRFPTIGFEKAEGKYTQGL

SEQ ID NO: 19680 - protein, 494 aa, Gibberella zeae
MGIFKTAILLAGASLNVLASQFPLNDADSPLASTFQVHQSSLSPEHSIRIKEQVDDSICDARVKQYTGWLDIGNQHLFFWYFESKNAPATDPLVLWLTGGPGGSSMLGLLQELGPCLINEHGNGTVHNPYGWNANANYIFVDQPAGVGFSYLDKDEPIPGNSFVAADSMHKFMQLFTTEVFPDLANRPFHISGESYGGHYIPILGATIVAQNNLYPKRPQVNLESVLIGNGYVSPLDTAFGYWETLCTTNPGVSEPIFNSTRCDIMAANLPRCLDLARVCYEHPDHAICSAASEVCWEGVIKWYDGESGSNGGRNRFDISVPCQSDDDLCYKESALIQNYLNLPRVFKALGVPSAVTNYSILSWDVAEAFELGIDTGISTQSQILYLLNHDIDVLMYQGNLDLACNTAGNLKWSNSMEWKGQPAYVAQRPKAWGAWGEEIGWYKEVKIQMGASDKKTTFSFATVDGAGHMVPQGKPKQALELVNRWLKKRTFAG

SEQ ID NO: 19681 - protein, 437 aa, Shigella dysenteriae
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKEQRVAASNVLTGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLP

SEQ ID NO: 19682 - protein, 63 aa, Protea aurea
  misc_feature (30)..(31): Xaa can be any naturally occurring amino acid
  misc_feature (40)..(47): Xaa can be any naturally occurring amino acid
MPGQWEYQVGPSVGIEAGDHIWCSRYLLEXXTEQAGVVLXXXXXXXXGDWNGAGCHTNYSTKS

SEQ ID NO: 19683 - protein, 293 aa, Candida albicans
MGKASKDKRDLYYRRAKEEGWRARSAFKLLQLNEEFNLFKDITRVVDLCAAPGSWSQVLSQKLGPDSTIVAVDLQPMTPIDGVTTIQADITHPKTLQRIRDCFGGEPADFVCSDGAPDVTGLHDLDEYIQSQLILSALQLTTCLLKPGGSFVAKIFRGRDIDLLYSQLSYLFDKVICAKPRSSRGTSLEAFIVCLGYKPRPGWKPTLDLTKSTEEFFEGADIGKQTTTQILEYSEEERKIAPFIACGDINDIDSDATYSLDLSTLTLDPVQKPTAPPYKKALEMKRRGDLHRR

SEQ ID NO: 19684 - protein, 801 aa, Unknown
  Magnetococcus sp. MC-1
MTTISQPLRHTLIVAIIAIVALALLLDRLYEYQVVMAREIENQQLAEMHDSCYVLANDYSRYLLANKQSELRFSVASQGTRISLERLAVSNSEGIVIASSRSSDIDRKIAEIAPLFRLQDAQEARTHNQIVTRLSDDHNSVLGYVPVEMPSPTHSIRAQTRGLLFIHNTLHTLKAASWQNLTSPQSLLRWLVTFFLVTVLLLILLNRVLFRPLEHLEQMATRLAEGDWQATSTLSGKSELAHLGQVLNTMQRHILQERRSLQQSESRFRTLVETSPIPMLVTRAAPNQRVALMNRSFTDLFGYTVADVPDIHHWWPLAYPDPTYRQEIQQLWQARVEEMSLKKTQIMHPVTANVTCNNGNIRFIEVHMSVIDDHALVIFQDLTHRKQESEELRQAKEAAEAANQAKGDFLAVMSHEIRTPMNVMLGMVEVLQESTLDQEQQEQLHSVQKAGKNLLALINQILDLSKLDAGHLQLQPEALNLHELIKEVVGLVAVLASEKNLLLSHQIDTSVPQWILADELRLRQILFNLLGNAIKFTEKGSVNITLSMRDPQQLALVIRDTGIGVDPAHHHAIFEPFTQQDGTITRRFGGTGLGLTLSRRLVELMHGQIRMDSQLGCGTQFEILLPVERTQPPRSDQPQALSLGIIEAHPALAPTDTLCPRLDPALNLLLAEDSPDNQSLIKAYLKRTPHILTIVANGEEAVTAVGNGSYDLLLMDIQMPIMDGYTATRTIRQWEKAEARTPMLIVALTAHALVGDRERSLAEGCDLHLTKPIRKKDLLALLESIAQRLVRQDHQPPAETL

SEQ ID NO: 19685 - protein, 385 aa, Helicobacter hepaticus
METFDYYEILEITRTSDKETIKKAYRKMALKYHPDRNPDDKDAEEQFKRVNEAYEVLSDDSKRQIYDKYGKEGLQNSGFSGFSGRDFSDIFGDLGSIFESAFGANFGFSTQKRGGGKYNLDEIVGLELSFTEAVFGCKKEIHNSFKIACSDCKGTGAKGGKLNTCKDCGGKGQVYMRQGFMTFAQTCPTCKGEGQSASEKCSKCKGSGFEISEESFEVSIPEGIDDGNRIRIGGRGNADKNGSRGDLYIAVSVAEDENFVRDGENVYIEVPVFFTSIVLGTTLKIPSLRGELELKIPPNTRDKEQFVFDNEGIKDVNSAYRGKFVAQIKITYPPKLNAEQRALTEKLQESFGIESEPYKNVFEECFTKVKQWLHKHSKNDKDTTK

SEQ ID NO: 19686 - protein, 511 aa, Unknown
  Pelargonium x hortorum
MYNMSLYLLLGSSALAFAAYLVLFSFSKSRRRLPPGPKAWPIVGNLPHMGSMPHQNLAAMARTYGPLVYLRLGFVDVVVALSASMASQFLKTHDSNFSSRPPNAGAKHIAYNYHDLVFAPYGPRWRLFRKITSIHLFSGKALDDYRHVRQEEVGVLASNLARAVSTIVNLGQLLNICATNALGRAVIGKKVFKDGTDDVDPKADEFKSMVVELMVLAGVFNIGDFIPPLDCLDLQGVASKMKNLHKRFDAFLSAILQEHNINSAASATPSMLTTLISLKDSVEDSEGGKLTDTEIKALLLNMFTAGTDTTSSTVEWAIAELIRQPEILIRAQKEIDSVVGRDRLVTELDLSKLPYLQAIVKETFRLHSSTPLSLPRIATQSCEINGYHIPKGATLLVNVWAIARDPDVWADPLSFRPERFLPGSEKENVDVKGNDFELIPFGAGRRICAGMSLGLRMVQLLTATLLHAFNWDLPQGQIPQELNMDEAYGLTLQRASPLHVRPRPRLPSHLY

SEQ ID NO: 19687 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQFNISSRSVSSGNLQ

SEQ ID NO: 19688 - protein, 95 aa, Brassica napus
MSSRRSSRSSRQSGSSRISDDQISDLVTKLQHLIPELRRRRSDKVSASKVLQETCNYIRNLHREVDDLSDRLSELLASTDDDSAEAAIIRSLLNY

SEQ ID NO: 19689 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQGGNGVRSNIKGILQ

SEQ ID NO: 19690 - protein, 134 aa, Pasteurella multocida
MSDLLKMLTNVRSLRVLARETSLEQLEIALEKFSLVVEEKREAEAKAEREIAERQARIAKLKESLIQEGITAQELAILLGQESQSQRKKREPRPAKYKYIDENGEERTWTGQGRTPKVIQKALDAGKSLSSFEI

SEQ ID NO: 19691 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQFNSSIRSIITKALQ

SEQ ID NO: 19692 - protein, 723 aa, Solibacter usitatus
MGNRPENQMPRTILPGKPYPQGATWDGTGVNVALYSERATRVELNLFDEVDAPASECITLRESSGYVWHGYLPGVKLGQLYGYRVHGPFDPENGDRFNPAKLLIDPYARAIAGSLNWKAPVFGYRLGDPAEDLSLDSEDDAQGVPKSVVTTSHFDWENDRPPLTPLHDTILYEVHVKGFTAQHPGIPEEMRGTYAGLAHPTSVEYLKKLGVTAVELMPVQEFLDDKILVDRGLRNYWGYNSINFFAPAARYCRSGDRGEQIGAFKAMVKALHRAGIEVILDVVYNHTAEGNQMGPTLSFRGVDNATYYRLADNRRYYMDYTGTGNTLNVRHPQVLKLVMDSLRYWVEEMHVDGFRFDLAAALARELHEVDRLSAFFDIINQDPVISQVKLIAEPWDVGEGGYQVGKFPVLWAEWNGRYRDVVRRYWKGDDGQLAELGYRLTGSSDLYQRDGRHPTASINFITAHDGFTLRDLVSYNSKHNEDNGEDNRDGANENYSNNFGTEGDTTDPQILELRARQTRSLLLMLLLSQGVPMICGGDEIGRTQRGNNNSYAQDNEISWYDWKLDTTQQELLEFTTRLVELRRAHPNLHRRKFFQDRGIDPGTPDRDIDGQTEQDVMWLRPDGGEMTPEEWHQGWVRCIGLQLNGRTLDDVNGAGEPIIDDSFMLIFNPHHEPVQFYMPEQGPSWEVLFNSQFAQQTENPVIGPGQSYELIAHSAAILREVKE

SEQ ID NO: 19693 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQGSNYPRSRITKDLQ

SEQ ID NO: 19694 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQPYSFIRSEGSAGLQ

SEQ ID NO: 19695 - protein, 569 aa, Unknown
  Bradyrhizobium sp. BTAi1
MASSISANSYNPSRDDFAAMLDESFTKGNLQESSVVKGKVVAIEKDMAVIDVGLKTEGRVALREFSGPGRDSELKVGDEVEVFLDRIENALGEAVLSRDKARREESWGKLEKAFQNNEKVNGVIFNQVKGGFTVDLDGAVAFLPRSQVDIRPIRDVAPLMNNSQPFQILKMDRRRGNIVVSRRTVLEETRAEQRQELVQNLEEGQVIDGVVKNITDYGAFVDLGGIDGLLHVTDIAWRRVNHPTEVLSIGQTVKVKIIKINHETHRISLGMKQLLDDPWQGIEAKYPLQARFHGRVTNITDYGAFVELEPGIEGLIHVSEMSWTKKNMHPGKIVSTSQEVEVQVLEVDSVKRRISLGLKQTMRNPWEVFVEKHPTGSVVEGEVKNKTEFGLFLGLEGDVDGMVHLSDLDWKLPGEQVIDNYKKGDMVKAVVLDVDVEKERISLGIKQLEGDPFAEPGDVKKGAVVTCEVLDVKDGGIDVKIVGTEFSTFIKRSELARDRNDQRSERFAVGEKVDARVIQFDKKARKVQVSIKALEVAEEKEAIAQYGSSDSGATLGDILGTALKNRDAK

SEQ ID NO: 19696 - protein, 82 aa, Oxalis laxa
INISGTNGEVMPGQWEYQVGPSVGIEAGDHIWASRYILERITEQAGVVLTLDPKPIDGDWNGAGCHTNYSTKSMREEGGFEV

SEQ ID NO: 19697 - protein, 251 aa, Prochlorococcus marinus
MDNKISFIGVGPGDPELLTLKALKKIKIADVIIWTDSLIPEKILDFSKEGSEKIKTSSLNLEQITSIMIEKFQAGKTVVRLHDGDPCLFGAIREQIEILETEKIEIEVVPGVSAFQVAAAYHKAELTIPDVTQTIILTRAGGRTGMPEKESLKDLAKHNSSICLYLSARHVKRSQETLLEFYPPETKVIVGFRVSWDDGWTSLIELKDMEKFSIEKKLIRTTIYIISPAINNSQKRSNLYNPSYKHLFRNK

SEQ ID NO: 19698 - protein, 471 aa, Zymomonas mobilis
MDYLPLFADIRQRPVLVVGGGEVAARKVALLKKAGAIIKIVAKNIHPELQILQENHEIEWLAKSFSPEQLDHVFLVIAATNDSLLNQQIYQAAEQRHRLVNVVDDQQKCSFIFPSIVDRAPITLALSSAGTSPVLVRMLREKLEALLPQSLGKMAEIAGKWRPRIKEKLPAIKDRRLFWEKAFNGLFAHKVASGDWESAEKTLAEQLEKDNPKQGEIILVGAGPGDAGLLTLRGLQALQQADIVLYDYLVSPAVLEMIRRDAQKICVGKRAGHHSVAQEETNRRLIEWAQQGKKVVRLKGGDPFIFGRGGEELQAAKQASIPFQVVPGITAASGAAAYAGIPLTHRDYSQNVVFITGHCQKDGNGLDWATLARPHQTLVIYMGVMNAGKISEALIKHGRKADTPVAIIAHATLPNQQILNGRLDQLESLAKQAETPALLIIGEVGGLQSDLSWFSSKTDKEDTKSSLINLA

SEQ ID NO: 19699 - protein, 243 aa, Triticum aestivum
CAWLEIQSLCTSSDILNNLNLKNHWMKDFFIASAHLELKMHEEALKRYERLMGVFRCSDYIQAQIATVQYSMRDLDEADMIFEELLRTDPFRVDSMDIYSNLLYAKESLTALSFLAHRVFLTDKYRPESCCIIANYYSLKGQHEKSVLYFQRALKLNRKYLSAWTLMGHEFVELKNTPAAIDAYRRAVDINPRDYRAWYGLGQIYEMMGMPFYALYYFRKSSHLQPNDARLWIAMAQCYESDP

SEQ ID NO: 19700 - protein, 325 aa, Sulfolobus solfataricus
MPLKTYDTIIVGAGIAGLSAALYSSRQKLSTLVLSKDLGGQLTLTDLIENYPGIESTGGLTLAQKIEKQAKKFGAEFIYGEEVKEIAQESDLFIIKGIKGEYAGRALILAFGKTPREINVPGEQEFKGKGVSYCAICDAAFFKGKPAAVIGEGEPGIEAIELLSNYANPAYYITSSSYLAGEEEIVKNVVNKPTVKILTSSRVLEIRGNSKVEELVIKRGDEILQLKVDGVIIEMGYTLKTEFLKGFVELNEKGEIIVDELGRTSREGVFAAGDVTQTPYKQAVVAAAEGVKAALSAYNYIRSKRGLPPVTVDWKAEKKKVSFRL

SEQ ID NO: 19701 - protein, 420 aa, Pyrococcus endeavori
MVEQDPFEIAVKQLERAAQYMKISEEALEFLKRPQRIVEVTIPVEMDDGTVKVFTGFRVQYNWARGPTKGGIRWHPEETLSTVKALAAWMTWKTAVMDLPYGGGKGGIIVDPKKLSDREKERLARGYIRAIYDVISPYEDIPAPHVYTNPQIMAWMMDEYEAISRRKTPAFGIITGKPLSIGGSLGRNEATARGASYTIREARKVLGWGDLKGKTIAIQGYGNAGYYLAKIMSEDYGMKVVAVSDSKGGIYNPDGLNADEVLKWKQEHGSVKDFPGATNITNEELLELEVDVLAPAAIEEVITKKNADNIKAKIVAEVANGPVTPEADEILFEKGILQIPDFLCNAGGVTVSYFEWVQNITGYYWTLEEVREKLDKKMTKAFYDVYNTAKEKNIHMRDADYVVAVQRVYQAMLDRGWVKH

SEQ ID NO: 19702 - protein, 219 aa, Unknown
  Synechococcus sp. WH 8108
NSRLCMSSAVAGYTRSLGSDGPPCSYEDLDHCTVAFLIGTNTAECHPVLFQRLLKRKRKNPGSVKIVVVDPRRTDTAKAADIHLPIAPSSDLALLHGIAHLVLRENGQDPAFIDDHTENYDAFFDVAARWTPRRVALFCNIPEKRLREVAALFHRREKVLSLWSMGVNQRRKGTAVVQGLINLHLLTGQIGKQGAGPFSLTGQPNAMGGREAGGLAHLL

SEQ ID NO: 19703 - protein, 873 aa, Monascus purpureus
MGSLTQVQTEPVTTATHSIGSVQLKVEEDSSMSSPDLAEIIPLPPPSREPSEVLNIDKNTPDGHVPRDPRLLRLTGAHPFNCEPPLTELYSQGFLTPPELHFVRNHGPVPHVQDDDIPDWELSIEGLVERPVVWTFQQILDEFEQITAPVTLVCAGNRRKEQNQVRKTKGFSWGSAGISTSLYTGPLMGDILRRAKPLRRAKYVCMEGADVLPNGHYGTSIKLNWALDFNRGIMLAHKMNGEPLRPDHGRPLRVVVPGQIGGRSVKWLKRLILTDSPSTNWYHINDNRLLPTMVSPEMASEDPKWWRDDRYAIFDLNVNSSVVYPENNEELVIASAPSTYTVKGYAYSGGGRRITRVEISLDKGRSWHLAHIDYAEDKYRNFEGDLFGGKVDMYWRETCFCWSFWSLDIPVSDLQASDAILVRAMDESLAVQPRDMYWSVLGMMNNPWFRVTITNENGRLKFEHPTHPTKTGGWMERVKKAGGDLANGYWGETVQGEAPAQQESAKEINMRREGLSRLIELQELKDHVSNGEPWFIVNGEVYDGTEFLRDHPGGAQSIISSAGMDVSEEFLAIHSETARIMMPGYHIGTLSTSALAVLQDNGLEEQNNSTEPRKTFLQSRYWSKTTLVRKKIVSSDSRIFTFELEHPKQTLGLPVGRHLMIRVPDPTKKNECIIRSYTPISGITQEGTMDILVKVYFDTATQPGGKMTTALDRLPLGSTIDCKGPTGRFEYLGNGNILIGDQERHVKSFRMICGGSGVTPIFQVLRAVMQDPDDPTTCVVLNGNRREEDILCRAELDALVALNNAKCTMIHTLTKAPETWAGHRGRISETLLKEYAMLNDDCMVLVCGPESMERDVQKILLGLGWEESNLHFF

SEQ ID NO: 19704 - protein, 296 aa, Anabaena cylindrica
NSRLCMSSAVSGYIQSFGADGPPCCYDDLELTDCAFLIGTNTAECHPIVFNRLAKYHKKNRHVKMVVVDPRRTPTAEAADLHLAIRPGTDIDLLNGIAHLLMKWNYIDTLFMDECTSNFPTYAEVIRHYSPDVVSRQCGISIEDLETAAKYWGKSKSVLSLWSMGVNQSTEGTAKVRTIINLHLMTGQIGKPGAGPFSLTGQPNAMGGREAGGLAHLLPGYRLVKNDKHRAEVEDFWGLERGRISPVSGLTAWDMITSLESGNVGLLWIAATNPAVSMPDLERTKKALLKSPLTIY

SEQ ID NO: 19705 - protein, 370 aa, Unknown
  Oceanobacter sp. RED65
MSKRDYYEVLGVDRQADAKEIKRAYRKLAMKYHPDRNPDDADADAKFKEASEAYEILGDQEKRAAYDQFGHAGVDGSAGAGAGGFGGGNFSDIFGDVFGDIFGGGGGRRGGPQRGNDLKYNLELSLEEAVKGTEKTIKVPTLVDCEVCDGSGAKAGSKPTVCGTCNGQGQVRMQQGFFAVQQTCPTCQGQGTIIKDPCDSCHGQGVKEETKTLNVKIPPGVDNGDRIRLNGEGEAGAMGGPAGDLYVEAHIKPHSIFERDGRNLYCDVPISIADAALGGEIEVPTLDGRVNLKIPAETQSGKLFRLRGKGVLPVRGGPQGDLLCRVMVETPVNLNDKQKEILREFQASLKGEKHSPRKKTWFDNVKAFFE

SEQ ID NO: 19706 - protein, 57 aa, Brassica napus
  misc_feature (13)..(13): Xaa can be any naturally occurring amino acid
  misc_feature (52)..(54): Xaa can be any naturally occurring amino acid
MGTPESSREPCPXDRILDDIGGAFGMGAVGGSAFHFLKGTYNSPKGSRFLGXXXAVA

SEQ ID NO: 19707 - protein, 413 aa, Unknown
  Rhodococcus sp. RHA1
MTSDIVVIGGGVAGVTAAQSLRSEGYDGRLVLIGKERELPYDRTALSKAVLAGDLADPPLLFPADWYDEWQIETVLDRTVLQVDVTRREVLLDGGPWLKVDRVHLATGASARVPSFSGSDLPGVATLRTADDVHRMRRDWEPGQRLVVVGGGLIGCEVATTARKLGLEVSILEASDELLQRVLGRRIGGWCRARLMELGISVVLNTGVAEFKGVDRITTVIGTDGRSFVADRAIVCVGAEPETAIAEQSGLACNRGILVNDSGGTAAEGVFAAGDVASWPLLTGGRRSLETYINSQREATAVASAMLGKAVHGPQLPLSWTEMAGHRIQMIGDIEGSGEYVMRGDPDDGPALLFRLSDGRVTAAVSVDAPRDFAMATRLVERGAQVGREVLGDTSMELRELNRAARERALIAE

SEQ ID NO: 19708 - protein, 353 aa, Campylobacter coli
MSEKILFIDRDGTIIEEPKSDFQIDSLEKLRFEKGAIPTLLKLKNFGFKFVLVSNQDGLGTQSFPKEDFEIAHQKMLDILQSCGIEFKDIFICPHFENENCECRKPKTALLDEYIKHNLYNKEQSFVIGDRDTDMILASNLGVRGLKYSENLTWKEIEEEILNSFRTASISRITKETNIYVKVCLNGGKIAINTGVPFFDHMLEQIAVHGGIGLEISCKGDLEIDEHHSVEDVALALGSAIKQALGDKIGITRYGFVLPMDECLASCAIDFCNRPHLVYKAKFKKEKLGELSTEMIEHFFYSLSYSMGVSLHLKVKGKNDHHKAEGLFKAFAKALKMAVKIESENLASSKGVI

SEQ ID NO: 19709 - protein, 396 aa, Unknown
  Frankia sp. EAN1pec
MDGRPRGAHPQRLRRPVKPDRLQGLVRQLPEHALRPTLPLRRAGGCRSRPPETAVASARGYMGYMGAGSGAGHTAGSPGDGEIMATSGRITTPFTAESTAAEVVAGIDLGGRRVVVTGASSGIGVETARALAGAGAEVTLAVRDVEAGRWTADDIVAAMGNKEIHVAPLDLADRASVAAFVAGWDGPLHILVNNAGVMATPELRTPEGWELQFATNHLGHFAVASGLRGALAAAGGARVVSVSSSGHLRSPVVFSDIHFRERAYEPWAAYGQSKTANVLFAVEATRRWADDGITVNALMPGAIATRLQRHISTEDLDRLRGQINAPALVWKSVEQGAATSVLLATSPLLDGIGGRYFEDCNEALPNTPGVRGGVAAYALDPEAAARLWDVTVDTLT

SEQ ID NO: 19710 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQNNCDNRSDVVVTLQ

SEQ ID NO: 19711 - protein, 593 aa, Paracoccus versutus
MRMTTEESFVKVLQLHGIEHAFGIIGSAMMPVSDLFPRAGITFWDCAHETNAGMMADGFTRSTGRMSMAIAQNGPGVTGFVTPVKTAYWNHTPLLLVTPQAANRTIGQGGFQEMEQMRIFADCVCYQEEVRDASRIPEVLNRVIMQAWRNSAPAQINIPRDFWTQVIDVELPQVVAFERPAGGEQAVAEAAKLLSGAEFPVILSGAGVVLSGAIPELARLAERLDAPVCSNYQHNDSFPGSHPLAMGPLGYNGSKAAMEIIARADVVLALGTRLNPFSTLPGYGIDYWPKDARIIQVDINADRIGLTKKVTVGIQGDAAKVARGILAQLAPTAGDAGRAERKALVAQTRSRWAQELSSLDHEEDDPGTEWNEDARRRDAGLMSPRQAWRAIMQAVPKEAIVSSDIGNNCAIGNAYPSFEAGRKYLAPGLFGPCGYGFPAILGAKIGNPDVPVIGFAGDGAFGISMNEMTACGREDWPAITMVIFRNYQWGAEKRNTTLWYDNNFVGTELDRDTSYAKIAQACGLVGVQVKSQEELTAALHDAVERQMKNRETTFIEVLLNQELGEPFRRDAMKKPVVVAGIDPADMRPQQGAA

SEQ ID NO: 19712 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQCPHARRSAVEAGLQ

SEQ ID NO: 19713 - protein, 207 aa, Glycine max
  misc_feature (165)..(165): Xaa can be any naturally occurring amino acid
MSSSGQIAPAEQVCYVHCNFCNTVLAVSVPGNSMLNIVTVRCGHCTNLLSVSLRGQMHSPVPPAAQVQESSLSKPNGSNGFIRDHSVYNSPEFGSSSSSSSSKFRMPTMMFSSQNDLLQEQTLHARPPEKRQRVPSAYNRFIKEEIRRIKANNPDISHREAFSTXAAKNWAHYPNIHFGLNPERDGGKRLAVDDAAPAAKKIQGFCS

SEQ ID NO: 19714 - protein, 137 aa, Zea mays
GLWSLDDEDIIKTAVEKPELFVLKPQREGGGNNIYGLDLRETLVRLQKEGGDALAAYILMQRIFPKASPAYLVRGGVCHEGLAISELGIYGAYLRNKDKVVINEQCGYLMRTKVSSSDEGGVAAGFAVLDSLYLTGK

SEQ ID NO: 19715 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQNNSYRRSENDGDLQ

SEQ ID NO: 19716 - protein, 95 aa, Oxalis pachyrrhiza
LYAGINISGTNGEVMPGQWEYQVGPSVGIEAGDHIWASRYILERITEQAGVVLTLDPKPIDGDWNGAGCHTNYSTKSMREEGGFEVIKKAILNLS

SEQ ID NO: 19717 - protein, 752 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQLDSAPDLARLMICSK

SEQ ID NO: 19718 - protein, 300 aa, Campylobacter upsaliensis
MSSIAIIGAGKWGSALYHALNTKNTCLISSPTPREMPHFIPIKEALKCDYLIFALSAQALHTWLKTHFKNQNAKVLIASKGIEAGTGLFLDEIFMEFLDENQICVLSGPSFATEVENHLPTALMINGKNLALCKEFANFFPSFIKTYIDDDVRGAEICGAYKNVLAIASGICDGLKLGNNARASLISRGLIEMRRFGKFFKAKEETFLGLSGAGDLFLTASSMLSRNYRVGLMLAQGKNLREILQTLGEVAEGVETAFAIEKLAKKNQIYTPIVSEVVSILQGESVRNSVEKLLKQKDWI

SEQ ID NO: 19719 - protein, 92 aa, Oxalis megalorrhiza
GINISGTNGEVMPGQWEYQVGPSVGIEAGDHIWASRYILERITEQAGVVLTLDPKPIDGDWNGAGCHTNYSTKSMREEGGFEVIKKAILNLS

SEQ ID NO: 19720 - protein, 392 aa, Propionibacterium acnes
MSNDYYEILGVSHDASADEIKKAYRRKAMKLHPDVAGPGSEEEFKKVQEAYEILQDPQKRAVFDRGGDPNARMGGFGEGGFSSAGFDFTNLVDAMFGGSSPFGSGGGRGPRSRTRRGQDALVRMRLSLAEAVFGVTKSLEVDTAVVCPKCQGKGAQSGSEPVTCDTCQGRGEVITVQRSFLGDIRTSQPCPTCHGYGTVIPDPCQECSGEGRVRTTRTINVKIPAGVADGNRIHLDSRGEVGPGGGPAGDLYIEMTVSPHDVFTRHGDDLEMVVTIPMTAAALGTKVPMHTLEADREDFAEDTKTVTVEVPAGTQSGTRIVVSERGVPRLRRNGRGDLGVTFIVQTPTKLDSHQKDLLRQLAEAREETNASASVEKSGGRGMFSRIKEAFGG

SEQ ID NO: 19721 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQDCSIIRSDVTNKLQ

SEQ ID NO: 19722 - protein, 643 aa, Mycobacterium avium
MCGLLAFVAARAGAVGADDAIARASHLMRHRGPDEPGTWAGADGSVVFGFNRLSIIDIAHSHQPLRWGPPETPDRYELVFNGEIYNYLELRDELAAHHGAVFATDGDGEAIVAGFHHWGTDVLTRLRGMFAFALWDTVTRELFCARDPFGIKPLFVATGTGGTAVASEKKCLLELAELIGFDTAIDERAVQHYTVLQYVPEPETLHRGVRRLESGCYARIRPGAAPDITRYFVPRFAAVPITRDTEQARYDEITAVLEDSVAKHMRADVTVGAFLSGGIDSTAIAALAIRHNPRLITFTTGFEREGFSEIDVAVASAEAIGARHIAKVVHPDEFVAALPEIVWYLDEPVADPALVPLFFVAREARKHVKVVLSGEGADELFGGYTIYREPLSLKPFDYLPRPVRRSMGKVSKPLPDGMRGKSLLHRGSLTLEERYYGNARSFSDAQLRDVLPGFRAEWTHTDVTAALYAQSIGWDPVARMQHIDLFTWLRGDILVKADKMTMANSLELRVPFLDPEVFAVASRLPVEAKITRTTTKYALRRALEPIVPAHVLHRPKLGFPVPIRHWLRAGELLEWAYSMVASSQAGHLVDLGAVRRMLDEHRNGVSDHSRRLWTVLIFMLWHAIFVEHSVVPQIGEPVYPVQL

SEQ ID NO: 19723 - protein, 311 aa, Glycine max
KSIQSFEPNFTVCTSNILEVPIESQFHNQKCKVQFHNLGIWITDYLLPQEVPSQFQFQDMSKNDNNMPMNHTNNNLQMPQITSFSKPPRSSSNLSNRKPSLKNITIPSITSGLATAMSQTTATTTTIATTMYNNNQVSSSSFSSDETNNTKDDKHYRGVRRRPWGKYAAEIRDPNRKGSRVWLGTFDTAIEAAKAYDKAAFKMRGSKAILNFPLEIGSDQSKEESSSSSSSVSSSSIVIKVGVKREREEESERKNNYEKSEFNNNSNSNKHVKKEECPLTPSCWKGFWDTDVMGTIFSVPPLSPLSPLMVV

SEQ ID NO: 19724 - protein, 300 aa, Unknown
  delta proteobacterium MLMS-1
MQIAMIGLGRMGFNMASRLLQGGHQVVVYNRTPAKSEELATQGATAAYSLSELVDKLSSPRVVWLMLPAGETVDQHLDELGELLAPGDLVVEGGNTYFKDDLRRAEKLAGKGIKYLDAGVSGGIWGLKLGYCTMVGGEQGDFERIEPLLKTLAPPEGYLYCGPQGAGHYVKMVHNGIEYAMMQAYGEGFALLEASPYGENLNYSQVSHLWNQGSVIRSWLLELLEPAFAKDPRLTEITGHVDDSGEGRWTVQQAVECGVAAPTIAISLFQRFQSRNPNAFENRVLAAMRREFGGHAVVKS

SEQ ID NO: 19725 - protein, 92 aa, Oxalis spiralis
LYAGINISGTNGEVMPGQWEYQVGPSVGIEAGDHIWASRYILERITEQAGVVLTLDPKPIDGDWNGAGCHTNYSTKSMRDEGGFEVIKKAIL

SEQ ID NO: 19726 - protein, 67 aa, Brassica napus
  misc_feature (49)..(49): Xaa can be any naturally occurring amino acid
MSNRRSRQSSSALRISDDQMIDLVSKLCQLLPEIRERRRSDKVSASKVXHETCNYIRKLHREVDNLS

SEQ ID NO: 19727 - protein, 351 aa, Medicago truncatula
MVFLLLLLVLIGLETTGTAQSLGVCYGRVANNLPSAEEVIDLYKINGIGRMRIYDPDQATLEALRGSNIELVIGVRNEDIQSIAYSVSSATNWVQNNILKYSQDVKFRYIVVGNEINPSNDATSKFVLLAMQNIYTALASSNLQNQIKVSTAIQMNLLGSSYPPSQGVFSPSSISYIIPIVKFLVDNEAPLLANVYTYFSYISDTKDIDLSFALFTSTTIKVHDGQYAYQNLFDATLGALYAALEKIGGANLEVVVSESGWPSDGGVAASIENAQIYHENLIKHVITGTPNRPNQALETYLFAMFDENNKGPDETERHYGLFTPDKQIKYQIAKTCDKKKDKSKLKLLDEE

SEQ ID NO: 19728 - protein, 442 aa, Wolinella succinogenes
MSNIDLAMFCNQCEMSAPMGCGAKGQEKGTCGKDSTLARLQDTMIYGLKGLSAYREHANELGADTKSVDDVMSETLYFTLTNVNFNFNEHIAQLMKVGSAGVQVMELLSDAHAKKFGVPTPVSVSQNRAEGKAILVSGHNMEMLHKLLEATKDRGVNIYTHSEMLPAHGYPELRKYSHLKGNIGKAWFDQGKLFEEWSGAIVVNTNCIVPPRSNCGYLDRLYTYKIVGVEGAKKIENDDFEPLIAQALSLPSVDRFNAETTLVTGHNYRTILTLAPQILEAISAGKIRRFFVIAGCDAPGKGREYYRELAQRLPKDCVILTSSCGKFRFNDIDFGTIEGTQIPRYLDLGQCNDSNGAVKIALALSSALGVPLNDLPVSIVLMWMEQKAIIILLALFSLGVQNIHIGPSAPEFVNEPILNFLVENFNLSLISNVEDDLKKFLG

SEQ ID NO: 19729 - protein, 91 aa, Oxalis spiralis
INISGTNGEVMPGQWEYQVGPSVGIEAGDHIWASRYILERITEQAGVVLTLDPKPIDGDWNGAGCHTNYSTKSMRDEGGFEVIKKAILNLS

SEQ ID NO: 19730 - protein, 454 aa, Neurospora crassa
MSNLPSEPEFEQAYKELAYTLENSSLFQKHPEYRTALTVASIPERVIQFRVVWEDDNGNVQVNRGYRVQFNSALGPYKGGLRLHPSVNLSILKFLGFEQIFKNALYGLSMGGGKGGADFDPKGKSDAEIRRFCCAFMAELHKHIGADTDVPAGDIGVGGREIGYMFGAYRKAANRFEGVLTGKGLSWGGSLIRPEATGYGLVYYVGHMLEYSGAGSYAGKRVALSGSGNVAQYAALKLIELGATVVSLSDSKGALVATGESGITVEDINAVMAIKEARQSLTSFQHAGHLKWIEGARPWLHVGKVDIALPCATQNEVSKEEAEGLLAAGCKFVAEGSNMGCTLEAIEVFENNRKEKKGEAVWYAPGKAANCGGVAVSGLEMAQNSQRLNWTQAEVDEKLKDIMKNAFFNGLNTAKTYVEAAEGELPSLVAGSNIAGFVKVAQAMHDQGDWWSKN

SEQ ID NO: 19731 - protein, 316 aa, Medicago truncatula
MANFKCAVKGGCPTDYVAVTVSILSFILLLIWSIFPFIVHKVPRTKGSGFWIPVIQVVASFNLLLSIMMSHNFFKFEKSHWWQSCYLWAVWGEGPLGFGLLLSSRITQAFQLYFIFVKRRLPLIRSFLLIPLILLPWIIGAAVIHIKKPLSNRCHMSVQWTIPVVCLHALYVATLVGVTAAVHHIEFRFDELRDLWRGILVSSVSVDGKILSKFWGDEDTDATDSTLEPDTDHEAHKSNCQSSLEHDIDTDGTLANLKETHSADQYLLQHSHEDGFIKPGKKGRKKAAKSKTLDGNSTVRVSTRHKKTSVRLKEQA

SEQ ID NO: 19732 - protein, 497 aa, Capsicum annuum
MAHAFNMLILCYTFFLLLDLSHNFAFAFTSQDYSNALEKSILFFEGQRSGKLPANQRVKWRGNSGLSDGSGSHVNLVGGYYDAGDNVKFGLPMAFTTTLLAWSVIEFGSSMHSQLGHAKEAIRWSTDYLLKAATASPDTLYVQVGDPNQDHRCWERPEDMDTPRNVYKVSPQNPGSDVAAETAAALAAASIVFKDSDPSYSSTLLRTAQKVFAFADKYRGSYSDSLSSVVCPFYCSYSGYNDELLWGASWLHRASQDTSYLSYIQSNGQTMGANDDDYSFSWDDKRPGTKIVLSKDFLEKSTQEFQAYKVHSDNYICSLIPGSPSFQAQYTPGGLLFKGSESNLQYVTSSSFLLLTYAKYLRSNGGVVSCGSSRFPANKLVELARKQVDYILGDNPAKISYMVGFGQKYPLRVHHRGSSLPSVRTHPGHIGCNDGFQSLYSGSPNPNVLVGAIVGGPDSRDNFEDDRNNYQQSEPATYINAPLVGALAFLSAESTAV

SEQ ID NO: 19733 - protein, 296 aa, Anabaena cylindrica
NSRLCMSSAVSGYIQSFGADGPPCCYDDLELTDCAFLIGTNTAECHPIVFNRLAKYHKKNRHVKMVVVDPRRTPTAEAADLHLAIRPGTDIDLLNGIAHLLMKWNYIDTLFMDECTSNFPAYAEVIRHYSPDVVSRQCGISIEDLETAAKYWGKSKSVLSLWSMGVNQSTEGTAKVRTIINLHLMTGQIGKPGAGPFSLTGQPNAMGGREAGGLAHLLPGYRLVKNDKHRAEVEDFWGLERGRISPVSGLTAWDMITSLESGNVGLLWIAATNPAVSMPDLERTKKALLKSPLTIY

SEQ ID NO: 19734 - protein, 575 aa, Vitis vinifera
SARAPSVISSSEATLGRHLARRLVQIGVSDVFSVPGDFNLTLLDHLIAEPGLKNIGCCNELNAGYAADGYARSRGVGACVVTFTVGGLSVLNAIAGAYSENLPVICIVGGPNSNDYGTNRILHHTIGLPDFSQEFRCFQTVTCYQAVVNNLEDAHEQIDTAISTALKESKPVYISISCNLPGIPHPTFSREPVPFCLAPKVTNQMGLEAAVEAAAAFLNKAVKPVMVGGPKLRVAKACEAFVELADACGYPVAVMPSAKGLVPECHPRFIGTYWGAVSTAFCAEIVESADSYIFAGPIFNDYSSVGYSLLLKKDKAILVQPERVVIGNGPAFGCILMKDFLKALSKRLKCNTTAYENYHRIYVPEGQPLRSDPKEPLRVNVLFQHIQKMLSSETAVIAETGDSWFNCQKLKLPKGCGYEFQMQYGSIGWSVGATLGYAQAVPNKRVISCIGDGSFQVTAQDVSTMIRCEQRTIIFLINNGGYTIEVEIHDGPYNVIKNWNYTGLVDAIHNGEGKCWTTKVVCEEDLINAIETATGSKKDCFCFIEVIAHKDDTSKELLEWGSRVSAANSRPPNPQ

SEQ ID NO: 19735 - protein, 332 aa, Wolinella succinogenes
MYNPPRLIAQESFKKIKTLNEGEKMKVAQNVQELIGKTPLVRLNFASKESGANVIGKCEFMNPSGSVKDRIALGMINAAIGAGKITPETIVIEPTSGNTGIGLASVCAAKGIKLILTMPSSMSIERRKLLAALGAQIELTPAEKGMKGAVERALELAQETKNSFVPQQFENPANPEYHRVTTAVEIWEDLDGKVDVLVAGVGTGGTITGVGEVLKAKNPNLKIYAVEPIDSPVLSGGKPGPHKIQGIGAGFVPKALNTALYDEVIQVKVSDAYEMSRRLGKEEGILVGISAGANIWASKEIGKKYPGKTVVTILCDTGERYLSTELFDLQPS

SEQ ID NO: 19736 - protein, 314 aa, Clostridium sticklandii
MSKIYDLVIIGAGPAGLSAGLYGARGKMSTLIIEKDKTGGQIVTTEEVANYPGSIHDASGPSLIARMAEQADEFGTERIKDSIVDFDFTGKIKILKGTKAEYQAKAVIVATGASPKKLDCPGEKELTGKGVSYCATCDADFFQDMEVFVVGGGDSAVEEAMYLTKFASKVTIVHRRDSLRAAKSIQDKAFANPKIDFKWDSVIKEIKGDGIVESVVFENTKTGELSEHFADEEFGTFGIFVFTGYIPQTDIFKDKVDMNQSGYFVTNQNMETNIPGVFAAGDCREKVLRQVVTATADGAIAAIMAEKYIEHEGL

SEQ ID NO: 19737 - protein, 296 aa, Oscillatoria sancta
NSRLCMSSAVSAYIQSFGSDGPPCCYDDLEQTDCAFLIGTNAAECHPIAFNRLRVHHKKNKKVKMVVVDPRYTQTAEAADLHLAIRPGTDIDLLNGIAHLLMRWGLLDPLFIDECTTGFSDYTDVIRHSPPELVARHCGIRLDELETAARYWGESKQVLSLWSMGMNQSSEGTAKVRTLINLHLMTGNIGKPGAGPFSLTGQPNAMGGREAGGLSHILPGYRVVKNPLHRAEVEKLWGLTPGQISAVPGRTAWEMITALERREIGCFWIAATNPAVSMPDLERTKAALLRSPFTVY

SEQ ID NO: 19738 - protein, 296 aa, Oscillatoria sancta
NSRLCMSSAVSAYIQSFGSDGPPCCYDDLEQTDCAFLIGTNAAECHPIAFNRLRVHHKKNKKVKMIVVDPRYTQTAEAADLHLAIRPGTDIDLLNGIAHLLMRWGLLDPLFIDECTTGFSDYTDVIRHSPPELVARHCGIRLDELETAARYWGESKQVLSLWSMGMNQSSEGTAKVRTLINLHLMTGNIGKPGAGPFSLTGQPNAMGGREAGGLSHILPGYRVVKNPLHRAEVEKLWGLTPGQISAVPGRTAWEMITALERREIGCFWIAATNPAVSMPDLERTKAALLRSPFTVY

SEQ ID NO: 19739 - protein, 420 aa, Sulfolobus solfataricus
MMEEVLSSSLYTQQVKKLYKVGELLGLDNETLETLSQPERIIQVKIQIRGSDGKLKTFMGWRSQHNSALGPYKGGIRYHPNVTQDEVEALSMIMTWKNSLLLLPYGGGKGGIRVDPKKLTKEELEQLSRKFIQAIYKYLGSELDIPAPDVNTDSQTMAWYLDEYIKITGNVDFAVFTGKPVELGGIGVRLYSTGLGVATIAKEAANKFIGGIEEARVIIQGFGNVGYYAAKFLSDMGAKIVGISDSKGGVINENGIDVGKAMEIKEKTGSVTNYPEGRKVTNEELLISDCNILVPAALENVINKFNAPKIKAKLIVEGANGPLTADADEIMRQRGIVVVPDILANAGGVVGSYVEWANNKMGQIISDEEAKKLIVDRMNNAFNTLYDYHQKKLEDHDLRTAAMALAVDRVVRAMKARGLL

SEQ ID NO: 19740 - protein, 296 aa, Unknown
  Tolypothrix sp. PCC 7101
NSRLCMSSAVAGYIQSFGADGPPCCYEDLELTDCAFLIGTNTAECHPIIFNRLEKYRKKNRKVKLIVVDPRRTPTAENADLHLAIRPGTDIDLLNGIAHLLMRWNQIDVGFIDDCTSNFPAYAEVIRHYSPDVVAHRCGISVADLETAARYWGQSQRVLSMWSMGINQSSEGTAKVRTIINLHLMTGQIGKPGSGPFSLTGQPNAMGGREAGGLSHLLPGYRLVKNPQHRAEVENFWGLKPGQISSEQGMTAWDMITGLENGTVGLLWIAATNPAVSMPDLERTKKALLRSPFTIY

SEQ ID NO: 19741 - protein, 296 aa, Unknown
  Tolypothrix sp. PCC 7101
NSRLCMSSAVAGYIQSFGADGPPCCYEDLELTDCAFLIGTNTAECHPIIFNRLEKYRKKNRKVKLIVVDPRRTPTAENADLHLAIRPGTDIDLLNGIAHLLMRWNQIDVGFIDDCTSNFPAYAEVIRHYSPDVVAHRCGISVADLETAARYWGQSQRVLSMWSMGINQSSEGTAKVRTIINLHLMTGQIGKPGSGPFSLTGQPNAMGGREAGGLSHLLPGYRLVKNPQHRAEVENFWGLKPGQISSEQGMTAWDMITGLENGTVGLLWIAATNPAVSMPDLERPKKALLRSPFTIY

SEQ ID NO: 19742 - protein, 489 aa, Photobacterium profundum
MSIELLINVTPSETRVAMIESGNLQEVHIERESKRGIVGNIYKGRVSRVLPGMQAAFVDIGLDKAAFLHASDIVPHTECVAENEKKQFQVLDISELVRQGQDIVVQVIKDPLGTKGARLTTDVTLPSRYLVFMPGASHVGVSQRIESEEERERLKKIVKYHCDDLGGFIIRTAAEGASEDELGQDAAFLKHLWRKVIERRIKLKPKSMLYGELGLAQRILRDFVGTELDRIQVDSRLGFEKLKEFTEEFVPEVNDKIDYYAGEQPIFDLFDTENEIQRSLDRKVELKSGGYLIIDQTEAMTTVDINTGAFVGRRNLEETIFNTNIEATKAIARQLRLRNLGGIIIIDFIDMAIEDHQRRVLATLEQALSFDRVKTNINGFTQLGLVEMTRKRTRESIEHVLCGTCPTCEGRGTVKTVESVCYEILREITRVNRAYDADRFVVYVSPAVGDVLAGDEYHALAELEVFIGKQVKVKPEPLYIQEQFDVVMM

SEQ ID NO: 19743 - protein, 428 aa, Oryza sativa
MAQAVVPAMQCQVGAVRARPAAAAAAAGGRVWGVRRTGRGTSGFRVMAVSTETTGVVTRMEQLLNMDTTPFTDKIIAEYIWVGGTGIDLRSKSRTISKPVEDPSELPKWNYDGSSTGQAPGEDSEVILYPQAIFKDPFRGGNNILVMCDTYTPAGEPIPTNKRNRAAQVFSDPKVVSQVPWFGIEQEYTLLQRDVNWPLGWPVGGYPGPQGPYYCAVGSDKSFGRDISDAHYKACLYAGINISGTNGEVMPGQWEYQVGPSVGIEAGDHIWISRYILERITEQAGVVLTLDPKPIQGDWNGAGCHTNYSTKSMREDGGFEVIKKAILNLSLRHDLHISAYGEGNERRLTGLHETASIDNFSWGVANRGCSIRVGRDTEAKGKGYLEDRRPASNMDPYVVTALLAETTILWEPTLEAEVLAAKKLALKV

SEQ ID NO: 19744 - protein, 569 aa, Oryza sativa
MPTTFTPNSPASSCSIHHRASPSRGARNSVRFTRPRAAAAATNSVLSAPSSVPPAYVPPPPPPPTKMFPEAGDAAAAKAAARRCGKKKDGLNFFQRAAAVALDAFEEGFITNVLERPHALPRTADPAVQIAGNFAPVGEQPPVRSLPVSGRIPPFINGVYARNGANPHFEPTAGHHLFDGDGMERALGRAVFPKAIGELHGHSGIARLALFYARGLCGLVDPSHGTGVANAGLVYFNGRLLAMSEDDLPYQVRVTADGDLETVGRYDFDGQLGCAMIAHPKLDPVSGELFALSYDVIKKPYLKYFYFDADGTKSPDVEIELEQPTMIHDFAITENFVVVPDHQVVFKLGEMFRGGSPVVLDREKTSRFGVLPKHATSSLEMVWVDVPDCFCFHLWNAWEEAESGEVVVVGSCMTPADSIFNESDEHLESVLTEIRLNTRTGESTRRAVLPPAAQVNLEVGMVNRAMLGRKTRWTSPPGELTKFEYGEGRFGGEPCFVPMGGAGAAASPARGEDDGYILSFVRDEAAGTSELLVVNAADMRLEATVQLPSRVPYGFHGTFINAGELATQA

SEQ ID NO: 19745 - protein, 290 aa, Cytophaga hutchinsonii
MNKKVNVGLVQLSCSSNVKDNFEKNVQGIREAAAKGAQIICLQELFGSLYFCDVEDYDNFKLAESIPGPATDAFQALAKELGVVIIASLFEKRAEGLYHNTTAVIDADGSYLGKYRKMHIPDDPGYYEKFYFTPGDLGYKVFKTKFATVGVLICWDQWYPEAARITSLMGADILFYPTAIGWADHQTEEVNTDQYNAWQTIQRSHSVANGTPVVSVNRTGVEAGMQFWGGSFVSNAQGRVLYQAPHLTEEIHVQEIDMSQTDYYRTHWPFLRDRRIDSYAPIQKRFIDGE

SEQ ID NO: 19746 - protein, 577 aa, Unknown
  Shewanella sp. ANA-3
MHESQTTSSATQAVQTSRLSWFDDVLLLGIMAVLAGCGLIYEYLLSHYAGRILGALEAAIYTMIGLMIVSMGLGAFAARKIKDAFTGFVVLELTVALCGSLAILITAAVIGFGQQLPMLIASTLGLPPDQLPEGGMIGSLQKLSEHLPYVWGVLLGLMIGMEIPLIARVRQSLSDEHLLHNAGTIYGADYIGAGIGAAIWVGFMLAIDIQLAAALTASFNLLAGFVFIWRFWPKIQRAKLLLAGHFVVTGVLLLLAIQGPSWEQQFNNLLYKDKVVYAKATRFQQLTFTERLRGNGLSPIYSLYINGRLQFSSIDEHIYHAFLVHPTLAASARHNKVLIIGGGDGLGLKQVLRWEPEQVTLLDLDAALVQLFKTPDTDMPKRLSQALLALNGNAFNDPRVKVINDDAFNGVDKLIAAGDKYDAIIVDLPDPSHPDLNKLYSDYFYRKLKELMSNDGALTVQSTSPYHAQKAFISVAKTLALAGFDVKQYHHNVPSFGEWGWSIATLSGKDAQHRLGELTTLPIADDWLTLGLVKGAFEFPANFYQDAASIKPNELGSLQLYHYHQQAWSETQGLDLF

SEQ ID NO: 19747 - protein, 499 aa, Unknown
  Marinobacter sp. ELB17
MKVAAIFGFKNPEIKALHLTWIAFFITFYVWFNMAPLASSMLKSVNWLTADDLRLFAICNVALTIPARIIVGMALDRFGPRRVFSILMVLMSIPALTFAFGNTMTQLLVSRLVLSSIGASFVVGIHMTAMWFKPRDIGFAEGFYAGWGNFGSAAAALTLPTIALQMYGGDDGWRWAIAQSAIVMALYGVYYWFAVTDGPVGTVHRKPRKASALEVSTWGDMVKLILWTIPLIGVLAILVWRIQNMGYLSVTGAVVAYVVICSIVCYQIAQILRVNVPILKKGVPEDDKYPFNSVAALNSTYFANFGAELAVVSMLPMFFEETWSLGAAAAGMVAASFAFVNLVARPMGGLVSDRMGNRRFVMLSYMFGIAVGFALMGMLNPSWPLIIAVGVTVFTSFFVQGAEGATFGIIPSIKRRLTGQISGMAGAYGNVGAVVYLTIFTFVTPSQFFYIIAAGAFVSWVLCFMWLKEPESGFADEYAVSSVDLQIEEEDRIRTASLG

SEQ ID NO: 19748 - protein, 560 aa, Kalidium foliatum
MWSQLSSLFYSKMDMLSTSDHASVVSMNLFVALLCGCIVIGHLLEENRWMNESITALLIGLSTGVVILLISGGKSSHLLVFSEDLFFIYLLPPIIFNAGFQVKKKQFFRNFITIIMFGALGTLVSFSIISLGAMTTFKRMDIGSLELGDYLAIGAIFAATDSVCTLQVLNQDETPLLYSLVFGEGVVNDATSVVLFNAIQNFDLTHIDHRIALQFSGNFLYLFFASTLLGAMTGLLSAYVIKKLYFGRHSTDREVALMMLMAYLSYMLAELFYLSGILTVFFCGIVMSHYTWHNVTESSRVTTKHAFATLSFVAEIFLFLYVGMDALDIEKWRFVSDSPGTSVAVSSILLGLLMVGRAAFVFPLSFLMNFSKKTHSEKVTFNQQIVIWWAGLMRGAVSMALAYNQFTRSGHTQLRGNAIMITSTISVVPFSTMVFGLLTKPLILFLLPHPKHFTSASTVSDLGSPKSFSMPLLEGVQDSEVDVDNQDEGTNNHVEGTNNRTIARPGSLRMLLNAPTHTVHYYWRKFDDSFMRPVLGGRGFVPYVPGSPIEQTTNNLLDRT

SEQ ID NO: 19749 - protein, 67 aa, Campylobacter coli
MIEIDGTVLEALPNANFKVELDNKHVILCHIAGKMRMHYIRIMPGDKVKVELTPYSLDKGRITFRYK

SEQ ID NO: 19750 - protein, 701 aa, Pseudomonas syringae
MNPVIKKFQFGQSTVTLETGRIARQASGAVLVTVDDDVSVLVTVVGAKQADAGKGFFPLSVHYQEKTYAAGKIPGGFFKREGRPSEKETLTSRLIDRPIRPLFPEGFMNEVQVVCTVVSTSKKIDPDIAAMIGTSAALAISGIPFDGPVGAARVAFHESTGYLLNPTYEQLQASSLDMVVAGTSEAVLMVESEAKELTEDQMLGAVLFAHDEFQVVINAIKELAAEAAKPTWDWQPKPEATALLGAIRAEFGDAISQAYTITVKADRYARLGELKDQVVAKLAVEDGSPSASEVKAAFGEIEYRTVRENIVNGKPRIDGRDTRTVRPLNIEVGVLPKTHGSALFTRGETQALVVATLGTARDAQLLDTLEGEKKDPFMLHYNFPPFSVGECGRMGGAGRREIGHGRLARRSVQAMLPGADVFPYTIRVVSEITESNGSSSMASVCGASLALMDAGVPMKAPVAGIAMGLVKEGEKFAILTDILGDEDHLGDMDFKVAGTSKGVTALQMDIKIKGITEEIMEIALGQALEARLNILGQMNQIIGQSRNELSANAPTMIAMKIDTDKIRDVIGKGGATIRAICEETKASIDIEDDGSIKIFGESKEAAEAARQRVLGITAEAEIGKIYIGKVERIVDFGAFVNILPGKDGLVHISMLSDARVEKVTDILKEGQEVEVLVLDVDNRGRIKLSIKDVAAAKASGV

SEQ ID NO: 19751 - protein, 153 aa, Medicago sativa
PLVLSWRERPLGHIEYTGRGNFLVHGKPRFATRLAMLAGGTGITPIYQVVRAILKDPEDCTEMHVVYANRTEDDILLKEELDEWAKKYDRLKVWYVIQESIREGWEYSVGFITESILTEHIPNASPDTLALTCGPPTYDSICSPAEFGEVGLR

SEQ ID NO: 19752 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQNFGADRSMVEVALQ

SEQ ID NO: 19753 - protein, 744 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQCVLATDL

SEQ ID NO: 19754 - protein, 196 aa, Medicago truncatula
MGQALGIPDSGVLTQSEPISRVDPNEPLDKLLLNKKFRQSFMGFADSCLAGESVHFFDEVHELSKISEHDCVRRIYMARHIIEKYMVAGAAMEINISHRSKQEILSTSDLARADLFHNALNEIVHLMKTNLAKDYWSSMFFLKFQEECDMRCNGYELEQMTGWNYSPRLSSVHGTDDPFHHDHLLKNSECGNDTDS

SEQ ID NO: 19755 - protein, 573 aa, Unknown; identical to SEQ ID NO: 419
  Synechocystis sp. PCC 6803

SEQ ID NO: 19756 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQSFNLRRSAGTTRLQ

SEQ ID NO: 19757 - protein, 556 aa, Suaeda salsa
MLSQLSSFFASKMDMVSTSDHASVVSMNLFVALLRGCIVIGHLLEENRWMNESITALLIGLSTGIIILLISGGKSSHLLVFSEDLFFIYLLPPIIFNAGFQVKKKQFFRNFITIILFGAVGTLVSFIIISLGSIAIFQKMDIGSLELGDLLAIGAIFAATDSVCTLQVLNQDETPLLYSLVFGEGVVNDATSVVLFNAIQNFDLTHIDHRIAFQFGGNFLYLFFASTLLGAVTGLLSAYVIKKLYFGRHSTDREVALMMLMAYLSYMLAELFYLSGILTVFFCGIVMSHYTWHNVTESSRVTTKHAFATLSFVAEIFIFLYVGMDALDIEKWRFVSDSPGTSVAVSSILLGLHMVGRAAFVFPFAFLMNLSKKSNSEKVTFNQQIVIWWAGLMKSAVSVALAYNQFSRSGHTQLRGNAIMITSTITVVLFSTMVFGLLTKPLILFMLPQPKHFTSASTVSDLGSPKSFSLPLLEDRQDSEADLGNDDEEAYPRGTIARPTSLRMLLNAPTHTVHHYWRRFDDYFMRPVFGGRGFVPFVPGSPTEQSITNFVTENIS

SEQ ID NO: 19758 - protein, 95 aa, Oxalis medicaginea
  misc_feature (3)..(3): Xaa can be any naturally occurring amino acid
LYXGINISGTNGEVMPGQWEYQVGPSVGIEAGDHIWASRYILERITEQAGVVLTLDPKPIDGDWNGAGCHTNYSTKSMRDEGGFEVIKKAILNLS

SEQ ID NO: 19759 - protein, 746 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQLSGIIDLTG

SEQ ID NO: 19760 - protein, 627 aa, Pseudomonas aeruginosa
MCGIAGFWNITGTLLGDNARVARQMAAAIHHRGPDESGIWYEAPRAPILVHARLAVLELSPAGSQPMHSDCGRYVLIYNGEIYNHLALRARLSEAGVTHSWRGGSDTETLLACFAQWGVESTLKLTVGMFALALWDRQEKTITLARDRMGEKPLYWGWQNGVLFFASELKALKEHPLFRGDIDRDALALFLRYGYVPAPYSIYKGIGKLRAGSYLVLSERSLNETCEPAAYWSANAAIEEALSNPFQGTDAEAVDLLESQLRTSISDQMVSDVPLGAFLSGGVDSSTVVALMQQQSSRPIRTFSIGFDEPGYDEAVYAKAVAEHIGTDHTELYVNSKDALDVIPSLPKIYCEPFGDSSQIPTLIVSGLARQQVTVALSGDGGDELFGGYNPYQFTPRVWRMLERFPHSMRRFASAFAQDLPLPEKLGKLRDVFASRTAEELFYRLNSHWRNHEYPVIGAQGHTALLDTPERWPRVDSFQHWMMAMDVQGYMPDDILVKVDRAAMANSLETRVPLIDHRVFELAWRMPLHMKIRNGKGKWLLREVLYRHVSRELIERPKKGFSVPVSDWLRGPLKEWAESLLDERRLQQEGYLDSRLIRRIWNDHLAGRRDHSRRLWSVLMFQAWLES

SEQ ID NO: 19761 - protein, 92 aa, Oxalis lotoides
  misc_feature (1)..(1): Xaa can be any naturally occurring amino acid
XINISGTNGEVMPGQWEYQVGPSVGIEAGDHIWASRYILERITEQAGVVLTLDPKPIDGDWNGAGCHTNYSTKSMRDEGGFEVIKKAILNLS

SEQ ID NO: 19762 - protein, 752 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQTGALPDLLLIINCSK

SEQ ID NO: 19763 - protein, 95 aa, Oxalis subintegra
  misc_feature (89)..(89): Xaa can be any naturally occurring amino acid
LYAGINISGTNGEVMPGQWEYQVGPSVGIEAGDHIWASRYILERITEQAGVVLTLDPKPIDGDWNGAGCHTNYSTKSMRDEGGFEVIKXAILNLS

SEQ ID NO: 19764 - protein, 163 aa, Oryza sativa
CRVGRNPGRPRVRFDVCVKAKGDTHIDDHHSNEDIALAIGTALLEALGDRKGINRFGHFTAPLDEAAVEVILDLSGRPHLSCGLSIPTERVGTYDTQLVEHFFQSLVNTSGMTLHIRQLAGKNSHHIIEATFKAFARALRQATEYDLRRRGTVPSSKGVLSRS

SEQ ID NO: 19765 - protein, 89 aa, Oxalis unduavensis
  misc_feature (1)..(1): Xaa can be any naturally occurring amino acid
XINISGTNGEVMPGQWEYQVGPSVGIEAGDHIWASRYILERITEQAGVVLTLDPKPIDGDWNGAGCHTNYSTKSMRDEGGFEVIKKAIL

SEQ ID NO: 19766 - protein, 298 aa, Lactobacillus plantarum
MKLGLIGLGKMGMNLALNMQDNGHTPVGMDLNPTNLSTASAHGLATATDLTNLLDQLPTPRIVWIMVPAGKATNSVIEQLAQTLSAGDIVLDGGNSHYQDSIRHGELLASHHINFLDVGTSGGQAGARHDGNFMIGGDLATFQVVEPLFKAIAAPDGYLYTGPVGSGHYLKMVHNGIEYGMMAAIGEGFDVLQHSQFTYDNAAVAKMWNNGSVIRSWLMGLAQDAFSKDGNLDDIKGVMHSSGEGRWTLDTALDQQVATPVIAMALMMRYRSETDDTFTGKVVAALRNEFGGHAVDHE

SEQ ID NO: 19767 - protein, 227 aa, Unknown
  Synechococcus sp. WH 8101
NSRLCMSSAVAGYSRSLGSDGPPCCYDDLDHCSVAVLIGTNTAECHPVLFQRLLKRKKRDPKGLTIVVVDPRATDTSRIADYHLAIAPGTDLALLHGLARLIVQDNGFDSDFIDEATEGFAAYAKTIRAWTPAKVAALCGISEKELRQVARLWSRSQGVLSLWSMGVNQRREGTAVVSGIINLHLLTGQIGKPGAGPFSLTGQPNAMGARGRRPGPSASRLSLYGQE

SEQ ID NO: 19768 - protein, 511 aa, Saccharomyces cerevisiae
MAFQQGVLSRCSGVFRHHVGHSRHINNILYRHAIAFASIAPRIPKSSFHTSAIRNNEAFKDPYDTLGLKKSATGAEIKKAYYKLAKKYHPDINKEPDAEKKFHDLQNAYEILSDETKRQQYDQFGPAAFGGGGAAGGAGGGSGSPFGSQFHDFSGFTSAGGSPFGGINFEDLFGAAFGGGGRGSGGASRSSSMFRQYRGDPIEIVHKVSFKDAVFGSKNVQLRFSALDPCSTCSGTGMKPNTHKVSCSTCHGTGTTVHIRGGFQMMSTCPTCNGEGTMKRPQDNCTKCHGEGVQVNRAKTITVDLPHGLQDGDVVRIPGQGSYPDIAVEADLKDSVKLSRGDILVRIRVDKDPNFSIKNKYDIWYDKEIPITTAALGGTVTIPTVEGQKIRIKVAPGTQYNQVISIPNMGVPKTSTIRGDMKVQYKIVVKKPQSLAEKCLWEALADVTNDDMAKKTMQPGTAAGTAINEEILKKQKQEEEKHAKKDDDNTLKRLENFITNTFRKIKGDKKN

SEQ ID NO: 19769 - protein, 257 aa, Clostridium thermocellum
MRAALYQMEIAWEDKEKNYKKLEGVSEEVKKHGADLLLLPEMSFTGFSMNTKLTKEYNDESKDRVKMICKSHQISIGFGWVKAAGEKAENHYTIINEKGDEISDYVKIHPFSMAGEEKYFVKGNKLSTCKLQGREIATFICYDLRFPAVFQALGDETEIVVVAANWPKKRREHWKCLLQARAIENQVYILGVNCVGNMGGLEYSGDSCVINPNGEIIEIIEDKEGVIYADIEQDVKKIRDSFPLRLDRRTELYKTLF

SEQ ID NO: 19770 - protein, 271 aa, Unknown
  uncultured bacterium
NSRLCMSSAVAGYTQSLGSDGPPCCYDDLDHCKVAFLIGTNTAECHPVLFQRLLKRKKRNPGSLKIVVVDPRRTDTAKAADIHLPIAPGSDLALLHGIAHLILRENGQDPAFIDDHTENYEAFFDVVARWTPRRVARFCNLPEKRLREVAQPFHHRETVLSLWSMGVNQRREGTAVVSGLINLHLLTGQIGKEGAGPFSLTGQPNAMGGREAGGLSHLLPGYRLVANEQHRQVVEQAWNLPAGSIAAKPGLAAWQQIEAMERGELDLWWVA

SEQ ID NO: 19771 - protein, 230 aa, Arabidopsis thaliana
  misc_feature (108)..(108): Xaa can be any naturally occurring amino acid
  misc_feature (115)..(115): Xaa can be any naturally occurring amino acid
  misc_feature (122)..(122): Xaa can be any naturally occurring amino acid
  misc_feature (162)..(162): Xaa can be any naturally occurring amino acid
  misc_feature (172)..(172): Xaa can be any naturally occurring amino acid
  misc_feature (177)..(177): Xaa can be any naturally occurring amino acid
  misc_feature (185)..(185): Xaa can be any naturally occurring amino acid
MASSMLSSATMVASPAQATMVAPFNGLKSSAAFPATRKANNDITSITSNGGRVNCMQVWPPIGKKKFETLSYLPDLTDSELAKEVDYLIRNKWIPCVEFELEHGFVYXREHGNSXPGYYDGXRYWTNVGSFPLFGLHPTSGQSVEREVGRGSKKGYPNAFIXIIGFHNTRQXVQCIXFNWLKPPXLHRLISLWLWPQNFYSPFFGFYPLVFWFFPLSWVLISLNGWFSGL

SEQ ID NO: 19772 - protein, 271 aa, Unknown
  uncultured bacterium
NSRLCMSSAVAGYTQSLGSDGPPCCYDDLDHCKVAFLIGTNTAECHPVLFQRLLKRKKRNPGSLKIVVVDPRRTDTAKAADIHLPIAPGSDLALLHGIAHLILRENGQDPAFIDDHTENYEAFFDVVARWTPRRVARFCNLPEKRLREVAQLFHHRETVLSLWSMGVNQRREGTAVVSGLINLHLLTGQIGKEGAGPFSLTGQPNAMGGREAGGLSHLLPGYRLVANDQHRQVVEQAWNMPAGSIAAKPGLAAWQQIEAMERGELDLWWVA

SEQ ID NO: 19773 - protein, 604 aa, Triticum aestivum
MAALVTSQLATSGTVLGITDRFRRAGFHGVRPRSPADAALGMRTVGASAAPTQSRKAHRGTRRCLSMVVRATGSGGMNLVFVGAEMAPWSKTGGLGDVLGGLPPAMAANGHRVMVISPRYDQYKDAWDTSVVSEIKVVDKYERVRYFHCYKRGVDRVFVDHPCFLEKVRGKTKEKIYGPDAGTDYEDNQQRFSLLCQAALEVPRILNLDNNPYFSGPYGEDVVFVCNDWHTGLLACYLKSNYQSNGIYRAAKVAFCIHNISYQGRFSFDDFAQLNLPDRFKSSFDFIDGYDKPVEGRKINWMKAGILQADKVLTVSPYYAEELISGEARGCELDNIMRLTGITGIVNGMDVSEWDPTKDKFLAVNYDITTALEGKALNKEALQAEVGLPVDRKVPLVAFIGRLEEQKGPDVMIAAIPEILKEEDVQIVLLGTGKKKFERLLKSIEEKFPSKVRAVVRFNAPLAHQMMAGADVLAVTSRFEPCGLIQLQGMRYGTPCACASTGGLVDTIVEGKTGFHMGRLSVDCNVVEPADVKKVVTTLKRAVKVVGTPAYHEMVKNCMIQDLSWKGPAKNWEDVLLELGVEGSEPGVIGEEIAPLAMENVAAP

SEQ ID NO: 19774 - protein, 429 aa, Unknown
  Erythrobacter sp. NAP1
MNTLATPIAPIDTQDPELLIAELARAARKAQRVLAAISSDARANALKLAAKQLRTDAATILAENAKDIEAGEANGLTKAMLDRLKLDEERLEGIASAVEAVANLPDPVGQVIDQSERPNGLKMSRVRVPIGTIGIIYESRPNVTADAAALCVRAGNAALLRGGSEAVHSNRAILASLAAGLAEGGVPAEAVQLVPTQDRAAVGAMLTASGLIDMIVPRGGKSLVARVQSDARVPVLAHLDGINHTYIHSAANPTMARDIALNAKMRRTGICGAMETLLIDSDFSDASALIKALIDAGVEVRGDDRIQALNDRVTAASANDWDTEYLDAIVSVAMVDGFDEATAHIARHSSAHTDVIVTSDDAVAEQFFARVDSAIVMHNASSQFADGGEFGLGAEIGIATGRLHARGPVALEGLTTYKWLVRGSGQARP

SEQ ID NO: 19775 - protein, 331 aa, Bacteroides fragilis
MKLPGKIAIMGGGSWATAIAKMCLAQEESINWYMRRDDRIADFKRLGHNPAYLTGVKFDMKRINFSSNINDVVKESDTLIFVTPSPYLKAHLKKLKTRIRDKFIITAIKGIVPDDNLIVSEYFNKEYGVPPENIAVLAGPCHAEEVALERLSYLTIACPDKDKARVFARRLGSSFIKTSVSDDVIGIEYSSVLKNVYAIAAGICSGLKYGDNFQAVLISNAIQEMNRFLNTVHPINRNVDESVYLGDLLVTGYSNFSRNRTFGTMIGKGYSVKSAQIEMEMIAEGYYGTKCIKEINKHHHVNMPILDAVYNILYERISPMIEIKLLTDSFR

SEQ ID NO: 19776 - protein, 445 aa, Bacteroides fragilis
MISLNIEKTFGFISKESVSAYEAQVKAAQEALENGTGKGNDFLGWLHLPSSISKEHLADLKATAQVLRDNCEVVIVAGIGGSYLGARAVIEALSNSFTWLQEKKTAPVMIYAGHNIGEDYLYELTEFLKDKKFGVINISKSGTTTETALAFRLLKKQCEDQRGKEMAKKVIVAVTDAKKGAARVTADKEGYKSFIIPDNVGGRFSVLTPVGLLPIAVAGFDIEQLVNGAADMEKACGADVPFAENPAAIYAATRNELYKNGKKIEILVNFCPKLHYVSEWWKQLYGESEGKDNKGIFPAAVDFSTDLHSMGQWIQEGERTIFETVISVDKVNHKLEVPSDEANLDGLNFLAGKRVDEVNKMAELGTQLAHVDGGVPNMRIVIPELSEFSIGQLLYFFEKACGISGYLLGVNPFNQPGVEAYKKNMFALLNKPGYEEESKAIQARL

SEQ ID NO: 19777 - protein, 538 aa, Colwellia psychrerythraea
MWWRGAVIYQIYPRSFYDANQDGIGDLPGIISKLDYIASLGVDAIWISPFFKSPMKDFGYDISDYREIDPIFGTLADFDELVIKAHALGIKIMIDQVLSHTSDQHQWFIDSREDQTNDKADWYVWSDAKEDGTAPNNWLSIFGGTGWTWEPRRQQYYLHNFLTSQPDLNFHNPDVRQAVLDNIEFWLKRGVDGFRLDAINFCYHDAQLRDNPAKAKELRTSIGFDEKNPYAYQYHYYNNTQDENLGFMEDIRTLLNEYPGTVALGEISSEDSLKTMAEYTQGEHRLHMGYSFDLLTDNFSASYIKQVVQNLESRVLDGWPCWSISNHDVERVVTRWGGFNSKDFAKMLYAMISSLRGSVCSYQGEELGLNEADIAFEDIQDPYGITFWPQFKGRDGCRTPHPWQHNAINAGFSEGKPWLPVSNEHFAKSVDVQDDAVDSVLNSYRNFNRWRKDQPALRYGDINFIDTAEPLLAFVRQYQGEQLLVCFNFSEQSQIVALSSLTPASDSLTVLSDHKLISATITDGVLELPPFGCFYSKL

SEQ ID NO: 19778 - protein, 959 aa, Rhizobium leguminosarum
MSLIHEIDYGTPASKSEAMVTLTIDGQQISVPEGTSIMRASMEAGIKVPKLCATDMVDAFGSCRLCLVEIEGRNGTPSSCTTPVAANMVVHTQTGRLKDIRRGVMELYISDHPLDCLTCAANGDCELQDMAGAVGLRDVRYGYEGDNHVKARSNGDINLKWMPKDESNPYFTYDPSKCIVCSRCVRACEEVQGTFALTIEGRGFGSRVSPGMHEHFIDSECVSCGACVQACPTATLTEKSVIQIGQPEHSAVTTCAYCGVGCSFKAEMRGEELVRMVPWKDGQANRGHSCVKGRFAYGYSTHKDRILNPMIREKVSDPWREVSWDEAFAHVATEFRRIQYQYGREAIGGITSSRCTNEETYLVQKLIRAGFGNNNVDTCARVCHSPTGYGLGQTFGTSAGTQDFDSVEHSDVVIVIGANPTDGHPVFGSRLKKRLRQGAKLIVIDPRRTDIVRSPHIEASYHLPLKPGTNVAVMTALAHVIVTEGLFDETFIRERCDWSEFEDWAAFVAEPQHSPEETEIFTGVPAADLRGAARLYAKGGNGAIYYGLGVTEHSQGSTTVIAIANLAMATGNIGRPGVGVNPLRGQNNVQGSCDMGSFPHELPGYRHISDDATRDIFEKLWGVKLNNEPGLRIPNMLDAAVDGSFKGIYIQGEDILQSDPDTKHVAAGLAAMECVVVHDLFLNETANYAHVFLPGSTFLEKDGTFTNAERRINRVRKVMSPRNGYGDWEVTQKLAQAMGLDWNYSHPSEIMDEIAATTPSFAMVSYDYLEKMGSVQWPCNEKNPLGSPIMHVNGFVRGKGKFIRTEYVATDERTSPRFPLLLTTGRILSQYNVGAQTRRTENVVWHAEDRLEIHPHDAEQRGVRDGDWVKLGSRSGDTTLRALITDRVAPGVVYTTFHHPTTQANVITTDFSDWATNCPEYKVTAVQISPSNGPSEWQLEYDEQARQSRRIAGKLEAAE

SEQ ID NO: 19779 - protein, 162 aa, Pseudomonas syringae
MSAFHDIKLKALGGQELPMAGFKNKVVLVVNVASKCGLTPQYAALENLYQQYKDKGLEILGLPCNQFAGQEPGSEKEIAEFCELNYGVTFTLGEKLDVNGPDRHSLYRLLAGEGAEFPGDITWNFEKFLVGKNGGVSARFSPRTAPDDPAVIQAIEKALAQS

SEQ ID NO: 19780 - protein, 301 aa, Prosthecochloris aestuarii
MKYTFIVNPVAGSRRLFAPATDMLKTLCRTRSADIVETRHAGHAGELAEESLRNGDVVIACGGDGTAHEVANILAFSERIMGVFPAGSANDFVKSYEAPSPHSDPEAFFDAPSFQVDLGRVMASGGFDRLFLNSFGAGLTGRIARRVRQTRWLRGDVVYLYALLRELLGYTALKMHIKLITEGETLVLDEPVFAFSVGNGRVEGGRFHIAPDADITDGLLDVCILKSISRIRFLPYVFKYMSGSQVNDPRVVYKKVSAVELAFESTEVIHMDGEVFEDLSGTIRIDAAPRALNLLGYQGVR

SEQ ID NO: 19781 - protein, 112 aa, Streptomyces coelicolor
MKLITAVVKPHRLDEIKEALQAFGVHGLTVTEASGYGRQRGHTEVYRGAEYTVDLVPKIRIEVLVEDDDAEQLIDVVVKAARTGKIGDGKVWAVPVDTAVRVRTGERGPDAL

SEQ ID NO: 19782 - protein, 216 aa, Pseudomonas syringae
MARSKTSHNWLKEHFDDKYVKMAQKDGYRSRASYKLLEIQEKDKLIRPGMTVIDLGAAPGGWSQVTSRLIGGQGRLIASDILEMDSIPDVTFIQGDFTEDAILEQILEAVGNTQVDLVISDMAPNMSGLSAVDMPRAMFLCELALDLAGRVLRPGGDFLIKVFQGEGFDVYHKDIRKLFDKVQMRKPSSSRDRSREQYLLARGFRGIDGAASIERF

SEQ ID NO: 19783 - protein, 649 aa, Schizosaccharomyces pombe
MAISSLSSPSGARVSSVTVKNKVLKTPCFFLPTSRGTVPHLTPDNVEEFDIPALYVGLEDCLDRLEASPILTNEGTIKKWIAAPSVQPTLLAPRRTSPLPSVSAGQSHINIVTASGAKKLTNDLYIKAVLKLCPELVIPLNDTPTSPPGVKRKPKIVERSVNWTTELLLALKATDAFNTTKVFFPVPDLDTQYLTPIFQFFQENQLANNIAGLAFSNNVNPLPADLVGLPRLSIQKFESPLEILKCIQRGIDIIVPDMITQATDAGVALTFSFPPPSKDVLNSKIELGLDMWDERFATDMEPLQSGCVCKTCRRYKRAYVRHLLQARELVAWILLQLHNVYAFTAFFQGIRASIQEGNFDEDVRKFEEIYMTSFPASHGFGPRKRGYQMDLTNVQPVENKPAWISMKSPLEKEIANEYEALKVTERKEDTQDYNEPELHNSNDPTVDLYADTYATQAATESDSELEDALFSQLDEFDDTAYREQRLEMLKKEFARVEAAKEKGHMQFLTVENEREVMDFTLSSKKVVIHFYHPDFIRCKIIDSHLEKIAKVHWETKFIRIEAANAPFLVVKLGLKVLPAVLCYVNSQLVDKIIGFADLGNKDDFETSLLEFRLLKSSAIDRLKEESSSNKSIYHDELQNNQSDDSDFFE

SEQ ID NO: 19784 - protein, 205 aa, Triticum aestivum
PARCYRYCKGKPYIKSRYCRGVPDAKIRIFDLGRKRAGADEFPFCAHLVSLENEQLSSEALEAGRISCNKYITKFGGKDSFHMRVRVHPYHVLRINKMLSCAGADRLQTGMRGAFGKPTGLVARVKIGQIIFSIRAKDNTATHVLEALRRAKYKFPGRQKVVVSKKWGFTRFAREEYTKLKAEGRIVPDGSFCKLVSNHGRLPAY

SEQ ID NO: 19785 - protein, 242 aa, Arabidopsis thaliana
MAISLATAYISPCFTPESSNSASPSRTLSSVRLPSQIRRFGSVQSPSSSTRFAPLTVSSPFTNYLFRFDAIDFETKFNFVLVLVTSSSFMVEANRLADGLANYAFSLPLGLHWLESRPDVVSSILLADVAGVRAAKKQTFNSFDDLLQNSDKPVLVDFYATWCGPCQLMVPILNEVSETLKDIIAVVKIDTEKYPSLANKYQIEALPTFILFKDGKLWDRFEGALPANQLVERIENSLQVKQ

SEQ ID NO: 19786 - protein, 89 aa, Oxalis cf.
GINISGTNGEVMPGQWEYQVGPSVGIEAGDHIWASRYILERITEQAGVVLTLDPKPIDGDWNGAGCHTNYSTKSMRDEGGFEVIKKAIL

SEQ ID NO: 19787 - protein, 216 aa, Brassica napus
QRAITVFTFADKYRGPYSAGLKPEVCPFYCSYSGYQDELLWGAAWLYKATSNPIYLSYVQTNGRNLGADEFDNMFSWDNKHVGARILLSKEFLIQNVKALEEYKEHADSFICSVIPGAPFSSSQYTPGGLLFKMSGSNMQYVTSTSFLLLTYAKYLTSARTVVYCGGSVVTPARLRSIAKNQVDYLLGDNPLKMSYMVGYGSKYPRRIHHRGSSLP

SEQ ID NO: 19788 - protein, 332 aa, Prosthecochloris aestuarii
MIITVLGAGSWGTTLAVLLANKGYAVSLWAHRPDFAQELARTRENVKYLPGVTFPDGLEIAQDINAAATDADVIVAAVPSQAVRETMELLAGINLDGKLMVNVAKGIELGSGKRLSEVILETLSGVDPSMVSVLYGPSHAEEVSGLQPTTVVAASSNLDTAKRVQEIFHTRMFRVYVNTDIVGVEIAGSVKNIIAIAAGIADGIGFGDNAKAAIITRGLAEISRLSAAMGGDPMTVSGLSGIGDLVVTCLSKHSRNRYVGEQIGKGRSLDDVISHMNMVAEGVLTTKAVVELSNRLGVDMPITRTVYAMLFEHKPVEDAILDLMTRDPKPEL

SEQ ID NO: 19789 - protein, 444 aa, Unknown
  Synechocystis sp. PCC 6803
MITSPTNLNSLPIPPGDFGLPWLGETLNFLNDGDFGKKRQQQFGPIFKTRLFGKNVIFISGALANRFLFTKEQETFQATWPLSTRILLGPNALATQMGEIHRSRRKILYQAFLPRTLDSYLPKMDGIVQGYLEQWGKANEVIWYPQLRRMTFDVAATLFMGEKVSQNPQLFPWFETYIQGLFSLPIPLPNTLFGKSQRARALLLAELEKIIKARQQQPPSEEDALGILLAARDDNNQPLSLPELKDQILLLLFAGHETLTSALSSFCLLLGQHSDIRERVRQEQNKLQLSQELTAETLKKMPYLDQVLQEVLRLIPPVGGGFRELIQDCQFQGFHFPKGWLVSYQISQTHADPDLYPDPEKFDPERFTPDGSATHNPPFAHVPFGGGLRECLGKEFARLEMKLFATRLIQQFDWTLLPGQNLELVVTPSPRPKDNLRVKLHSLM

SEQ ID NO: 19790 - protein, 95 aa, Oxalis humbertii
LYAGINISGTNGEVMPGQWEYQVGPSVGIEAGDHIWASRYILERITEQAGVVLTLDPKPIDGDWNGAGCHTNYSTKRMRDEGGFEVIKKAILNLS

SEQ ID NO: 19791 - protein, 225 aa, Zea mays
MVQCLDGVRQLLAVLLKCCDVELKQPPGLEDPQVLARETVFSVSEVEALYELFKKISSAVIDDGLINKEEFQLALFKTSKKESLFADRVFDLFDTKHNGILGFEEFARALSVFHPNAPLDEKIDFSFRLYDLKQQGYIERQEVKQMVVATLAESGMNLSDEIVESIIDKTFEEADTKHDGRIDKEEWRSLVSRHPSLLKNMTLQYLKDITTTFPSFVFHSQVDDN

SEQ ID NO: 19792 - protein, 242 aa, Mesostigma viride
SVSQMIQASTFLGSKVASVARATPAKAQAKFVVSASSNRPVWFPGNAPRAWLDGSLPGDFGYDPLGLSSDPQVLKWMVQAELQNARWAMLGVAGMLGADLANKVGLPAAVQWYEAPLVDYQADWKTLLVVQLVLHAWVEGRRWADFHSPGSANADPFGNSLPSTATTGYPGGPFDPLGFSKGNLPELKLKEIKNGRLAMVASLGLFVQYSATGASPLDNLAAHLADPGHANIFALDKSGLYN

SEQ ID NO: 19793 - protein, 95 aa, Oxalis lucumayensis
  misc_feature (93)..(93): Xaa can be any naturally occurring amino acid
LYAGINISGTNGEVMPGQWEYQVGPSVGIEAGDHIWASRYILERITEQAGVVLTLDPKPIDGDWNGAGCHTNYSTKSMRDEGGFEVIKKAILXLS

SEQ ID NO: 19794 - protein, 271 aa, Unknown
  uncultured bacterium
NSRLCMSSAVAGYTQSLGSDGPPCCYDDLDHCKVAFLIGTNTAECHPVLFQRLLKRKKRNPGSLKIVVVDPRRTDTAKAADIHLPIAPGSDLALLHGIAHLILRENGQDPTFIDDHTENYEAFFDVVARWTPRRVARFCNLPEKRLREVAQLFHHRETVLSLWSMGVNQRREGTAVVSGLINLHLLTGQIGKEGAGPFSLTGQPNAMGGREAGGLSHLLPGYRLVANDQHRQVVEHAWNLPAGSIAAKPGLAAWQQIEAMERGELDLWWVA

SEQ ID NO: 19795 - protein, 567 aa, Shigella flexneri
MLRPVETPTREIKKLDGLWAFSLDRENCGIDQRWCESALQESRAIAVPGSFNDQFADADIRNYVGNVWYQREVFIPKGWAGQRIVLRFDAVTHYGKVWVNNQEVMEHQGGYTPFEADVTPYVIAGKSVRITVCVNNELNWQTIPPGMVITDENGKKKQSYFHDFFNYAGIHRSVMLYTTPNTWVDDITVVTHVAQDCNHASVDWQVVANGDISVELRDADQQVVATGQGTSGTLQVVNPHLWQPGEGYLYELCVTAKSQTECDIYPLRVGIRSVAVKGEQFLINHKPFYFTGFGRHEDADLRGKGFDNVLMVHDHALMDWIGANSYRTSHYPYAEEMLDWADEHGIVVIDETAAVGFNLSLGIGFEAGNKPKELYSEEAVNGETQQAHLQAIKELIARDKNHPSVVMWSIANEPDTRPQGAREYFAPLAEATRKLDPTRPITCVNVMFCDAHTDTISDLFDVLCLNRYYGWYVQSGDLETAEKVLEKELLAWQEKLHQPIIITEYGVDTLAGLHSMYTDMWSEEYQCAWLDMYHRVFDRVSAVVGEQVWNFADFATSQGILRVGGNN

SEQ ID NO: 19796 - protein, 525 aa, Brassica oleracea
MKQSSMVHSCSILFRFVVFLISFCIFFVTTSHAQVVHRRLWPWPSIPWPSMPWPYPWPMEPPEPGPPPGPPPGPSPNPGPPSGPSPRPPIPPKPQPKPPPAPGPSACPPIPPKPQPKPPPAPAPSPCPPQPPKPQPKPPPAPAPSPKPGPSPPPPKPPSPVPKPVPPPAPSPKPSPPAPSPKPKPSPPAPLPPKPENKTIPAVFFFGDSIFDTGNNNNLKSKIKSNYRPYGMDFPSRVATGRFSNGKVASDYISTYLGVKEIVPAYLDQKLQQNQLQRSDLLTGVSFASGGAGFDPETSESVEVIPMLDQLSYFQDYIKRVKKLVGKKEAKRIVSKGVAIVVAGGTDLIYTYFGIGAQHLKTDIDSYTTLMADSAASFVLQLYGYGARRIGVIGTPPLGCTPSQRVKDKKICDEEINYAAQLFNSKLAIILDQLSETLRNSTLVYMDIYSIFSKILESPAHYGFEEVKKPCCKIGLTGGGVFCKKKTSKICPNTSSYLFWDGAHPTERAFETLNKKLVKKYLRYI

SEQ ID NO: 19797 - protein, 271 aa, Unknown
  uncultured bacterium
NSRLCMSSAVAGYTRSLGSDGPPCSYEDLDHCTVAFLIGTNTAECHPVLFQRLLKRKKKHPGSVTIVVVDPRQTDTAKAADIHLAVAPGSDLALLHGIAHLVMRENRQDPTFIDDCTDNYDSFFDVVARWTPRRVALFCGIPEKRLREVAQLFHRREKVLSLWSMGVNQRREGTAVVGGIINLHLLTGQIGKEGAGPFSLTGQPNAMGGREAGGLSHLLPGYRQVTNPAHRAEVEQTWGFPKGKITANPGLTAWQQVEAMERGELDLWWVA

SEQ ID NO: 19798 - protein, 167 aa, Unknown
  Rhodococcus sp. RHA1
MVRMTTPVQNIGINTLGGTPTSLGEYDGRAVLVVNVASKCGLTPQYKGLEKLATDYADRGLTVIGVPCNQFMGQEPGTAEEIETFCSTTYGVTFPLLEKIEVNGENRHPLYEELTKATDAEGAAGDIQWNFEKFLVAPDGTVVKRFRPRTEPDAPEVVEAIEAVLPK

SEQ ID NO: 19799 - protein, 271 aa, Unknown
  uncultured bacterium
NSRLCMSSAVAGYTRSLGSDGPPCCYEDLDHCSVAFLIGTNTAECHPVLFQRLLKRKKRNPGSLKIVVVDPRRTDTAKAADIHLPITPGSDLALLHGIAHLILRENGQDPTFIDDHTENYEAFFDVVARWTPRRVARFCNLPEKRLREVAQLFHHRETVLSLWSMGVNQRREGTAVVSGLINLHLLTGQIGKEGAGPFSLTGQPNAMGGREAGGLSHLLPGYRLVANDQHRQVVEQAWNLPAGSIAAKPGLAAWQQIEAMERGELDLWWVA

SEQ ID NO: 19800 - protein, 275 aa, Xerophyta humilis
SLQQVEEVKCLLRIIPIWSTGIIYYIAIVQQQTYVVYEALQSDRHLGNTSFLIPAASYSVFAMLAMTIWIPIYDRIIVPRFRKLTGQEGGITLLQRMGVGLVLAIIGMVVSAIIEIQRRSYAIHRPTIGTAPSGGAISSMSSLWLIPQLVILGLSEAFNAIGQIEFYYKQFPENMRSVAGSLFFLGAATANYLSGALIGVVHRVTGRGAGKNWLAGDLNKGRLDYYYFFIAGLGVLNLVYFMMCAKWYKYKEADSSSNAGEISLVDEIISKEPLV

SEQ ID NO: 19801 - protein, 117 aa, Triticum aestivum
  misc_feature (19)..(19): Xaa can be any naturally occurring amino acid
  misc_feature (78)..(78): Xaa can be any naturally occurring amino acid
  misc_feature (85)..(85): Xaa can be any naturally occurring amino acid
  misc_feature (92)..(92): Xaa can be any naturally occurring amino acid
  misc_feature (100)..(101): Xaa can be any naturally occurring amino acid
  misc_feature (111)..(111): Xaa can be any naturally occurring amino acid
  misc_feature (115)..(115): Xaa can be any naturally occurring amino acid
SDGPFCASAFAVSFYVPAXNQADPPPAEGLRVDRWAGARYADVRRFGGFVADADVGEQAARLEASLQGTRWAAAVNDXRRADPAXPYTVAQXNSPFEFTXXVNEIWMLFDXDDDXSM

SEQ ID NO: 19802 - protein, 241 aa, Yersinia kristensenii
MTESFAQLFEESLKTIETRPGSIVRGVVVSIDKDIVLVDAGLKSESAIPAEQFKNAQGELEIQVGDEVDVALDAVEDGFGETLLSREKAKRHEAWLMLEKAYEEAATVTGVINGKVKGGFTVELNGIRAFLPGSLVDVRPVRDTLHLEGKELEFKVIKLDQKRNNVVVSRRAVIESENSAERDQLLENLQEGMEVKGIVKNLTDYGAFVDLGGVDGLLHITDMAWKRVKHPSEIVNVGDEI

SEQ ID NO: 19803 - protein, 271 aa, Unknown
  uncultured bacterium
NSRLCMSSAVAGYTRSLGSDGPPCSYEDLDHCTVAFLIGTNTAECHPVLFQRLLKRKKRHPGSVTIVVVDPRQTDTAKAADIHLAVAPGSDLALLHGIAHLVMRENGQDPTFIDNCTDNYDSFFDVVARWTPRRVALFCGIPEKRLREVAQLFHRREKVLSLWSMGVNQRREGTAVVGGIINLHLLTGQIGKEGAGPFSLTGQPNAMGGREAGGLSHLLPGYRQVTNPEHRAEVEQTWGFPQGKIAPDPGLTAWQQVEAMERGELDLWWVA

SEQ ID NO: 19804 - protein, 170 aa, Magnetospirillum magnetotacticum
MVLTRFPRAPLTEGPTPIRSLDRLSTHLGAELNGVRLFVKRDDVGPVGLGGNKLRKLEFLLGQALADRADTVITVGALQSNHARLTAAAAARMGLACELFLTRSVPRDDADYTGNGNRLLQDLFGARIHLLPGEADSLAEAEARADMLRSQGRRVCVFPSGGSSPLGWLG

SEQ ID NO: 19805 - protein, 271 aa, Unknown
  uncultured bacterium
NSRLCMSSAVAGYTRSLGSDGPPCCYDDLDHCSVAFLIGTNTAECHPVLFQRLLKRKKRNPGSLKIVVVDPRRTDTAKAADIHLPIAPGSDLALLHGIAHLILRENGQDPTFIDDHTENYEAFFDVVARWTPRRVARFCNLPEKRLREVAQLCHHRETVLSLWSMGVNQRREGTAVVSGLINLHLLTGQIGKEGAGPFSLTGQPNAMGGREAGGLSHLLPGYRLVANEQHRQVVEQAWNLPAGSIAAEPGLAAWQQIEAMERGELDLWWVA

SEQ ID NO: 19806 - protein, 167 aa, Arabidopsis thaliana
MALEKHIEKVLFSDEVIAHRVNQLGIDITSDFSGDSEETPIFVGVATGACLFLADLVRRIDLPIAIDFIRAESYGSGTVSSGVPRVSFDLKLDITNKHVVLVEDIVDTGNTLSCLIEHMKAKKASSVSVCTLLDKPSRRKVHYKLVGKGKFYSGFENNTATYLTLAY

SEQ ID NO: 19807 - protein, 275 aa, Oryza sativa
VSLLVLGLFLPPFPPPLRASKTAPPDVDEPLRSASALLLLLLPAAPTPYKSATAISSPQLSRLLYVGKTAGYHSRTQEEIHELLLSFAEAGANVVRLKGGDPLVFGRGGEEMDFLQQQGIRVEVIPGITSASGIAAELGIPLTHRGVATSVRFLTGHSRNGGPDPLYVAENAADPDTTLVVYMGLSTLPSLAPKLMKHGLPPDTPAVAVERGTTPQQRMVFAMLKDFVNEVKSEDLVSPTLIIIGKVVALSPFWIDSSKQGAQSIENLYAAETKR

SEQ ID NO: 19808 - protein, 817 aa, Ostreococcus tauri
MDRDHASSGTGDGSGTHATSRTNAEGSLTERVKHAVRSMSANEYSCVKSTLPTFASIKRKHLERLVRATWASEFEAENAEEIARALARVNVLRSPLSALRRAGLLHALARYGSNSMLYPLYAWREKLFDEPLEAYSSDDRSELARARRKMCAEFNRGAGAKDRQGQNACAGLVAPCAALVRAKVKFHRHFVAFENNYSVDAREEVLLDDEDDIGMSDPISSLSLCALIAISGKARRVLDVAAPLLPDLSEWVTEANAADGLQWAELVAFVARMALQEADLAYGAALFVAATLAEEKRLSESDNEKFQVEYDALRQCFAVARSKVYLHEESVHELGVNAPDFLETETDIKEILSANAPAKKHVLDTTFINLMDADVSGEPMSVTYATPVVGETPPLIEFDGPGSHAVDWYNPFGLAPPQDLGVRPGHRRKPSDFDLEAFAAPLEFTPLQSGPASELTYVDPFATPANAPNADALDMNALTQLLGTPKRMPSPSRQGAHTPQKPPRSPMHQPDWFVEIPLAELEFGRQIGRGAFGEVFRGKFRGTDVAIKRLCVLDGSAAAPMMTSEETSDDRGLAEFKRELSFLSRLRHRHIVQFIGAATEPPNLCIVMDYCDKGSLYAYLHNQSKTLSAFKVLKWMSEAAKGLVYLHASGIIHRDVKSGNLFIDDGGSIKIGDFGLSKFHSGASTSGGMMSVVGTYQFMAPELLNGQPRYTSAVDVYSFGIVMWECLTREEPFVGLSPMQIVAALLRGERPGDGATETNDMELPEEYLERMRACWDAEPGVRPAMKDVAPELERLFLNEKRRVLAAKRAVDQTPSLI

SEQ ID NO: 19809 - protein, 562 aa, Dictyoglomus thermophilum
MIYDDKIFGDLCHKEFLVEREVKKLEEIYLEEVLPEDPKPEDEIEFTFNCPLKFHITSGKIVKDNREIYTFNIQERKTQWNDSIFNFSEIIKIKIPPLKENGLYQIHLYEMNEKIYEQYLSIDSFEAPLWSEESIIYHIFIDRFAKDEKEVEYSENLKEKLGGNLKGILSRLDYIENLGINTIWISPIFKSTSYHGYDIEDYFEIDPIWGTKEDLKKLVREAFNRGIRIILDFVPNHMSYKNPIFQKALKDKNSNLRSWFIFKGEDYETFFGVKSMPKINLKNKEAIDYIINAAKYWIREFGISGYRMDHATGPDINFWSIFYYNLKSEFPETFYFGEIVETPKETKKYVGKFDGTLDFYLFKIIRDFFIGKRWSTKEFVKMIDLEEKFYGNKFKRISFLENHDSNRFLWVAKDKKLLRLASIFQFSINAIPIIYNGQEMGCSQYRDILEGNRTLHEHARLPIPWSDDKQDKELIDFYRQLVKIRKSHPALYKGTFIPIFSDMISFIKETQEESILVLINIEDKEEIFNLNGTYRDLFSGNIYTNSLKLGPMSAHLLLRIDH

SEQ ID NO: 19810 - protein, 466 aa, Salmonella typhimurium
MGQLSESHALGGGLKSRHVTMLSIAGVIGASLFVGSSVAIAEAGPAVLLAYLFAGLLVVMIMRMLAEMAVATPDTGSFSTYADKAIGPWAGYTIGWLYWWFWVLVIPLEANIAAIILNSWIPGIPVWLFSLVITLALTGSNLLSVKNYGEFEFWLALCKVIAILAFIALGATAISGFYPYAEVSGISRLWDHGGFMPNGFGAVLSAMLITMFSFMGAEIVTIAAAESDTPDKHIVRATNSVIWRISIFYLCSIFVVVALIPWNMPGLKSVGSYRSVLELLHIPHAKFIMDCVILLSVTSCLNSALYTASRMLYSLSRRGDAPAIMGKTNRSKTPWVAVLLSTGAAFLTVIVNYYAPAKVFKFLIDSSGAIALLVYLVIAISQLRMRKILLAQGGEIKLKMWLYPWLTWLVIGFICFVLVVMLFRPAQQLEVISTGLLGLGIIGTVPIMSRWKKLIRWQKAPLQNLR

SEQ ID NO: 19811 - protein, 514 aa, Ipomoea nil
MGSCNSIPSSPFAATSAGGESDPPPPKNDITVLPPSQPPPPRPFLSGVGRVLGRPMEDVHSTYIFGGELGRGQFGVTYLVTHRKTRERLACKSIATRKLLSKDDVDDVRREVQIMHHLTGHRNIVELKGTYEDRNHVHLVMELCAGGELFDRIIAKGHYSERAAAGLCRQMVTVLHYCHSMGVMHRDLKPENFLFLSSDENSPLKATDFGLSVFFKPGDTFKDLVGSAYYVAPEVLRRNYGPEADIWSAGVILYILLSGVPPFWGENEQSIFDAVLRGHLDFSSDPWPSISSSAKDLVKKMLRSDPKERLSATDVLNHPWMREDGDASDKPIDIAALSRMKQFRAMNKLKKVALKVIAENLSEEEIIGLKEMFKSIDTDDSGTITYEELKAGLTKMGTKLSESEVRQLMEAADVDGNGTIDYLEFITATMHMNRVEREDHLYKAFEYFDKDKSGYITMEELEHSLKKYNITDEKTIKEIIVEVDTDNDGKINYDEFVAMMRKGTPDLVINRRRR

SEQ ID NO: 19812 - protein, 380 aa, Pseudomonas syringae
MAKRDYYEVLGVERGSSEADLKKAYRRLAMKHHPDRNPDDKASEELFKEANEAYEVLSDASKRAAYDQYGHAGVDPSMGGGGGFGGGAGGANFSDIFGDVFSDFFGGGRAGGGGGRGGAQRGSDLRYTLELNLEEAVRGTNVNIRVPTLVNCKPCDGSGAKKGSSPVTCPTCGGIGQVRMQQGFFSVQQTCPRCHGHGKIISDPCDSCHGEGRVEESKTLSVKVPPGVDTGDRIRLSGEGEAGTQGGPTGDLYVVINVREHAIFQRDGKHLFCEVPISFTDAALGGELEVPTLDGRVKLKIPEGTQTGKQFRLRGKGVAPVRGGGAGDLMCRVAVETPVNLSKRQRELLEEFRTSLENDESHSPKASGWFEGVKRFFGDL

SEQ ID NO: 19813 - protein, 255 aa, Ralstonia eutropha
MHNTAKVAIVTGGSQGIGEAAARRLAADGFRIAVVASSDRAKAGNVAEAINSNGGDAAGFTCDVRDPQAARRLIAEVQNMFGRIDVLVNAAGIFKPTPAGSSDAQQVNQMIDTNLKGTWNTIDAVVPVLKAAGGGRIVNVASVAGVTGFGTYAIYCATKAGIILATRALACELGRENINVNCVAPGNTATAINEDIRNDAAMQGLRDYMTARTPSTRTFSEPEDIAGAIAFLASDAARAMHGSCILMDEGISAGL

SEQ ID NO: 19814 - protein, 421 aa, Rhizobium leguminosarum
MTRRFTRRGGKMSKIIIVGGGECGARAAFALREQGFNGDITLIGAEPHLPYERPPLSKTGLASAAPPQYVAGPARYEEARITILTGVPVDTVDRQSKLVRLSDGRKFPYDQLLLATGARPRPFAGVSGDPGLGRICMLRNHGDAVAIHEALAPGKSLAVVGGGFIGLEIAATARKLGAEVLLIESSPRVLSRGVPAEIAKVVTERHRQEGVNILCGEQITSIATENDKVQILFANGTTRLADIVVVGIGVIPNVELAEAAGLLIDNGIAVDATLRTSDPDIFAAGDCCSFPLSHYRERRVRLEAWRNAQDQGMLVAANLLGRGLAIASVPWFWSDQYELTLQIAGLSDGAATTVRRDLDQGAFILFHLDGEDRLIAASGIGPGNAVARDIRLAEMLIAAKRRLDPEALASPKTNLKKLLAA

SEQ ID NO: 19815 - protein, 1037 aa, Arabidopsis thaliana
  misc_feature (62)..(62): Xaa can be any naturally occurring amino acid
MERARRLAYRGIVKRLVNDTKRHRNAETPHLVPHAPARYVSSLSPFISTPRSVNHTAAFGRXQQTRSISVDAVKPSDTFPRRHNSATPDEQTHMAKFCGFDHIDSLIDATVPKSIRLDSMKFSKFDAGLTESQMIQHMVDLASKNKVFKSFIGMGYYNTHVPTVILRNIMENPAWYTQYTPYQAEISQGRLESLLNFQTVITDLTGLPMSNASLLDEGTAAAEAMAMCNNILKGKKKTFVIASNCHPQTIDVCKTRADGFDLKVVTSDLKDIDYSSGDVCGVLVQYPGTEGEVLDYAEFVKNAHANGVKVVMATDLLALTVLKPPGEFGADIVVGSAQRFGVPMGYGGPHAAFLATSQEYKRMMPGRIIGISVDSSGKQALRMAMQTREQHIRRDKATSNICTAQALLANMAAMYAVYHGPAGLKSIAQRVHGLAGIFSLGLNKLGVAEVQELPFFDTVKIKCSDAHAIADAASKSEINLRVVDSTTITASFDETTTLDDVDKLFKVFASGKPVPFTAESLAPEVQNSIPSSLTRESPYLTHPIFNMYHTEHELLRYIHKLQSKDLSLCHSMIPLGSCTMKLNATTEMMPVTWPSFTDIHPFAPVEQAQGYQEMFENLGDLLCTITGFDSFSLQPNAGAAGEYAGLMVIRAYHMSRGDHHRNVCIIPVSAHGTNPASAAMCGMKIITVGTDAKGNINIEEVRKAAEANKDNLAALMVTYPSTHGVYEEGIDEICNIIHENGGQVYMDGANMNAQVGLTSPGFIGADVCHLNLHKTFCIPHGGGGPGMGPIGVKNHLAPFLPSHPVIPTGGIPQPEKTAPLGAISAAPWGSALILPISYTYIAMMGSGGLTDASKIAILNANYMAKRLEKHYPVLFRGVNGTVAHEFIIDLRGFKNTAGIEPEDVAKRLMDYGFHGPTMSWPVPGTLMIEPTESESKAELDRFCDALISIREEIAQIEKGNADVQNNVLKGAPHPPSLLMADTWKKPYSREYAAFPAPWLRSSKFWPTTGRVDNVYGDRKLVCTLLPEEEQVTAAVSA

SEQ ID NO: 19816 - protein, 213 aa, Zea mays
MEVKLWNDKRERELLESYADLYAIIKAVEKLERAYVRDLVSAADYEAECLKLISQFNSLSSSLAGAVTVPRFVQAYRLDCPAALNRLLQSGVPATVELRAASASSAPAATAASASAIAHCVQTFITAMDAVKLNMLANDQVRPLLQDVAASMARLGSLLPPDFEGKVKVNEWLAKLHKMGAADELTEQQARQLNFDLDSAYSAFLAALPAAGL

SEQ ID NO: 19817 - protein, 421 aa, Pseudomonas aeruginosa [sequence omitted]

SEQ ID NO: 19818 - protein, 746 aa, Unknown
  Bradyrhizobium sp. BTAi1
MMGASFRIRLRLRRFTRRHHTLFTILRSAMIFMAGFGGAYGFIKASLSETSGYNPHAFAIGASFLFALACVGLATLSMRLRFMRKKMHKLALHNEVLADRNWELQEAEQRARSLFEQQGDLIVMRESDGTIIFVNDAYCRMAGLDRENLLGSQFSFDLLEQGDSALEPSGTRVHDQRIDSAIGPRWIAWREALVRSDAGHPAVQQCVGRDVTDRTETERALAEARDQANAANRAKSRFLAMASHEIRTPLNGILGMSGLLLETQLTPEQTTYAKAVRSSGEALMSLINELLDYSKIEAGKLALEAQPFALTALIEEITELLAPRAQGKQLEIAAYLDERLPTWVTGDAARLRQVLLNLAGNAIKFTSKGGVALIAEPGIWPNEISFQVRDTGIGIAADAQERIFREFEQADDSVARSFGGTGLGLAISDRIVKRMGGRIALQSQPGAGSTFEVSVPLPPALERGEQNSFRGPDLTGQSIMLIAPAGLQAELIERRLQNWGAQTCLVAETEIAAALLPERAWHAVLIDDAIGSEAARRLGEAAHHHTTRLIVLVTPTSRHELAPAAPFNGYLVKPLRAASLAARVSFDLDAGAAFAEHPIPTIAPSIAARAGTGLAILVAEDNDINALLMRSLLTKLGHHADIAVHGEAALDSWLAARAAGTPYDLILMDVQMPRLDGIAATRRIRAHEASEPGRRTPILALTANALVEDRYACFEAGMDGFLVKPIDRDKLDEALANLAAARQVAA

SEQ ID NO: 19819 - protein, 413 aa, Pyrococcus furiosus
MKAVILAGGFGTRLRPISSTRPKPMVPVLGKPNLQYILEALEKVSEIDEIILSVHYMRGEIREFIQERMVDYPKDIRFVNDPMPLETGGALKNVEDYVSDDFLVIYGDVFTNFDYSELIKAHKENDGLITVALTKVYDPERFGVVIVDEEGKIIDFEEKPRKPKTNLVDAGIYMVNKEVLKEIPKNKEVYFEREILPKFVSQGLVYGYRMPKEYYWIDLGTPEDLFYAHQIALDQLSRENGYMILGENVEIPEDVEVQGPVYIDNNAKIGHGVKIKAYTYIGPNTIIEDKAYIKRSILLGSDIIKERAELKDTILGEGVVVGKNVIIKENAVVGDYARINDNLVIYGAKILPWKKVEEYEAYIRIKLDPTKVRPELTPERCPLGLPECIYKKFKAIAGEKPPCDECIENQWLF

SEQ ID NO: 19820 - protein, 308 aa, Unknown
  Bradyrhizobium sp. BTAi1
MRVINIAAAQMGPIQRADSRAAVVMRMIALLDEAKRKGADLIIYPELALTTFFPRWYMEDQAEVDTWFEKTMPNEAVQPLFDRAAQHGIAMYLGYAELTPDGHHYNTAVLTDRNSTIIGKYRKVHLPGHDEFEPARSHQHLEKRYFEPGDLGFPVWRNLGGIIGMAICNDRRWPETYRVMGLQDVELVLIGYNTPSVNSLKSAEGLQQRLFHNRLSAQAGAYQNSCWVVAVAKAGVEDGHHLIGGTLIVNPDGEIVAEAATEGDEVLVVPCDLDATRFGKQTIFDFARHRRVEHYGLITSRTGAVPPD

SEQ ID NO: 19821 - protein, 137 aa, Mycobacterium avium
MVMKILARFRKAEPASIYDRIGGHEALEVVVEDFYVRVLADEQLSGFFTGTNMNRLKGKQVEFFAAALGGPHPYTGAPMKQVHQGRGITMHHFGLVAGHLADALTAAGVPSETVSEILGAIAPLAPEIATGEAKATV

SEQ ID NO: 19822 - protein, 91 aa, Oxalis cf.
  misc_feature (1)..(1): Xaa can be any naturally occurring amino acid
  misc_feature (4)..(4): Xaa can be any naturally occurring amino acid
XNIXGTNGEVMPGQWEYQVGPSVGIEAGDHIWASRYILERITEQAGVVLTLDPKPIDGDWNGAGCHTNYSTKSMRDEGGFEVIKKAILNLS

SEQ ID NO: 19823 - protein, 389 aa, Enterococcus faecalis
MATKRDYYEVLGLAKGASDDEIKKAYRKLSKKYHPDINKEADAEEKFKEVSEAYEVLSDPQKKAAYDQYGHAGTDPNYGGGAGGFGGFGGGGFSSSGFGGFEDIFDSFFGGGGGRSVDPNAPRQGADLQYTIQLKFEEAIFGVEKEIKYNREDTCATCGGNGAKPGTHPETCHKCHGSGTINVERQTPLGRMMSRQTCDVCHGTGKEIKEPCPTCHGTGHEKKAHTVKVNVPAGVEDGQQMRLANQGEAGTNGGPYGDLYVVFRVEDSDIFDRDGAEIYYDLPVSFVQAALGDEVTVPTVHGDVKLKIPAGTQTGTNFRLRGKGAPRLRGGGNGDQHVKVKLITPKNLNEEQKDALRAFAKAGGQNVTEQQEEGFFDKMKDAFGGKKKK

SEQ ID NO: 19824 - protein, 368 aa, Streptococcus pyogenes
MHYLHRRKGSVMVSVMWFRRDLRIDVQKALAHAIASQSPTLCVFQFNKEQLNLLHSRNQSSFITSVLAFRKLLKCEGIDLYLMYGDLMTCFEQLLTQLKDWTDVYFNYDESGYGRLRDQKAAQFFKKNGIAVHTYQDHYLHGSQEIINQSGQPYKVFTPYYRIWQNYPKETPIKVELSQGRWLNLETPDDVLRTVESIKDEKYQDVATFDEASKQLNRFIQDQLAAYHANRDFPAQLGTSRLSPFLRIGAIGIRTVYHAVRQAPNSLGQATFLKELAWRDFYNMVYVAYPDQKTQPIQKAFSQIEWVNNPDWFQLWKEGKTGYPIVDAAMLQLQKTGWMHNRLRMIVASFLTKDLLCDWRLGEQYFQQ

SEQ ID NO: 19825 - protein, 378 aa, Arabidopsis thaliana
METTPKRSKTLLMSNGEERRSMTFGIEMLPDDLVLSCLARVPRMYYPILSLVSKRFRSFLTSTELYQTRNLLGSTESFLFVCLRIVNDSNPLRLFTLCRRPNSLTKVMVPILSPDSIPKFLPDVVLVGSNIYVIGGLINNNASHKVMVMDCRSHTWREAQGTCVARVSPSACVLDGKIYVAGGCKNLDATMWMEVFDTKTESWEFVSSPGEEICRDLTSCESIGYDGNVYVESMKTYGLYELHKGRWREGQYSMSRGGSLSSQCVIDNVLYRSWSYMVEWYDSENKLWNSLKGLEKLFIVTNQYVPTKCVNYGGKLAVFWLEKVYAKHLHQETKIWCAVITIERRKKEEIWGTREWFDLVFTTNEEMVDLTHVFAATL

SEQ ID NO: 19826 - protein, 362 aa, Unknown
  Pseudomonas sp. cn4902
MIMANSGATSGWYHDFLETPFTRLVHSKSSKNMLLWINDALMAVFFLLVGLEVKRELMQGSLASLRQAAFPVIAAIGGMIVPALLYLAINYADPITRQGWAIPAATDIAFALGVLALLGSRVPFALKIFMMALAIIDDLGAIIIIALFYTNDLSMASLGLAAVAFAVLAVLNLCGARRTGVYILVGVVLWTAVLKSGVHATLAGVIVGFFIPLKEKHGPSPAKRLEHVLHPWVAYLILPLFAFANAGVSLQGVTLDGLTSILPLGIIAGLLIGKPLGISLFCWLALRLKLAHLPEGTTYQQIMVVGIVCGIGFTMSIFIASLAFGSVDPELINWAKLGILVGSISSAVIGYSWLRVRLRPSV

SEQ ID NO: 19827 - protein, 95 aa, Oxalis paucartambensis
LYAGINISGTNGEVMPGQWEYQVGPSVGIEAGDHIWASRYILERITEQAGVVLTLDPKPIDGDWNGAGCHTNYSTKSMRDEGGFEVIKKAIFNLS

SEQ ID NO: 19828 - protein, 457 aa, Coprinopsis cinerea
MLRMTAKASIFGQRNFTSWLIEATGTVPIKRRKDNPEDADNTEVMTKLMEALEGGDAVCLFPEGISRFHPEIAPLKTGVARMISDVLGRNRDNPDFEIALLPCSITYMHRQHFRSDVLVSFQRPMIFSPKTHPELVPPVDFAHIKALTKDLQGSISSGTLDAPKWHLIRSAKLAARMYAPLGTLMPLGEYVRLTRKFLELFKACQQDEGSGTLPQEVDRAAVRQICADLKAYQDQLAHWGIKDDRIRRPMRRSTALYRMSIRLAWLCLLGSISLPGLLLWAPIFATTYVAVRNYKKTGPILDTWDEIAQYKLIYGLLSGGIVYAVVVLMTWPIAFITIPMTPALMWITLRWFEDLVATFRAFVALYRLLRVGKPALKQMRERRLDLYSRVSNVAVSALGLPDEPEKYFSQIEGRHKGRILGEWDGRARYFSLKRRRKRDWDEVLRLYEKVDYPSEDD

SEQ ID NO: 19829 - protein, 197 aa, Unknown
  Bradyrhizobium sp. BTAi1
MRSATIKRKTKETDIEVAVNLDGTGVVNIATGIGFFDHMLDLLARHSRIDMTVKAVGDLHIDFHHTTEDVGIALGQAVRQALGDMAGITRYASIHMPMDETLTRVVIDVSGRPMLVFRTTFPRDKIGEFDTELVREWFNAFAMNAGITLHVETLYGENAHHIAESCFKGLARALRSALAIDPRNQGEVPSTKGQLGG

SEQ ID NO: 19830 - protein, 253 aa, Glycine max
MASSPTFALRTISSFSVKPVTTTRSSLTTSSTTTLLPFTSTNSSLPRTLKLNTSSPHPHLSLPHKSFTCRSQAEPSSDSAKVQELSVYEINERDRGSPAYLRLSQKTVNSLGDLVPFSNKLYSGCLQKRVGITAGICVLIQNKAEKKGDRYEAIYSFYFGDYGHISVQGSYLTYEDTYLAVTGGSGIFEGAYGQVKLHQIVFPFKLFYTFYLKGIKDLPQELLSQPVEPSPAIEPSPSAKACEPHAVIAGFTD

SEQ ID NO: 19831 - protein, 564 aa, Coccidioides immitis
MADLEGQRESDAPSIKSFLAPLVLDDAKVYDISYRLSEVFRDLARTGDGHFFPTPVTHLPSGKETGFYLAVDVGVTNLRVAFIELLGDSSDSPGNGSSSMPTAESYIAHNAIPKVWQRRVRRTLEKAWRIEEHLKEDPTEELFSWIGSCIADVVADELTSHSSEFPAELETGLSFSLPMKQKSLSEATLMPVGKAFFISEDLDLRQALLAGYERHTRRTDLIEPTAKRQKIYELPKLKIVAITNDTVATLVSLAYSVKSLPNTRVAMGIIVGAGCNATVPMKLSDLHESKVRQIRSYNPDATEAIINTEWTLRGTETPLQELGVVTKWDVELDSKTHRPGFQPFEYMTGARYIGELVRIIVFDYFTNVAGISKQDLPQTLTEPYSLTTALVSDVIATSRSDITLASDLARSLPPPTSSSWSWTPESAVVMRATVSAVQTRSAALIAAASVGLLACNHEIKLSEKPGSTSGSPTSTQPTGQNPQDQPEAICPGSGWHSGPEELVVAYTGGIIQHYPNFKEMCQVYIDRLIMRGGPQEEGKSVFLREASDGSIIGAGVLAGMVSRK

SEQ ID NO: 19832 - protein, 271 aa, Unknown
  uncultured bacterium
NSRLCMSSAVAGYTRSLGSDGPPCSYEDLDHCTVAFLIGTNTAECHPVLFQRLLKRKKRHPGSVTIVVVDPRQTDTAKAADIHLAVAPGSGLALLHGIAHLVMRENGQDPTFIDNCTDNYDSFFDVVARWTPRRVALFCGIPEKRLREVAQLFHRREKVLSLWSMGVNQRREGTAVVGGIINLHLLTGQIGKEGAGPFSLTGQPNAMGGREAGGLSHLLPGYRQVTNPAHRAEVEQTWGFPQGKIAPEPGLTAWQQVEAMERGELDLWWVA

SEQ ID NO: 19833 - protein, 271 aa, Unknown
  uncultured bacterium
NSRLCMSSAVAGYTRSLGSDGPPCCYDDLDHCSVAFLIGTNTAECHPVLFQRLLKRKKRNPGSVTIVVVDPRRTDTAKAADIHLPIAPGSDLALLHGIAHLVLRENGQDPAFIDDHTDNYEAFFDVVARWTPRRVARFCNLPEKRLREVAQLFHRRERVLSLWSMGVNQRREGTAVVCGLINLHLLTGQIGKEGAGPFSLTGQPNAMGGREAGGLSHLLPGYRLVANDQHRQDVEQAWKFPAGSIAATPGLAAWQQIEAMERGELDLWWVA

SEQ ID NO: 19834 - protein, 135 aa, Brassica napus
  misc_feature (84)..(84): Xaa can be any naturally occurring amino acid
  misc_feature (92)..(93): Xaa can be any naturally occurring amino acid
  misc_feature (101)..(101): Xaa can be any naturally occurring amino acid
  misc_feature (103)..(106): Xaa can be any naturally occurring amino acid
  misc_feature (108)..(112): Xaa can be any naturally occurring amino acid
  misc_feature (114)..(115): Xaa can be any naturally occurring amino acid
MASSMLSSAAVATSPAQATMVAPFTGLKSSAAFPVTRKSNTDITSIASNGGRVSCMKVWPPVGKKKFETLSYLPDLTDVELAQXADYLLRNXXIPCVEPEXGXXXXVXXXXXRXXPGVYLLRFSPSPPHPSYTFP

SEQ ID NO: 19835 - protein, 75 aa, Arachis hypogaea
MQPTIWAENAGVELPYSCRAGACSTCAGKIVSGTVDQSDGAFLDENQLNKGFLLTCVSYPTSDCVIETHKEGDLY

SEQ ID NO: 19836 - protein, 430 aa, Lotus japonicus
  misc_feature (263)..(263): Xaa can be any naturally occurring amino acid
  misc_feature (284)..(284): Xaa can be any naturally occurring amino acid
MAQILAPSTQWQTRITKTSPNASPITSNMWSSLLWKQNKKVARASKFRVLAIKSDGSTINRLEGLLNLDVTPYTDKFIAEYIWIGGTGVDVRSKSRTISKPVSHPSELPKWNYDGSSTGQAPGDDSEVILYPQAIFRDPFRGGNNILVICDAYTPQGEPIPTNKRHRAAEIFSNPKVQAEIPWYGIEQEYTLLQTDVKWPLGWPVGGYPGPQGPYYCAAGADKSFGRDISDAHYKACLYAGINISGTNGEVMPGQWEYQVGPXVGIEAGDHIWASRYLLERITXQAGVVLTLDPKPIEGDWNGAGAHTNYSTKSMREEGGFEVIKKAILNLSLRHQDHIRAYGEGNERRLTGKHETADINTFSWGVANRGCSIRVGRDTEKEGKGYLEDRRPASNMDPYVVTALLAETTLLWEPTLEAEALAAQKIQLKV

SEQ ID NO: 19837 - protein, 116 aa, Gibberella fujikuroi
PDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGQ

SEQ ID NO: 19838 - protein, 482 aa, Propionibacterium acnes
MSDTAPQTAEVGVIGMAVMGSNLARNMARKGFRVAIYNRTASRTDEVIAGHGNEGTFLPFHDLANFVASLERPRRVVMMVKAGCGTDAVIKEITPLLQPGDVLVDGGNAYFGDTRRREEEIRPTGIHYVGTGISGGEVGALEGPSIMPGGSKESYEIIGPVLEKISAHVDGEPCCAWMGTDGAGHFVKMVHNGIEYADMQFIGEAHSLLRAAGLTNAEAADAFESWNHGDLNSYLVEITSRVLRAKDPRNPDTDLLDVIRDEAGMKGTGTWTVQTALELGVDVSTISEAVFARSVSSAVPLRTVGQHVLAGPEHTITVEDRQTFLTDVRDALWSAKVVAYAQGLDEIRTAAAEYNWEVDMGQIASIWRDGCIIRARLLQRIRDEYAAGDLVSLLEAPSVKAELARCQQAWRRVVACAVEAGVPVPGFSSALGYYDQVRAPRLNAALTQGLRDLFGAHTYRRVDDEGSWHLNWSGDGREVRAN

SEQ ID NO: 19839 - protein, 271 aa, Unknown
  uncultured bacterium
NSRLCMSSAVAGYTLSLGSDGPPCSYEDLDHCTVAFLIGTNTAECHPVLFQRLLKRKKRHPGSATIVVVDPRQTDTAKAADIHLAVAPGSDLALLHGIAHLVMRENGQDPTFIDNCTDNYDSFFDVVARWTPRRVALFCGIPEKRLREVAQLFHRREKVLSLWSMGVNQRREGTAVVGGIINLHLLTGQIGKEGAGPFSLTGQPNAMGGREAGGLSHLLPGYRQVTNPEHRAEVEQTWGFPQGKIAPDPGLTAWQQVEAMERGELDLWWVA

SEQ ID NO: 19840 - protein, 498 aa, Dictyoglomus thermophilum
MKIKFFIKRTLIFIFILVTFLTYIHGYNEPWYKNAIFYEVFVRSFADSDGDRVGDLNGLIDKLDYFKNLNITALWLMPIFPSVSYHGYDVTDYYDIHPGYGTMEDFENLIRKAHEKNIKIILDLVVNHTSSRHPWFVSSASSYNSPYRDYYIWSTEKPEKNSNLWYKKPTGYYYALFWSEMPDLNFDNPKVREEVKKIAKFWIEKGVDGFRLDAAKHIYDDDSKNIQWWKEFYSYLKSIKPDVYLVGEVWDNEYKIAEYYKGLPSNFNFPLSDKIMNSSSKSKRLRNYRISRLKRLFGENNTDFADAIFLRNHDQVRVRTFFGGSIDKSILAGSIYLTLAGNTFIYYGEEIGMEGSKPDEYIREPFKWTDDMKSKYQTYWIIPRYNLPGNGIALDTEEKDPNSIYNHYKKLLEIRVKCRALSNGKIERIKTQDRSILAYKLELEDEKIMVVHNLNRIENTFNFNNEIKEKDILYIRNAKTEKNKIILGPYSTVIVKIP

SEQ ID NO: 19841 - protein, 849 aa, Fervidobacterium pennivorans
MFRDSSMGLLKKLSVITLIVFALSISFAETELIIHYHRWDGNYDGWNLWIWWVEPISKEGAAYQFTEKDDFGVVAKVKFPETLTKVGIIVRLGEWREKDVAMDRFITIKDGKAEVWLLQGIEQIYTTKPDTSPRVLFAQARDQYTIEAYLTGQVDTTKVGAKVTVDGQPLKIARVEKANPTDISRTNHVKVVLAEPIKLEDVNKDVQVEIEGYKPARVIMMEILDKIYYDGPLGFEYTPEKTTIRVWSPVSKTVDVLLYKNWDDKEPTQVVPMKYIGNGAWEAVLEGNWDGWFYKIRYFSYGEYRESVDYFSKAVTKNSAKSAIIDFSKTNPESWEKVARPPLVAPEDAIIYEIHIADMTGLDNSGVKNKALYLGLTEKGTRGPNGVTTGLDHLVELGVTHVHILPMFDFWTGDEADKDFERSYNWGYDPYLFTVPEGRYSTDPINPYTRIIEVKQMVKALHENGIRVILDMVFPHTWGVGVMSPFDQAVPYYFYRIDKTGAYLNESGCGNVIASERPMMRKYIVDTLKWWVTEYKIDGFRFDQMGLMDKVTMLAIKSELSKIEPSVVLYGEPWGGWGAPIRFGKADVGGTGIAAFNDEFRDALRGSVFNATVKGFLMGALAKETGVKRGVAGSIEYDEVIRSFAKDPQETINYVEVHDNHTLWDKNYLAAQADTTVKWTEEMLKDAQKLAGAILLTSQGIPFLHAGQDFARTKKFDENSYKSPISINGLDYARKAEFIDVFNYYKGLIELRKSHIAFRQRTAEDIRKKLTFLPSPRKMVAFVLKDEKDPWKEILVIYNGDTKDQQFTLPDGTWNVVVDKDNAGTKVLYQVSGKINIKAISAMVMYKGN

SEQ ID NO: 19842 - protein, 271 aa, Unknown
  uncultured bacterium
NSRLCMSSAVAGYTLSLGSDGPPCSYEDLDHCTVAFLIGTNTAECHPVLFQRLLKRKKRHPGSVTIVVVDPRQTDTAKAADIHLAVAPGSDLALLHGIAHLVMRENGQDPTFIDNCTDNYDSFFDVVARWTPRRVALFCGIPEKRLREVAQLFHRREKVLSLWSMGVNQRREGTAVVGGIINLHLLTGQIGKEGAGPFSLTGQPNAMGGREAGGLSHLLPGYRQVTNPEHRAEVEQTWGFPQGKIAPDPGLTAWQQVEAMERGELDLWWVA

SEQ ID NO: 19843 - protein, 209 aa, Shewanella oneidensis
MSGKKRTASSNRWMLEHFDDHYVKLAQKRGLRSRAAFKLEELQQKDQLIRPGMTVVDLGAAPGGWSQVAVKLVGDKGKVIACDILPMDPIVGVDFLQGDFREEKVLEALLTRVGADKVDVVLSDMAPNMSGSDGVDQPRAMYLVELALDMCHQVLAPNGSFAVKVFQGEGFDEYMKAVKEAFKVVKTRKPDSSRARSREVYLVATGYKL

SEQ ID NO: 19844 - protein, 511 aa, Glycine max
  misc_feature (192)..(192): Xaa can be any naturally occurring amino acid
  misc_feature (312)..(312): Xaa can be any naturally occurring amino acid
MEEMSFAVAVPLRVGSDDCHDSGNLEDEVGIAEVIPPIQDREGESPMLDMISQNRSTLVAGDEELTMEIEEDSLSFEGDQFVDSSCSLSVVSENSSVCGEESFCFDATSDVGTPCSTDVEKSICAVNIVAEAVDLGESNVDTDIMTDPLAVAVSLEEESGVRSGPKSSAVDLHQLPQEKGVSGTVGRSVFEXDYTPLYGFISMCGRRPEMEDAVATVPRFLKIPIHMLIGDRVIDGINKCFNQQMTHFFGVYDGHGGSQVANYCRDRIHLALAEEIESVKEGLIVGSIKNDCRDLWKNTFTNCFLKVDAEVXGEVNREPVAPETVGSTSVVAIICSSHIIVSNCGDSRAVLCRGKEPMALSVDHKPNRDDEYARIEAAGGKVIQWNGHRVFGVLAMSRSIGDRYLKPWIIPDPEVTFLPRAKDDECLILASDGLWDVMTNEEVCDIARRRLLLWHKKNGLALPSERGEGIDPAAQAAADYLSNRALQKGSKDNITVIVVDLKAQRKFKSKT

SEQ ID NO: 19845 - protein, 277 aa, Magnetospirillum magnetotacticum
SERQPRSQGRLEALLNFQQVVEDLTGLDVANASLLDEATAVAEAVALMWRASRAKSGYVVLDADLFPQTLAVTLGRAQAVGLPVVVADLSGGLQAGLAAARAAGAFPTVLDDDAHLVGVVVQQSGASGRVVDWRPVVAEAKDAGALVTVASDLLALTLLVSPGELGADVAVGSAQRFGVPLFYGGPHAAFMAVRKGLERSLPGRLVGVSIDADGDTAYRLALQTREQHIRREKATSNICTAQALLAIVASMYAVYHGPDGLRAIAERTHAHATTLAE

SEQ ID NO: 19846 - protein, 531 aa, Aspergillus oryzae
MTTLPPIKGAESLPSRWSLTEDLGGYDMPIRLEGEIGDVMVRGTIPDSIDGTFYRVGSDHFTPTLPGHSPLLGHGVVSASRIHKGQVDFKIRYVQNDRYKLERNLKESVWGDMRDHPLSQHPCVKAVLTSTSNTNVIYWAGRLLALQEMDPPYAMDPDTLETTGVDPFGNQILSPTFTAHPKIDSNVNELVTWGIDHGANEIISYSIDRHGIVKNEHQIKRAIGGLIHDIAMTENWIVFCQWPTSFVDGTTVWDTSRPAIFVVAPRHPKHPLEGSGWEPYEHRIYTHDFNSEIVHTAGAWEEGGKIFFEGTWPHESLFPFWPKTDGKKPSEKTVVDLVRLEIDVSQPSNTRIPDPVTLVDIPNEFPRIDERFYCRKYDHIFMNIYYSETEKFLVNKHVFEGLNATAMLTKSTGELKVYYPGPNCRCQEPVFIPRSDSAPEGDGHVIFAVDRLDINLTNLVILDTKDFEHPVAVIELPLRMRAQIHGNWVDARELNGQPLVVPPPLHHMTWRHRPGQSVPNGRGFVAESSGV

SEQ ID NO: 19847 - protein, 405 aa, Vibrio vulnificus
MAGVLGMILAGGEGSRLRPLTESRSKPAVPFGGSYRLIDFALNNFVNADLMRIYVLTQFKSQSLFHHMKKGWNINGITDRFIDPIPAQMRTGKRWYEGTADAIYQNLRFMELSEPEQVCIFGSDHIYKMDIKQMLSFHKEKQAALTVSALRMPLAEASQFGVIEVDAEGRMVGFEEKPSAPKSIPGDPDFALVSMGNYIFEADVLFAELIEDADNENSSHDFGKDIIPKMFPRGDVFVYDFSQNRISGEKAEVYWRDVGTIDAYWQAHMDLLKTDAPFSLYNRKWPLHTYQPPLPPATFTDSDNGRVQIIDSLVCNGSYVRGSRIEKSVLGFRSNIASACDISESILLGDVKVGEGCVLRRVIVDKDVDIAPGTQIGVNLQEDKKVFHVSDDGIVVIPKGARVGY

SEQ ID NO: 19848 - protein, 893 aa, Glycine max
MSSMAASVDQRPYPGLHNGVVRPLKPGPDIPRPKKLPQPPPPLSDSSSDEEEDTTLNLKDLIRKGTTEVESSIFDPRDDGTSDHWIQRNSSLVRLTGKHPFNSEPPLPRLMHHGFITPVPLHYVRNHGPVPRARWEDWTVEVTGLVTRPTCFTMEQLLHDFPSREFPATLVCAGNRRKEQNMVKQSIGFNWGAAAISTSVWRGVPLRTLLKSCGIYTRTKGALHVCFEGAEDLPGGGGSKYGTSILREVALDPSRDIILAYMQNGEPLSPDHGFPVRMIIPGFIGGRMVKWLKRIIVTTDQSQNYYHYKDNRVLPSHVDAELANAQAWWYKPDYIINELNINSVITTPCHEEILPINSWTTQMPYFIRGYAYSGGGRKVTRVEVTLDGGETWQVCTLDCPEKPNKYGKYWCWCFWSVEVEVLDLLGAREIAVRAWDEALNTQPEKLIWNVMGMMNNCWFRVKTNVCRPHKGEIGIVFEHPTQPGNQSGGWMAKEKHLEKSSESNPTLKKSVSSPFMNTTSKTYTMSEVRRHNNADSAWIIVHGHVYDCTRFLKDHPGGTDSILINAGTDCTEEFEAIHSDKAKQMLEDYRIGELTTTCYNSDSSSSNPSVHGSSDTIPLTPIKEVITPMRSVALNPREKIPCKLISKTSISHDVRLFRFALPSDDLLMGLPVGKHIFLCATVDEKLCMRAYTPTSSVHEVGYFDLVVKVYFKGVHPKFPNGGIMSQHLDSLPIGSVLDVKGPLGHIEYTGRGNFLVHGKPRFATRLAMLAGGTGITPIYQVVQAILKDPEDCTEMHVVYANRTEDDILLKEELDEWAKKYDRLKVWYVIQESIREGWEYSVGFITESILTEHIPNASPDTLALTCGPPPMIQFAVQPNLEKLGYDTQNNLLVF

SEQ ID NO: 19849 - protein, 411 aa, Vitis vinifera
MNALAATNRNFKLAARLLGLDSKLEKSLLIPFREIKVECTIPKDDGTLASFVGFRVQHDQWRGPMKGGIRYQPEVDPDEVNALAQLMTWKTAVANIPYGGAKGGIGCNPGELSLSELERLTRVFTQKIHDLIGVSTDVPAPDMGTNSQTMAWILDEYSKFHGYSPAVVTGKPTDLGGSLGRDAATGRGVLFATEALLHEHGKSIAGQRFVVQGFGNVGSWAAQLISGHGGKIVAVSDITGAIKNSKGIDVPSLLKHSVEHRGVKGFNGADPIDPKSILVEDCDVLIPAALGGVINRENANEIKAKFIIEAANHPTDPEADEILSKKGVIILPDIYANSGGVTVSYFEWVQNIQGFMWDEEKVNNELRTYMTRGFKDVKEMCRTHNCDLRMGAFTLGVNRVARATVLRGWEA

SEQ ID NO: 19850 - protein, 390 aa, Meiothermus ruber
MRNAPRSVTITQAMHGRLPLTAQTHRRLVVKVGSAVLSGPQGRQHQLAIAAQVAALRAEGREVVLVSSGAQATGMQKLGLTEKPKSMPGKQALAAVGQPTLMLLWEQAFSWYDLKVAQVLLTAEDLAHRHRYLNARQTLETLLEWGIVPIINENDTVMVEEIKFGDNDQLSALIASLVGADLLILLSDIEALYEADPRTHPEAQPIPYVERVDAGVLRMAGDSPNRVGTGGMKSKLLAAEKAQAAGIPHLLLPGTRPQSIAEALQGAPVGTLFAGGQRRYSGRKLWLYQLPKPQGEVVVDAGAAKALRQGGASLLPAGILEVRGQFGVGEAVRCLDEQGNLIGVGLVNYSAAELARIKRRKTREIEALLGYKNTDEAIHRDYFALASELE

SEQ ID NO: 19851 - protein, 248 aa, Picea glauca
MEHLNAAAAQASSSLYGVSMAEYGDVGVSSMMALMTQHEPHERDSILTTSMPSSFSSFHGHAECLLSAAMFQASQGDHKLKRQPEMDQLVSEQAVMSDSSMPSVKTEGCSSLRNQFEIRREQTGNCYTDQSSNAPVSPLVTSLVPQAGGEARMITSLEADSSHISGGNEAEAIKAKILAHPQYPSLLGAYIDCQKIGAPPEVVARLDALTNEYENQQHRTTVSIGMDPELDQFMEAYCEMLTKYHEEL

SEQ ID NO: 19852 - protein, 318 aa, Unknown
  Pelargonium x hortorum
MESFPVINMEKLNGEERAATMEKIKDACENWGFFELLNHGIPYELLDTVEKMTKEHYRKCMEQRFKEMVASKGLEGVEVEVEDLDWESTFFLKHLPESNISQVPDLQDEYRKVMKEFAAKLEKLAEELLDLLSENLGLEKGYLKKAFYGSKGPTFGTKVSNYPPCPKPDLIKGLRAHTDAGGLILLFQDDKVSGLQLLKDGKWVDVPPMHHSIVINLGDQLEVITNGKYKSIEHRVIAQSDGTRMSIASFYNPGSDAVIYPAPALLEKETEEKQVYPKFVFEDYMKLYSGLKFQAKEPRFEAMKAVEANVTLDPIRTA

SEQ ID NO: 19853 - protein, 97 aa, Populus deltoides
LMAHPHYHRLLAAYANCQKVGAPPEVVARLEEACASAASMGPANTDGIGEDPALDQFMEAYCEMLTKYEQELSKPLKEAMVFLQRVECQFRALTLSS

SEQ ID NO: 19854 - protein, 178 aa, Triticum aestivum
  misc_feature (88)..(88): Xaa can be any naturally occurring amino acid
  misc_feature (100)..(100): Xaa can be any naturally occurring amino acid
  misc_feature (112)..(112): Xaa can be any naturally occurring amino acid
  misc_feature (134)..(135): Xaa can be any naturally occurring amino acid
  misc_feature (138)..(138): Xaa can be any naturally occurring amino acid
  misc_feature (142)..(142): Xaa can be any naturally occurring amino acid
  misc_feature (144)..(144): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPXCLEFSKVGLSSXSKNASPGYYDGXRYWTNVGSCLCSGCTDATQVIXXVEXVKKXYXDPYVRSSDSKHRVNAQILQRAARRKAKNYSHRHA

SEQ ID NO: 19855 - protein, 352 aa, Desulfitobacterium hafniense
MAKIAVYGAGSWGTALAVSMGKAGHEVALVGRNLSEMDLMEQRRENRPYLPGVVLPPTVRPTGDAGALEEAEMLVLSVPSHSVRETAQKIRAYLQPGTIVVNTAKGLEEGSHKRLSQVLTEELPHHPIVVLSGPSHAEEVGKDMPTTVVVASQNSQAAEAVQDMLMTPKFRVYTNPDTIGVELGGAFKNIIALCAGFADGLGFGDNTKAALMTRGIAEITRLGAAMGGNPLTFAGLAGVGDLIVTCTSRHSRNHRAGVALGEGKPLEQVLKEVGMVVEGVRTTRVAYELSRQYEISMPITEQAYQVLFQGADPRAAVSALMMRGKKHEIEEVALIAMEQGSYQENGPDDHGE

SEQ ID NO: 19856 - protein, 446 aa, Candida albicans
MTAETIAKAANSAFASLKTLTNDQRSLALQKIHDALLTNKDKILESNKLDMENAQSQNLSSSLIKRLDLSNPGKYDSMLQGILDVAQLPDPMGKITLAKKLDEGLNLYRVTAPIGVLLIIFESRPEVIANITALAIKSGNSAILKGGKESYQTFKIMSEIINQTLQIETDVPRDAIQLIQSREDVADLLNQDKYIDLVIPRGSNELVRNIKSNTKIPVLGHADGICSIYVDEKFDIIKAKKIIVDSKTNYPAGCNAVEQLLINSHIPQQQIIEILQILIAAKVTIHVTPEIKQIISSGDNININIKGDDYIKDVEADSFDKEYLSFDISVKLVDNVDEAIKHINEHSSKHTECIITEDKAIAEKFLKSIDSAGIYWNASTRFADGFRYGFGTEVGISTNKIHARGPVGLEGLMSYQYQLKGDGHIVGEYVGGGGNKLFIHEDLSTN

SEQ ID NO: 19857 - protein, 372 aa, Arabidopsis thaliana
MSSPEKKRKKNQKSSPNPSLPEDLIVSILARVSRSYYTNLSVVSKTFRSILTSPELYKTRTLLGKPETFLYVCLRFPDEANPRWLILYRKPNQTLTKKKKKKEDSSVHLLAPIPILNSPTVEWSSLVAVGSYLYAITADIKDSPCSNVWYLDCRTHTWLDSPRLRLAHINSDFNGRTYFPGSSEKPDSLNCVEVYNTNTQTWNPVPPQKRKLKFGNMEGKIYIPPCQENHRKAVALNPKVLTWEAVGLGTNLDRGSFCMIGNIAYCYDPSGKFRWMNCNTAEGDWSRLEGLEGLPKFARYSTVKLAEYGGKLVVLWDKYVAASGYKEKMIWCAEISLEKRNSEEIWGKVEWFDAVLTVPKSYKFVCAKSATV

SEQ ID NO: 19858 - protein, 381 aa, Ludwigia peploides
NVLDKIKEFSERIRNGSWVGATGKQLTNVIAIGIGGSFLGPLFVHTALQTDREACECARGRQLRFLANVDPIDVARNIMGLNPETTLVVVVSKTFTTAETMLNARTLREWISSALGPSAVAKHMVAVSTNLPLVEKFGIDPKNAFAFWDWVGGRYSVCSAVGVLPLSLQYGFAIVEQFLLGARSIDQHFNSAPFEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGVMKSQQPVYLKGEVVNNHDELMSNFFAQPDALAYGKTPEQLRKENVPEHLVPHKTFTGNRPSLSILLPSLNAYNVGQLLAIYEHRVAVQGFI

SEQ ID NO: 19859 - protein, 1085 aa, Unknown
  Frankia sp. EAN1pec
MECRTPAGRRRARGPRPAGAMPVNSPNAQRLPDADPVGRVQPQPVAGLGAEDVVELVEVAHDVGAQVRRAVRVGGQVLPLQLEPALGAPHVGPVHEQPTSVLPRRLAVLGDDVGLVGDGQAAEVADVLPDSERAVHLLARQVARLEPVVLLDQRLRLHLEGRLVGGRPPVVEVAGAVVLRALVVEAVTDLVADHRADAAVVLGRVAVRAEERLLENGGREADLVGARVVVGVDGLREHEPLVAVHRRADLGQLPVGLERGGCAGVAHQVAAADRQRRVVPEPVGVADLRPERLELLVRPLLGLLRHPVQLGDRRAVGREQVRDEVVHLRLGVRREVPGDVLPADRLPDRALDERHRALPAGPQLGRAAERAAVEVEVGLGEHVGQVGRGRAQHAADQPVAPHVDRRVGQHGRQVLEERRLPHARLRQRRVRAGQRPTETGDVGVPVERRAERGQLSARHQVVGLLDVAGLGPLPVALREQGFHVEDPLRGALGVGVPAQPEHPGQVVDVLLAGRGELVVVVVRLVRQAEAALAQVEQVAVRVAVVGVDVGAEQSGAADPLELAEERGEAADVAQPARAVQQRPHRAQAERLERLGVHEGVVEVADLPRVLALGGLVPRGEVGDDVADLPLGVIGQLHERAPARPVGRDLRLGEPPAVHVAEQVVLRSDVEVHALAGVVEDVHRTEVSNRLPPGHGATPSCPARPVHPLDGICPHVGIRSVRGHPLSITGGRRAARDQALSGLTNDTLWVSLWPGARSTPAARTRPHCSGPRCGTPPFACSATASGPADLMEMFLPPYADRPVAVVTGASSGIGRATARTLAEQGWQVIGVGRDPVRSAATEAEIAAAARKDGGFTMLRGDFTLMADVRRVAGEIQHLTPRLDILINNAGGVRDRQIISAEGTEATFAVNHLAPFLLTRELTPLLRASAASLPAGSTRVIAVSSSGHRAVDGLDWDDLQSLGEFRPAVAYCRAKLANILFTRELARRAGPDGIVAQAMHPGVVASNFSAHGDAAMRAHMAAADTVPPDEPAETLAWLATEPEGGRTGGRYFHRRAEELPAEAARDDAAAARLWTESERLLDGLGFR

SEQ ID NO: 19860 - protein, 392 aa, Pseudomonas syringae
MHKPTPRTESPNALAFITRFFAAESAGGLVLMAAALAALIVANSPLGDSYFAALHAVFAGLSVSHWINDGLMAIFFMLVGLEIKREVLAGQLASWSQRALPGFAALGGMLVPALIYVAFNWGRPDTIGGWAIPAATDIAFALGVLSLLGKRVPLSLKIFLSALAILDDLGAVLIIALFYTSDLSIPMLLAALGSIAMLVALNRLGVKKLLPYLIVGALLWFFMLQSGIHATLAGVALALCIPLGKPDEEARSPLLHLEEKLHPWVAFAVVPIFGFANAGVSLSGITADTLVDPVPLGVALGLLVGKQVGIFAMAALAIRAGLARLPDGSNWGQLYGVAALCGIGFTMSLFIGALAFPGAPELVDEVKVGVLIGSVLSAVLGVVVLRRFAQRG

SEQ ID NO: 19861 - protein, 501 aa, Calylophus toumeyi
MASPALISETEAWKDLKAHVEGIKRTHLRELMGDAERCQSMMVEFDNIFLDYSRQQASPDTINKLYKLADAAHLKQKIDRMYNGDHINSTENRSVLHVALRAPRNSTICSDGKNVVPDVWNVLDKIKDFSERVRSGSWVGATGKVLKDVIAVGIGGSFLGPLFVHTALQTDPEASKNARVRELRFLANVDPIDAARNISGLDPETTLVVVVSKTFTTAETMLNARTLREWISSALGPSAVAKHMVAVSTNLPLVEKFGIDPNNAFAFWDWVGGRYSVCSAVGVLPLSLLYGFAVVEKFLQGAHNIDQHFSSAPFEKNIPVLLGLLSVWNVSFLGYPARAILPYSQALEKLAPHIQQVSMESNGKGVTIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFIGNRPSLSILLPTLDAYRIGQLLAIYEHRVAVQGFV

SEQ ID NO: 19862 - protein, 952 aa, Sulfurospirillum multivorans
  misc_feature (187)..(187): Xaa can be any naturally occurring amino acid
MEKTTERALSTTVGRRSFLKMAAVASVFGATSGFAGENVTRAATEEEVKNPFPGSKKVKTICTSCSVGCGVIAEVQNGVWVRQEVAQDHPISLGGHCCKGADMIDMVRSEVRLKYPMVKENGQWKRLSWDDALNRIATKLADLKKKDGADSVQFLGSAKMGNEQAYYFRKFAAFYGTNNTDHQARIXHSSTVAGVANTFGYGAMTNSLGDIQKSKAIIIFGANPAVNHPVGFQHFLKAKERNNSQLIVIDPRFTKTAAKADIFAQIRPGTDIPFMYGMLNIIFKNGWEDKEYIHDRVFGMEKIREEALKWTPELVADVTGVPAEKLIQITTLYAKNRPGTLIWAMGLTQHSIGTSNTRMAPILQLALGNMGKAGGGTNILRGHDNVQGATDMGCLADSLPGYYGLAEGSWKYFAKQWGVDYEYLVSQFKDASWMTKNGFSLARWWAGVEGVKSDDKIENAGTTLKALVVMGNGITSIAQQAKIKEALDNLELIVLADPFVNEAAILTDKKDNVFILPAATQFETSGLVVATNRSAQWRYKVVEPLYESKADQDIMFELAKRLGFYDLYTKAMFMQETKDGKLEMIPEKKAFTWPEDATNEIARIIKTIGLTGWTAERVKKHTDNWHMFDEVTGAGMGPMKGEYYGLPWPCWTKTHGGSPNLYDTSIPVSAGGMGFRNNFGLEKDGVNLLAEKGSFPKGSKIEAGYPEITKANIEAVLGITLTEEEKAAMGANWKVDNSNLIVQKALDAGLCPYGNAKARAIVWNFPDHIPMHREPLHSPRTDLTLKYPAYPDKANHFRVMTKYISVQSAQDYAKDFPINMVTGRLVTMNGAGIENRASKYIAALTPEMFCDIHPDLALKHDIKNGAMMWVHSPEGTKIKVKAKYSHSVLPDMVFMPFHFAGYFQGTDRTGNFPAGTKPYASGESVNTVTNYGYDIITQIPETKGGLCRIEKA

SEQ ID NO: 19863 - protein, 491 aa, Gaura lindheimeri
WKDLKAHVEGVKRTHLRELMGDSERCQSMMVEFDNIFLDYSRQQASPDTINKLYKLADAAHLKQKIDRMYNGDHINSTENRSVLHVALRAPRNSAICSDGKNVVQDVWNVLDKIKDFSERVRNGSWVGATGKELKDVIAVGIGGSFLGPLFVHTALQTDPEASKNARGRELRFLANVDPIDAARNISGLDPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHNIDQHFSSAPFEKNIPVLLGLLSVWNVSFLGYPARAILPYSQALEKLAPHIQQVSMESNGKGVSIDGLPLPFQSGEIDFGEPGTNGQHSFYQLIHQGRVIPCDFIGVMKSQQPVYLKGEVVNNHDELMSNFFAQPDALAYGKTPEQLKKENVSEHLIPHKTFTGNRPSLSILLPTLDAYRIGQLLAIYEHRVAVQGFVWG

SEQ ID NO: 19864 - protein, 286 aa, Unknown
  delta proteobacterium MLMS-1
MILSDSQVDTVETSPAGWPRWAICLQFRVVFDDPAANLALVRQRLAELAPAAGSLVVLPELWAAGFAYPSLARQAARTPELLAALAAEAADRGITVAGSLPEAAVATDGGYLYYNTLYLVEPAGVAGKYRKQRLFAPLGEDRYFRAGTDDHGAGEPRGPLPAAWGPVAALVCFDLRFPELATAQVDRGAELLLVSAQWPRARRQHWRVLLQARAIENQIFVVACNTCGRVGESDFAGTSMIIAPDGEVLAEAGGTPQALGAPLDFSRLAAARRLFRTRSPGSTTCG

SEQ ID NO: 19865 - protein, 661 aa, Desulfitobacterium hafniense
MKIIRAEKAGFCFGVKRALDMAERTVQSSSTASLGPLIHNQQVVEKMEKQGVRVVGEVKETQAGDTLIIRSHGVPPDIYEEARRCQVKVVDATCPFVQKAQRLAAESSQSGQVVVVGDRQHPEVQGILGWAGGNAIAIETLEEARELPFYEQLSVLAQTTQPAANFHGIVDELKTHTHALKVHNTICNATEERQTVARELAGKVDVMIVVGGKNSANTRKLAGICSERTQTYLIETADELEDNWFTGVVTVGLTAGASTPDWIIEEVYRKMSTMENKETHEMMNMEDWAEGMQNLHRGALVTGTVVKINHDEVFVDLGWKSEGVIALKELTVASDLQTSDIVAIGDQISAVVLRVENEEGNPVLSKRRADEMAAVDKLKELAESKEEIQGKVADVVKGGLIVDVGMRGFVPASQIQPGYVEDLNQFKGQTLRLRVIEFDPAKRRVVLSQKEILQEEQAAKKEHLLATLQEGDVVSGVVKRLAQFGAFVDIGGVDGLLHVSDIAYTRIKHPSEYVNVGDEVEVQILKVDKEQGKISLGLKQLKPSPWESAPEKYALGSLVTGKVVRIAPFGAFVQLEDGIDALIHISQLSEKRVNKVEDVVKVGDMVQAKVIECKPEEKRISLSIREAAAEAQATEDAELLASQPEAPQVTIGDVVQSESES

SEQ ID NO: 19866 - protein, 491 aa, Coccidioides immitis
MSDQAVGDFGLIGLAVMGQNLILNAADHGFTVVAFNRTVSKVDRFLENEAKGKSIVGAHSIQEFCAKLKRPRRIMLLVMAGKPVDDFIDALLPYVEPGDIIIDGGNSHFPDSNRRCKYLKERGIRFVGTGVSGGEEGARYGPSLMPGGNEEAWPYIKDIFQSIAAKSYGEPCCDWVGDEGAGHYVKMVHNGIEYGDMQLICEAYDIMKRGLGMTAAEMGDVFEKWNKGVLDSFLIEITRDVLRYNDEDGKPLLEKILDTAGQKGTGKWTAINALDLGMPVTLIGEAVFARCLSALKSERVRASKILGGPKPEFSGDRQEFIANLEQALYASKIISYAQGFMLIQNAAKEYNWKLNKPSIALMWRGGCIIRSVFLKDITNAYRNDPDLENLLFDDFFNKAIHTAQPGWRDVVSKATLWGIPTPAFSTALSFYDGYRSHDLPANLLQAQRDYFGAHTFLIKPECANERYPAGQNHHVNWTGRGGNVSASNYQV

SEQ ID NO: 19867 - protein, 340 aa, Arabidopsis thaliana
MNNMSTSTAATPQGEEPARVSSMMDSKFKYHVKDNTKKTTMKRKQRCGFGRERTLHNLNLQSFNMGTLVGHILPGFFFFALGLWHLFNHIKIFSLHPKSYIAPLWFPLSKPRYLEPLVIIIASSLSISVELFLGQKNHQPFDPNDGTIPSNHLHNFEHSCISFTFITYAAFAIVFDKTRPIAHRSLINLIAALAFAQQLFLFHFHSSDHTGVEGHYHLLLQLVVFVSLVTTLLGIALPSSFILSFVRSLSVSFQGIWLMSMACMLWTPSLVPKDCFLHIEEGKHTIRCSDVKALHRAISLVNIQFSWFLVIITIFAMWFYIFLQRIYGEKIEYSQLRTKD

SEQ ID NO: 19868 - protein, 91 aa, Oxalis picchensis
INISGTNGEVMPGQWEYQVGPSVGIEAGDHIWASRYILERITEQAGVVLTLDPKPIDGDWNGAGCHTNYSTKSMRDEGGFEVIKKAIFNLS

SEQ ID NO: 19869 - protein, 458 aa, Prochlorococcus marinus
MENKENNSNVENVVIIGSGPAGYTAAIYAARANLQPLLVTGFNSGGIPGGQLMTTTFVENYPGFPDGVLGPELMDLMKAQAERWGTNLYESDVVSINTDSHPFELKTLEGTIKTNSIIIATGASANRLGVINEDKFWSKGISACAICDGATPQFRDEELAVIGGGDSACEEAAYLTKYGSKVHLIVRSEKLRASAAMVDRVKANPKIEIHWNTKVNKADGFEWLEKIETIHSQEGKGEINIKGLFYAIGHTPNTKFLDNKIDLDNKGYIACKSGRPETSIEGIFAAGDVVDSEWRQGVTAAGTGCMAALATERWLAEKNLAKTIVRETPEPEKKLNSSDFNEEEVNEDTFDSNSEWQKGSYALRKLYHESKKPILVIFSSPSCGPCHVLKPQLKRVIKELDGAVLGVEIDIDKDQNIAKQAGINGTPTVQLFKEKLLKKQWQGVKQRSEFKEAIKNII

SEQ ID NO: 19870 - protein, 78 aa, Arabidopsis thaliana
MITDEQINDLVLQLHRLLPELANNRRSGKVSASRVLQETCSYIRNLSKEVDDLSERLSQLLESTDSAQAALIRSLLMQ

SEQ ID NO: 19871 - protein, 316 aa, Arabidopsis thaliana
MPIMAGTASPWRREAVFLTAMLVVETSVVGISTLFKFATSKGLNIYPFLGYSYLLASLLLLPSLFFTNRSSSLPPLSVSILSKIGLLGFLGSMYVITGYIGIEYSSPTLASAINNITPALTFILAIIFRMEKVSFKERSSLAKLMGTILSLIGALVVIFYHGPRVFLASSPPYVNFRQFSPPLSSSNSDWLIGGALLTMQGIFVSVSFILQAHIMSVYPAAFRVSFLYTVCVSIVTSTIGLVVEKNNPSVWIIHFDITLITIVTMAIVTSVYYVIHSWTVRHKGPLYLAIFKPLSILIAVVMGAIFLNDSLYLGWY

SEQ ID NO: 19872 - protein, 306 aa, Mesostigma viride
MNTSTFMGAQLQVATAVATKTTTVLPTQAIFGTKKGGTVVKKGTVKKAATAVKTAKKAAPSGDKLSASERQSGPDRPKFLPGITPPAYLDGSMIGDYGYDILGLAAPKEFLQYDVDGNDINAAVSAPGEIIGTIKKTGPEVDATPFQPYAEVFSIERFRETELINGRWAMLGVAGALAGEMQTGINWVDIGKVMLEQGSSFGGLPLPWTMTQLVIIEVVLVGWAEILRNNELDPEKRLYPGGPFDPFGFTKASESRVNDLKLAEIKHARLGMMASLGFAVQYAYTGAGPIKNLADVLIGRGQTIVQ

SEQ ID NO: 19873 - protein, 311 aa, Propionibacterium acnes
MAKIANDVTELIGNTPLVKINKLFPDSQATVLAKLEFYNPASSVKDRIATSIVDAAEASGQLNPGGTIVEATSGNTGVGLALVGAARGYKVIITMPETMSKERRAIIRLLGAELVLTPGADGVPGANSKAAEIVENTPGAILASQFDNPANPAIHHDCTGEEIWNDTEGEVDAIVAGIGTGGTISGAGKYLKEKDPEIKIFGAEPAESPVITKGDKAPHKIQGWGPGFVPDNLDKSVVDGILLVPGDEAIAFARRAAAEEGIITGISGGGALQAAGQVVARPEFAGKTIVVVIADTGERYLSTALFEGLLD

SEQ ID NO: 19874 - protein, 137 aa, Coprinopsis cinerea
MARTKQTARKSTGGKAPRKQLATKAARKTAQTATGGVKKPHRFRPGTVALREIRRYQKSTELLIRKLPFQRLVREIAQDFKTDLRFQSSAVMALQEAAEAYLVSLFEDTNLAAIHAKRVTIQPKDLALARRLRGERS

SEQ ID NO: 19875 - protein, 421 aa, Streptomyces tubercidicus
MVDAHQTFVIVGGGLAGAKAAETLRAEGFTGRVILICDERDHPYERPPLSKGFLLGKEERDSVFVHEPAWYAQAQIELHLGQPAVRLDPEGRTVRLGDGTLIAYDKLLLATGAEPRRLDIPGTGLAGVHHLRRLAHAERLRGVLASLGRDNGHLVIAGAGWIGLEVAAAARSYGAEVTVVEAAPTPLHGILGPELGGLFTDLHREHGVRFHFGARFTEIVGEGGMVLAVRTDDGEEHPAHDVLAAIGAAPRTALAEQAGLDLADPETGGGVAVDAALRTSDPYIYAAGDVAAADHPLLDTRLRVEHWANALNGGPAAARAMLGQDISYDRIPYFFSDQYDVGMEYSGYAPPGSYAQVVCRGDVAKREFIAFWLAADGRLLAGMNVNVWDVAESIQQLIRSGAPLEPGALADPQVPLAALLP

SEQ ID NO: 19876 - protein, 178 aa, Thermotoga maritima
MGSDKIHHHHHHMSDRPRRYKIFMDKKKRIALIAHDRRKRDLLEWVSFNLGTLSKHELYATGTTGALLQEKLGLKVHRLKSGPLGGDQQIGAMIAEGKIDVLIFFWDPLEPQAHDVDVKALIRIATVYNIPVAITRSTADFLISSPLMNDVYEKIQIDYEEELERRIRKVVEGEEEET

SEQ ID NO: 19877 - protein, 151 aa, Escherichia coli
MSIVVKNNIHWVGQRDWEVRDFHGTEYKTLRGSSYNSYLIREEKNVLIDTVDHKFSREFVQNLRNEIDLADIDYIVINHAEEDHAGALTELMAQIPDTPIYCTANAIDSINGHHHHPEWNFNVVKTGDTLDIGTANSSFLSKHQCCTGRTA

SEQ ID NO: 19878 - protein, 268 aa, Escherichia coli
MTYLTGDAVLFSNDAFGQHYCDEHLFNDEVDQTELFEQCQRYYANILTPFSRLVTPKITEILGFNLPVDMIATSHGVVWRDNPTQIVELYLKWAADYQEDRITIFYDTMSNNTRMMADAIAQGIAETDPRVAVKIFNVARSDKNEILTNVFRSKGVLVGTSTMNNVMMPKIAGLVEEMTGLRFRNKRASAFGSHGWSGGAVDRLSTRLQDAGFEMSLSLKAKWRPDQDALKLCREHGREIARQWALAPLPQSTVNTVVKRRNLCHHDG

SEQ ID NO: 19879 - protein, 377 aa, Escherichia coli
MSNGIVIIGSGFAARQLVKNIRKQDATIPLTLIAADSMDEYNKPDLSHVISQGQRADDLTRQTAGEFAEQFNLHLFPQTWVTDIDAEARVVKSQNNQWQYDKLVLATGASAFVPPVPGRELMLTLNSQQEYRACETQLRDARRVLIVGGGLIGSELAMDFCRAGKAVTLIDNAASILASLMPPEVSSRLQHRLTEMGVHLLLKSQLQGLEKTDSGIQATLDRQRNIEVDAVIAATGLRPETALARRAGLTINRGVCVDSYLQTNNTDIYALGDCAEINGQVLPFLQPIQLSAMVLAKNLLGNNTPLKLPAMLVKIKTPELPLHLAGETQRQDLRWQINTERQGMVARGVDDADQLRAFVVSEDRMKEAFGLLKTLPM

SEQ ID NO: 19880 - protein, 51 aa, Glycine max
MQVSASKVLQETCNYIRSLHREVDDLSERLSELLATTDTAQAAIIRNLLMQ

SEQ ID NO: 19881 - protein, 410 aa, Streptomyces tubercidicus
MAQNTAFIIAGAGLAGAKAAETLRAEGFGGPVLLLGDERERPYERPPLSKGYLLGTSEREKAYVHPPQWYAEHDVDLRLGNAVTALDPAGHEVTLADGSRLGYAKLLLATGSTPRRLPVPGADLDGVHTLRYLADSDRLKDLFRSASRIVVIGGGWIGLETTAAARAAGVEVTVLESAPLPLLGVLGREVAQVFADLHTEHGVALRCDTQVTEITGTNGAVDGVRLADGTRIAADAVIVGVGITPNSETAAAAGLKVDNGVVVDERLCSSHPDIYAAGDVANAYHPLLGKHLRVEHWANALHQPKTAARAMLGGEAGYDRLPYFFTDQYDLGMEYTGHVEPGGYDRVVFRGDTGAREFIAFWLSGGRVLAGMNVNVWDVTDPIRALVASGRAVDPERLADADVPLADLVP

SEQ ID NO: 19882 - protein, 98 aa, Bacteroides fragilis
MEKFEDLIQSQSPVLVDFFAEWCGPCKAMKPILEDLKQQVGEKARIVKIDVDTHEELAVKYRIQAVPTFILFKKGEAVWRHSGMIQASELKGVIEQYT

SEQ ID NO: 19883 - protein, 299 aa, Zea mays
MDATAQRAMAVDTSNAPTTSCSSSSCTSSSSLVNEAPQEVPCKKSKGTNKRKRASSPDSQEVEANNNGSGNNSNGQQGEESSSCCSTEDNEASASVGEKAEAAAAATATGAASRSRSGYKHPSYRGVRRRSWGKWVSEIREPRKKSRIWLGTFPTAEMAARAHDVAALAIKGRGAHLNFPERAHELPRPASTSPADVQAAAALAAAADFPLPPSPGGANAKSPESSSSGSASASASDDASAASPAAPQDAEPNPDDALFDLPDLLLDLRCCGPSSWAVDDDVAGGGAFRIIEEPLLWEY

SEQ ID NO: 19884 - protein, 561 aa, Sulfolobus solfataricus
MTFGYKLDEDGVTFNLWAPYQRKVKLKILNRGIYEMERDDKGYFTITLDNVRVGDRYKYILDDNSEVPDPASRYQPEGVHGYSEIISPDFEWDDENSVKVKREDLVIYELHIGTFTSEGTFEGVIKKLNYLKELGVTAIEIMPIAQFPGKKDWGYDGVYLYAVQNSYGGPSGFRKLVNEAHKLGLAVILDVVYNHVGPEGNYMVKLGPYFSEKYKTPWGLTFNFDDAGSDEVRKFILENVEYWINEFHVDGFRLDAVHAIIDNSPKHILEDIADVVHKYDKIVIAESDLNDPRVVNPKEKCGYNIDAQWVDDFHHAIHAFLTGERQGYYSDFGSIGDIVKSYKDVFIYDGKYSNFRRKTHGKSVGDLDGCKFVVYIQNHDQVGNRGGGERLIKLVDKESYKIAAALYILSPYIPMIFMGEEYGEENPFYYFSDFSDPKLIQGVREGRRRENGQETDPQSDCTFNDSKLSWKINDDILSFYKSLIKIRKEYGLACNRKLSVENGNYWLTVKGNGCLAVYVFSKSVIEMKYSGTLVLSSNSSFPSQITESKYELDKGFALYKL

SEQ ID NO: 19885 - protein, 488 aa, Bacillus cereus
MNSATNQATSKTETTKGKGELRRGLKSRHLTMISLGGTIGTGLFLASGGVIHSAGPGGALIAYAAIGIMVYFLMTSLAELAAYMPVTGSFSTYATKFVDPSLGFALGWNYWYNWAITIAAELAAVTLIMKFWFPNTPSLIWSGLCLAIIFLLNYLSVKGFGESEYWFALIKVVTIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLKDLPYKAKWFPFGPLFAFTLCIIVILGQNYGAFMGESIDWNGVLVSYIGLPLFLVLWLGYKFTKKTKVIPLDKCELK

SEQ ID NO: 19886 - protein, 718 aa, Sulfolobus solfataricus
MALFFRTRDRPLRPGDPYPLGSNWIEDDDGVNFSLFSENAEKVELLLYSLTNQKYPKEIIEVKNKTGDIWHVFVPGLRPGQLYAYRVYGPYKPELGLRFNPNKVLIDPYAKAINGSVIWNDAVFGYKIGDQNQDLTYDERDSGEYVPKSVVINPYFEWDDEDFIKGKKVPLKDTVIYEVHVKGFTKLRLDLPENIRGTYEGLASEQMISYLKDLGITTVELMPVFHFIDQRFLTDKGLTNYWGYDPINFFSPECRYSSTGCLGGQVLSFKKMVNELHNAGIEVIIDVVYNHTAEGNHLGPTLSFRGIDNTAYYMLQPDNKRYYLDFTGTGNTLNLSHPRVIQMVLDSLRYWVTEMHVDGFRFDLAAALARELYSVNMLNTFFIALQQDPILSQVKLIAEPWDVGQGGYQVGNFPYQWAEWNGKYRDSIRRFWRGEALPYSEIANRLLGSPDIYLGNNKTPFASINYVTSHDGFTLEDLVSYNQKHNEANGFNNQDGMNENYSWNCGAEGPTNDQNVVICREKQKRNFMITLLVSQGTPMILGGDELSRTQRGNNNAFCQDNEITWFDWNLDERKSKFLEFVKKMIQFYRAHPAFRRERYFQGKKLFGMPLKDVTFYTLEGREVDEKTWSSPTQLVIFVLEGSVMDEINMYGERIADDSFLIILNANPNNVKVKFPKGKWELVISSYLREIKPEERIIEGEKELEIEGRTALVYRRIEL

SEQ ID NO: 19887 - protein, 469 aa, Photobacterium profundum
MDYLPIFTDLKRRPCLVVGGGDVAWRKARMLLKAGADVRVIAPVLNQAFQQAIEQQQVSHVADEFESSHLDGIFLAIAATDRKAVNALVYQSANQRQVLVNVVDDTQRCSFIIPSIIDRSPIIVAVSSSGKAPVLARLIREKLEALLPQHLGRMATIAGNFRARLAKTVTSFSARRQFWEQVFDGRFSDLVACGQEQDAKQELINLTQSTSPQGQVALIGSGPGDAGLLTLRALQLMQQADVVLYDYLVSDEVMDLVRRDAELVCVGKKAGFHSVPQEETNQLIVKYAQQGKRVVRLKGGDPFVFGRGGEELEVLFDANILFQVVPGITAAAGATAYAGIPLTHRDYAQTAMFVTGHLKAESDQMDWSTLARGKQTLVIYMGLMKSGHIQQQLLINGRAGDTPIAIIERGTQKKQKVIKGQLSELEQLAKNAESPSLIVIGEVVNLSEKLHWFGKQEQSLQQSAVVKLA

SEQ ID NO: 19888 - protein, 273 aa, Oryza sativa
MSSSSSSSASSAAAAAFRPAVVQREQQVDEEKFPAAAAAMREMVLPPVAGAAADSEQEQLCYVHCHYCDTVLVVSDLRSNHAHFLSICVHLALDSRAFLVHPWRRVLQDEISTANSPTQLLLEQHGLGGLMASAASCRNNNSPAAAAAPPPPTSQGKAAAKEPSPRTNTAVINRPPEKRQRVPSAYNRFIKDEIQRIKAGNPDISHREAFSAAAKNWAHFPHIHFGLMPDHQGLKKTSLLPQDHQRKDGLLKEGLYAAAAAAAAAANMGVAPY

SEQ ID NO: 19889 - protein, 701 aa, Pseudomonas syringae
MNPVIKKFQFGQSTVTLETGRIARQASGAVLVTVDDDVSVLVTVVGAKQADAGKGFFPLSVHYQEKTYAAGKIPGGFFKREGRPSEKETLTSRLIDRPIRPLFPEGFMNEVQVVCTVVSTSKKIDPDIAAMIGTSAALAISGIPFDGPVGAARVAFHESTGYLLNPTYEQLQASSLDMVVAGTSEAVLMVESEAKELTEDQMLGAVLFAHDEFQVVINAIKELAAEAAKPVWDWQPKPEATALLGAIRAEFGDAISQAYTITVKADRYARLGELKDQVVAKLAVEEGSPSASEVKAAFGEIEYRTVRENIVNGKPRIDGRDTRTVRPLNIEVGVLPKTHGSALFTRGETQALVVATLGTARDAQLLDTLEGEKKDPFMLHYNFPPFSVGECGRMGGAGRREIGHGRLARRSVQAMLPGADVFPYTIRVVSEITESNGSSSMASVCGASLALMDAGVPMKAPVAGIAMGLVKEGEKFAILTDILGDEDHLGDMDFKVAGTSKGVTALQMDIKIKGITEEIMEIALGQALEARLNILGQMNQIIGQSRNELSANAPTMIAMKIDTDKIRDVIGKGGATIRAICEETKASIDIEDDGSIKIFGESKEAAEAARQRVLGITAEAEIGKIYVGKVERIVDFGAFVNILPGKDGLVHISMLSDARVEKVTDILKEGQEVEVLVLDVDNRGRIKLSIKDVAAAKASGV

SEQ ID NO: 19890 - protein, 97 aa, Oryza sativa
  misc_feature (79)..(79): Xaa can be any naturally occurring amino acid
MAAMATTASSLLKTSFAGARLPAAVRNPTVSVAPRTGGAICNSISSSSSTLPYDLNAIRFSPIKEDIVSREMTPGHMTXMITYADTYFVGARADSSG

SEQ ID NO: 19891 - protein, 371 aa, Epilobium canum
ERVRNGSWVGATGKELKDVIAVGIGGSFLGPLFVHTALQTDPEASKNARGRELRFLANVDPIDAARNLSGLNPETTLVVVVSKTFTTAETMLNARTVREWISSALGPSAVAKHMVAVSTNLQLVETFGIDPNNAFAFWDWVGGRYSVCSAVGVLPLSLQYGFAVVEKFLQGAHSIDQHFLSAPFEKNIPVLLGLLSVWNVSFLGYPARAILPYSQALEKLAPHIQQVSMESNGKSVSIDGLPLPFETGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSVSILLPTLDAYRVGQLLAIYEHRVAVQGFI

SEQ ID NO: 19892 - protein, 407 aa, Moorella thermoacetica
MRYLIIGNSAAGVAAARAIRQADPAGEITMVGDEPYPFYARVLTSYYLGGLVPRDRLWLVDREWYRRQRIQLLTGRRATGLNTGACRVTLDDGTELAYDRLLIATGASPQRVDFPGAGLAGVFTLRTIDDAAAIGKFARPGGRAVVIGGGLVGLKAAEGLHARGLKVRLVVSSGRLLSQAMDDSGAELVRRAMAAAGFTIHLREDVVALEGRERVMAAVLRSGATVPVDVAVVGKGVRPNVDFLSGSGVVVNRGVVVDDYLSTGIPGVYAAGDVAEAYDRAWQKPRLNAIWGNAVEQGRLAGLNMAGHHTPYRGGIGQNSLVVHGLGVISGGIVNPPGEGYEVITRLDEKRSLYRKIVLQGRRLVGMVSVGPPNGAGSFQALIGREVKEKYIASFLDGSFTWAMVGR

SEQ ID NO: 19893 - protein, 115 aa, Triticum aestivum
MGSEANGGAAAIDLLRSAAPFLPDADLLLTPGTGLVLVDLVNGFCTVGAGNLAPVTPNKQIEKMVEESTRLAKVFCQRNWPVFAFLDTHHPDKPERFSAELYIVVKEICSLVISN

SEQ ID NO: 19894 - protein, 371 aa, Epilobium canum
ERVRNGSWVGATGKQLKDVIAVGIGGSFLGPLFVHTALQTDPEASKNARGRKLRFLANVDPIDAARNISGLNPETTLVVVVSKTFTTAETMLNARTLREWISSALGPSAVAKHMVAVSTNLQLVEKFGIDPYNAFAFWDWVGGRYSVCSAVGVLPLSLQYGFAVVEKFLQGAHSIDQHFSSAPFEKNLPVLLGLLSVWNVSFFGYPARAILPYSQALEKLAPHIQQVSMESNGKGVSIDGLPLTFESGEIDFGEPGTNGQHSFYQLIHQGRVIPCDFIGVVKSQQPVYLKGEVVNNHDELMSNFFAQPDALAYGKTPEQLKKENVAEHLIPHKTFTGNRPSLSILLPTLDAYRIGQLLAIYEHRVAVQGFI

SEQ ID NO: 19895 - protein, 584 aa, Unknown
  Synechococcus sp. CC9311
MTSRPIGVSTSWNGAGVMTKQQPWWNGAVIYQLIVRSYADGNGDGIGDLQGLANRLPYLRWLGVEAIWLTPIYPSPLQDGGYDITDFKSIHPELGDLAAFHRVLIAAHSHGIKVVMDLVLNHTSTLHPWFQRARWAPEGSPERDVYVWSDDPKRYADAPVLFRHFESSNWEWDEVAQQYYLHRFLRHQPDLNYDSPVVQEEMLDVVDFWIERGVDGFRLDAVPFLCEAEGSRCEGLPETHEFLKRLRARVDRHGKDVLLLAEAIQPVEEAAPYLADDELHGAFNFALTAHLFASIASGTVEALRECLQAAQNAVGGCRWALPLRNHDELWLGDGHLVPEEVIQTIRAGLHQGQGHWLNWGINRRLAPLLNGDPGSNRVMHALLYSLPGLPCLYYGDELGMGDWPGLRDRDPNRTPMAWTPGRNGGFSTAPDPLLVLPPITAPGYDYRVVNVEVQKQLPGSLLNWHRRMLTCRKLLPALRNGDFELLDCAHPGVIVYVRTNATMTVLVAANLSAAGASFRLDLSRWAGERTREVLWGCDFPPADADWFVYLAAHGFSWWLIGEVEETDNTSEDIDAQQDKLSSGV

SEQ ID NO: 19896 - protein, 240 aa, Ashbya gossypii
MELRTRPDSASSETTTSSKMARRPARCYRYQKNKPYPKSRYNRAVPDSKIRIYDLGKKKATVDEFPLCVHLVSNELEQLSSEALEAARICANKYITKMTGRDSFHLRVRVHPFHVLRINKMLSCAGADRLQQGMRGAWGKPHGLAARVDIGQIIFSVRTKDNNKDIVVEALRRARYKFPGQQKIIMSKKWGFTNLDRAEYVRRRDAGEVKDDGAFVKFLSKKGALENNFREFPEYFTAQA

SEQ ID NO: 19897 - protein, 348 aa, Caulobacter crescentus
MSPLRRIHTISPPMSTLSPRQTRCLIIGSGPAGYTAAIYAARALLKPVLIAGIQPGGQLTITTDVENYPGFADVIQGPWLMDQMRAQAEHVGTEFVSDIVTSVDLSKRPFTVKTDSGQDWIAETIIIATGAQAKWLGLESEAKFQGFGVSACATCDGFFYRNKDVIVVGGGNTAVEEALFLTSFASKVTLVHRKDELRAEKILQERLLAHPKIEVIWDSVIDEVLGQTDPMGVTGARLKNVKTGETQEVAADGVFIAIGHAPSSELFAGQLETGSGGYLKVKPGTASTAIEGVYAAGDVTDDVYRQAVTAAGMGCMAALEAVRFLAEEDHKAAHHPISHAEANKIGVW

SEQ ID NO: 19898 - protein, 330 aa, Unknown
  Candidatus Protochlamydia amoebophila UWE25
MSQPIKIAISGGAGQIAYSLLFRLASGELFGPNQLIELQVLEVPNALSALEGVKMEIEDCAFPLLSSIKICSDPYQAFEDIDYALLIGAKSRGPGMERRDLLQENSKIFVNQGQALNAVAKSSAKIFVVGNPCNTNCLIALNNAPSLKRENFYAMTRLDQNRATFFLSQKSQVSTKDVSCVTIWGNHSATQVPDFVNAKISQKPVETIIPDRQWLEKDFIESVQKRGAAIIQARGKSSAASAASALLDAMRDRILPTPTGQWFSTALLSDGNPYGIEEGLIFSFPCRVKKNGELSIVSGLKWDAFLEEKIKLTEQELKEEREMVSSILKI

SEQ ID NO: 19899 - protein, 371 aa, Epilobium brachycarpum
ERVRNGSWVGATGKELKDVIAVGIGGSFLGPLFVHTALQTDPEASKNAKGRELRFLANVDPIDAARNLSSLNPETTLVVVVSKTFTTAETMLNARTVREWISSALGPSAVAKHMVAVSTNLPLVEKFGIDPNNAFAFWDWVGGRYSVCSAVGVLPLSLQYGFSVVEKFLQGAHSIDQHFSSAPFEKNIPVLLGLLSVWNVSFLGYPARAILPYSQALEKLAPHIQQVSMESNGKGVSIDGLPLPFETGEIDFGEPGTNGQHSFYQLIHQGRVIPCDFIGVVKSQQPIYLKGEVVNNHDELMSNFFAQPDALAYGKTPEQLKKENVSEHLIPHKTFTGNRPSVSILLPTLDAYRVGQLLAIYEHRVAVQGFI

SEQ ID NO: 19900 - protein, 463 aa, Glycine max
PRVRESQANGVHSSKHDDDGRLKRRGTWLTATSHIVTAVIGSGVLSLAWAVAQLGWIAGPAILTIFSVITVFTSSLLSDCYRYPDSVHGTRNHNYREMVKNILGGRKYLFCGLAQFANLIGTGIGYTVTASISMVAVIRSNCFHKYGHEAKCHTSNYPYMTIFAVIQILLSQIPDFQELSGLSIIAAVMSFGYSSIGIGLSIAKIAGGNDAKTSLTGLIVGEDVTSQEKLWNTFQAIGNIAFAYAFSQVLVEIQDTLKSSPPENQAMKKATLAGCSITSLFYMLCGLLGYAAFGNKAPGNFLTGFGFYEPYWLVDIGNVFVFVHLVGAYQVFTQPVFQLVETWVAKRWPESNFMGKEYRVGKFRFNGFRMIWRTVYVIFTAVVAMILPFFNSIVGLLGAISFFPLTVYFPTEMYLVQAKVPKFSLVWIGVKILSGFCLIVTLVAAAGSIQGIIADLRIYEPFK

SEQ ID NO: 19901 - protein, 373 aa, Epilobium brachycarpum
ERVRNGSWVGATGKQLKDVIAVGIGGSFLGPLFVHTALQTDPEASKNASGRKLRFLANVDPIDAARNISGLNPETTLVVVVSKTFTTAETMLNARTLREWISSALGPSAVAKHMVAVSTNLQLVEKFGIDPYNAFAFWDWVGGRYSVCSAVGVLPLSLQYGFAVVEKFLQGAHSIDQHFSSAPFEKNLPVLLGLLSVWNVSFFGYPARAILPYSQALEKLAPHIQQVSMESNGKGVSIDGLPLPFESGEIDFGEPGTNGQHSFYQLIHQGRVIPCDFIGVVKSQQPIYLKGEVVNNHDELMSNFFAQPDALAYGKTPEQLKKENVAEHLIPHKTFTGNRPSLSILLPTLDAYRIGQLLAIYEHRVAVQGFIWG

SEQ ID NO: 19902 - protein, 1050 aa, Cymodocea nodosa
MAAVEDGALPYRKLLEEVNGTVTGEGRSESTPQDGIIFVGVSLVLGIASRHMLRGTRVPYTVALLLLGIGLGALEFQTSNGLGKLGSGIRLWSHINPELLLGVFLPALLFESSFGMEVHQIKKCLAQMILLAGPGVIASTFCLGSLLKLTFPYNWDWKTSLLLGGLLSATDPVAVVALLKDLGASKKLNTIIEGESLMNDGTAIVVYQLFYDMVLGQEFSAGSIIKFLCEVSLGAVAVGLAFGIVSVLWLHYIFNDTVIEVTLTLAVSYIAFYTSQDAIKVSGVLSVMTLGMFYAVAARTAFKGETHESLHHFWELVSYIANTLIFILSGVVIGENVMSDKSSFESDGAKWGYLILLYVYVQLSRATVVGILFPFLRYFGYGLGLKEAAILIWSGLRGAVALALSLSVKRAGDSLESPSLKQDVGTSFVFFTGGIVLLTLIINGSTTQFLLHFFAMDKLPDAKIRILNYTKYEMLNKAMETFDDLGDDEDLGPVDWPTVKKYITCLNDLEGVQENPHTISESENQLHDMNLSDTRVRLLNGVQAAYWEMLEEGRITQTTGILLMQSVDEAMDTVSHETLCDWKALKAHVHFPKYYKFLQMSRIPQGLVTYFTVERLESACYISAAFLRAHRIARRQLREFIGESEIATAVINESEEEGQEARNFLEDVRISFPQVLCAVKAKQVTYSVLKNLSEYVQTLEKIGLLEEKEMLQLDDAVQTDLKKLLRKPPSVVMPKLKDLLDRHPLLGVLYKQVQVPFEKSTKEIMKTEGRTLYREGSKPKGIWLISSGVFKWASTTLSSRQSLHPDFLHGSPLGLYEVLAGKRFICDMVTDSLVHCFFIKAEKILPLLRSDPEVEELLWRESSIVIAKLLLPLVFENLPLQEVQGLLNERSRMDTYVSGESIEIPHNSVCILLEGSLESQDAHRSLIASPAVLLPSNVAPSFLNLESSGTVPASCCHRGNSYMVEAIARVVRFEIGANERRSPPQWRQSLCMPQSVGPQRLPVREQCGLLSWPENLQRARSHPQVLNAYGHQANNMSARGTGLHNFRSMV

SEQ ID NO: 19903 - protein, 92 aa, Oxalis oblongiformis
  misc_feature (91)..(92): Xaa can be any naturally occurring amino acid
GINISGTNGEVMPGQWEYQVGPSVGIEAGDHIWASRYILERITEQAGVVLTLDPKPIDGDWNGAGCHTNYSTKSMRDEGGFEVIKKAIFNXX

SEQ ID NO: 19904 - protein, 322 aa, Unknown
  Synechococcus sp. CC9311
MPIASDITALVGRTPLVRLNQLPQRSGCLAELVAKLESFNPTASVKDRIAGSMVQAAEEAGTISPERTVLIEPTSGNTGIALAMVAAARGYRLILTMPDTMSTERRAMLRAYGAELQLTPGNEGMQGALDLAVELVSEIPHAYLLQQFDNAANPAVHAATTAEEIWMDTDGQIDALVAGVGTGGTITGCARVLKQRNPDLKVIAVEPAGSPVLAGGAPGPHRIQGIGAGFVPAVFDQSLIDEILGVSDQEAMEVGRRLAREEGLLSGVSSGAAVAAAIRIGQRPEMAGKRIVVILASFGERYLSTPMFSASAATPAWRDGQL

SEQ ID NO: 19905 - protein, 460 aa, Lactobacillus plantarum
MSKQTHLSRQMESRHVLMISLGGVIGTGLFLSSGYTIHQAGPIGTLLAYTIGAILVYLVMLCLGELSVAMPYTGAFHVYAKKYIGPGTGFTVAILYWLTWTIALGSEFTAAGLIMQTWFPHIATWIWSLVFMVVIFTVNALSVRWFAETEFWFASIKVIAIIAFIVLGGLAMVGILPLHGHTSAPFLSNYTRNGWFPNGFGGVFTTMLTVNFAFSGTELIGITAGETKDPAHTIPTAIKTTLWRLIIFFIGSMFVMAALIPYKQAGVTQSPFVLVFKAIGIPYAADLMNFVVLTAIMSAANSGLYASTRMLWSLANEGTIPKVFKRTTKRDVPLVALITSMLGGILALLSSVYAAGSVYLVLVSISGLAVVIVWMAIALSEINFRKAYLKSGQSLDQLTFKTPGYPVVPWLAFILSGLSCILIWFDPNQRIALYYTIPFVAICYLGYYLNQRYRRTHAAK

SEQ ID NO: 19906 - protein, 410 aa, Thermotoga maritima
  misc_feature (13)..(13): Xaa can be any naturally occurring amino acid
  misc_feature (158)..(158): Xaa can be any naturally occurring amino acid
  misc_feature (168)..(168): Xaa can be any naturally occurring amino acid
  misc_feature (275)..(275): Xaa can be any naturally occurring amino acid
  misc_feature (283)..(283): Xaa can be any naturally occurring amino acid
  misc_feature (338)..(338): Xaa can be any naturally occurring amino acid
  misc_feature (393)..(393): Xaa can be any naturally occurring amino acid
MGSDKIHHHHHHXPKIWTERIFDDPEIYVLRIDDDRIRYFEAVWEIPEGISYNAYLVKLNGANVLIDGWKGNYAKEFIDALSKIVDPKEITHIIVNHTEPDHSGSLPATLKTIGHDVEIIASNFGKRLLEGFYGIKDVTVVKDGEEREIGGKKFKFVXTPWLHWPDTXVTYLDGILFSCDVGGGYLLPEILDDSNESVVERYLPHVTKYIVTVIGHYKNYILEGAEKLSSLKIKALLPGHGLIWKKDPQRLLNHYVSVAKGDPKKGKVTVIYDSXYGFVENVXKKAIDSLKEKGFTPVVYKFSDEERPAISEILKDIPDSEALIFGVSTYEAEIHPLXRFTLLEIIDKANYEKPVLVFGVHGWAPSAERTAGELLKETKFRILSFTEIKGSNXDERKIEEAISLLKKELE

SEQ ID NO: 19907 - protein, 256 aa, Pinus ponderosa
  misc_feature (189)..(189): Xaa can be any naturally occurring amino acid
CGIGSCAFAGGQISSLKPHTNQLLGVGAGVHGEARVTMRKATTKKVSVSASTSPWYGPDRVLYLGPFSGEPPSYLTGEFPGDYGWDTAGLSADPETFAKNRELEVIHCRWAMLGALGCVFPELLARNGVKFGEAVWFKAGAQIFSEGGLDYLGNPSLVHAQSILAIWACQVILMGAVEGYRIAGGPLGXVTDPIYPGGSFDPLGLADDPDAFAELKVKEIKNGRLAMFSMFGFFVQAIVTGKGPIENLADHLADPV

SEQ ID NO: 19908 - protein, 84 aa, Pisum sativum
MCGILAVLGCSDDSQAKRVRILELSRRLKHRGPDWSGLHQHGDNYLAHQRLAIVDPASGDQPLFNEDKSIIVTVNGEIYNHEEL

SEQ ID NO: 19909 - protein, 256 aa, Pinus radiata
CGIGSCAFAGGQISSLKPHTNQLLGVGAGVHGEARVMMRKATTKKVSVSASTSPWYGPDRVLYLGPFSGEPPSYLTGEFPGDYGWDTAGLSADPETFAKNRELEVIHCRWAMLGALGCVFPELLARNGVKFGEAVWFKAGAQIFSEGGLDYLGNPSLVHAQSILAIWACQVILMGAVEGYRIAGGPLGEVTDPIYPGGSFDPLGLADDPDAFAELKVKEIKNGRLAMFSMFGFFVQAIVTGKGPIENLADHLADPV

SEQ ID NO: 19910 - protein, 84 aa, Pisum sativum
MCGILAVLGCSDPSRAKRVRVLELSRRLKHRGPDWSGLHQHGDCFLAHQRLAIVDPASGDQPLFNEDNPSIVTVNGELYNHEDL

SEQ ID NO: 19911 - protein, 455 aa, Synechococcus elongatus
MSSSAVLTWRQGDRLSLTIESLCDSGDGLGRVEGRVVFVPDTVPGDRIQAKLLQVRSRYARAELEEVLEASPDRIRPACIVADKCGGCQWQTVDYPAQVEAKTVIVQDAMQRLGQLETEVQPTIAAPYPLGYRNKVSYPLRRSDRGEVQAGYFRKGSHRLINLNQCPVQDDRLNPLLAGIKADIAARDWPIYDEQTRSRGLRHLGLRIGQRTGEILITLIATDDQLPEVEAQAEQWLTDYPNVVGVCLNLNPSHGNRILGDETHCLAGRPYLIECLDDLEFAIGPETFFQVNTEQAERLLPILKDFLRGSDRLFDLYCGVGTLTLPLASEVGSVLGLEILPESVVQAQQNADRNGISNVEFRAGAVEILLAQIPESPDAVLLDPPRKGCEPAVIEVLRDRQPQRIAYVSCNPATLARDLQALCAGDRYRLLLVQPLDFFPQTAHVETVALLELQD

SEQ ID NO: 19912 - protein, 256 aa, Pinus contorta
CGIGSCAFAGGQISSLKPHTNQLLGVGAGVHGEARVTMRKATTKKVSVPASTSPWYGPDRVLYLGPFSGEPPSYLTGEFPGDYGWDTAGLSADPETFAKNRELEVIHSRWAMLGALGCVFPELLARNGVKFGEAVWFKAGAQIFSEGGLDYLGNPSLVHAQSILAIWACQVILMGAVEGYRIAGGPLREVTDPIYPGGSFDPLGLADDPDAFAELKVKEIKNGRLAMFSMFGFFVQAIVTGKGPIENLADHLADPV

SEQ ID NO: 19913 - protein, 702 aa, Shewanella oneidensis
MGHVNPIVKSFEYGQHTVTLETGVIARQADAAVLASMGDTTVLVTVVGKKEAEAGRDFFPLTVNYQEKTYAAGKIPGGFFKREGRPSEEETLIARLIDRPIRPLFPNGFKNEVQVIITVVSVDPEIEPDIISMIGTSAALAISGIPFNGPLGAARVGYINGEYVLNPTVKQIGASQLNLVVAGTESAVLMVESEAQALPEEVMLGSVVYGHDQQQVVIKAIAEFKAEAGKPTWDWTAPVEDEALVAQIKELAEAGFIEAYQIQVKQERYAQVAVVKAAAKEALLAANPDVDLREVDNLLGSLEKKVVRGRILRGMPRIDGREPDMVRALSVLAGVLPRTHGSALFTRGETQALVTCTLGTERDAQKIDSIMGERTNRFMLHYNFPPYSVGETGMVGSPKRREIGHGKLAWRGINAVMPSAEEFPYSVRVVSEITESNGSSSMASVCGTSLALMDAGVPIKTSVAGIAMGLVKEGDDFVVLSDILGDEDHLGDMDFKVAGTRDGVTALQMDIKIEGITKEIMEIALQQAYGARVHILNVMDQAIGSHRADISDHAPRITTIKINPEKIRDVIGKGGAVIRALTEETGTTIELEDDGTVKIASSNGEATKEAIRRIEEITSEVEVGRIYNGKVIRIVDFGAFVNILPGKDGLVHISQISDERVANVSDHLELNQEVTVKVMEVDRQGRVRLSIKEAQTKEPAAE

SEQ ID NO: 19914 - protein, 128 aa, Mesostigma viride
MQAVAMSVSVPSVAAFAPALPQRLVARKPQAAARVPAKCARKAVVCQAQKNEAAVAVSAAAIASSVAFAAPAQAIIEDAMYTEGAGIALGLNSGALGFVMLGAFTLVWSLYSSYTRSLDSSEDGGLDL

SEQ ID NO: 19915 - protein, 256 aa, Pinus merkusii
CGIGSCAFAGGQISSLKPHTNQLLGVGAGVHGEARVTMRKATTKKVSASASTSPWYGPDRVLYLGPFSGEPPSYLTGEFPGDYGWDTAGLSADPETFAKNRELEVIHCRWAMLGALGCVFPELLARNGVKFGEAVWFKAGAQIFSEGGLDYLGNPSLVHAQSILAIWACQVILMGAVEGYRIAGGPLGEVTDPIYPGGSFDPLGLADDPDAFAELKVKEIKNGRLAMFSMFGFFVQAIVTGKGPIENLADHLADPV

SEQ ID NO: 19916 - protein, 256 aa, Pinus roxburghii
CGIGSCAFAGGQISSLKPHTNQLLGVGAGVHGEARVTMRKAATKKVSVSASTSPWYGPDRVLYLGPFSGEPPSYLTGEFPGDYGWDTAGLSADPETFAKNRELEVIHCRWAMLGALGCVFPELLARNGVKFGEAVWFKAGAQIFSEGGLDYLGNPSLVHAQSILAIWACQVILMGAVEGYRIAGGPLGEVTDPIYPGGSFDPLRLADDPDAFAELKVKEIKNGRLAMFSMFGFFVQAIVTGKGPIENLADHLADPV

SEQ ID NO: 19917 - protein, 402 aa, Bacteroides fragilis
MEKNIFKLDNEQLKGIAHAFREKVEEGLNKNNAEIQCIPTFILPKATDVKGKALVLDLGGTNYRVAIVDFSTEKPIIYPNNGWKKDMSIMKSPGYTREELFKELADLIVEIKREEEMPIGYCFSYPTESIPGGDARLLRWTKGVDIREMVGQFVGKPLLDYLNEKNKIRFTGVKVLNDTIASLFAGLTDKSYDAYIGLIVGTGTNMATFIPSDKITKLDPECHVQGLIPVNLESGNFYPPFLTAVDDTVDATSDSLGKQRFEKAVSGMYLGDILKAAFPLEEFEEKFDARKLTAIMNYPDIHKDIYVQVAHWIYNRSAQLVAASLAGLIALLKSYNRDIHRVCLIAEGSLFWSESRKDKNYNILVMEKLQELLRELELEDVEVHINSMDNANLIGTGIAALS

SEQ ID NO: 19918 - protein, 472 aa, Escherichia coli
MITHLVWFRQDLRLHDNLALAAACRNSSARVLALYIATPRQWATHNMSPRQAELINAQLNGLQIALAEKGIPLLFREVDDFVASVEIVKQVCAENSVTHLFYNYQYEVNERARDVEVERALRNVVCEGFDDSVILPPGAVMTGNHEMYKVFTPFKNAWLKRLREGMPECVAAPKVRSSGSIEPAPSITLNYPRQSFDTAHFPVEEKAAIAQLRQFCQNGAGEYEQQRDFPAVEGTSRLSASLATGGLSPRQCLHRLLAEQPQALDGGAGSVWLSELIWREFYRHLMTYYPSLCKHCPFIAWTDRVQWQSNPAHLQAWQEGKTGYPIVDAAMRQLNSTGWMHNRLRMITASFLVKDLLIDWREGERYFMSQLIDGDLAANNGGWQWAASTGTDAAPYFRIFNPTTQGEKFDREGEFIRRWLPELRDVPGKAVHEPWKWAQKAGVMLDYPQPIVDHKEARLRTLAAYEEARKGA

SEQ ID NO: 19919 - protein, 340 aa, Nostoc punctiforme
MELAMIGLGRMGANMAQRLMRAGHHVVGYVRRTEKLSAMVNEGVIAAGASSIADLVSKLSKPRTVWLMVPAASVDETIETLIPLLEPDDIIIDGGNSYYHDDIRRAATLKDRGIHYVDCGTSGGVWGLERGYCLMIGGEQVAIKRLDPIFATLAPGVGEIDRTPGREKAGGTAEQGYLHCGPIGAGHFVKMVHNGIEYGVMAAYAEGLNILHHANIGNNQREIDAETTPLRNPEHYQYDFNLGDIAEVWRRGSVIASWLLDLTAIALLESPNLERFGGRVSDSGEGRWSAIAAIDESVPTPVLSAALFARFSSRGEADFADKLLSAMRYQFGGHYEKANS

SEQ ID NO: 19920 - protein, 374 aa, Bacteroides fragilis
MKKKVLFIDRDGTLVIEPPVDYQLDSLEKLEFYPKVFRNLGFIRSKLDFEFVMVTNQDGLGTSSFPEETFWPAHNLMLKTLAGEGITFDDILIDRSMPEDCASTRKPRTGMLTKYISNPEYDLEGSFVIGDRPTDVELAKNIGCRAIYLQESIDLLKEKGLETYCALATTDWDRVAEFLFAGERRAEIRRTTKETDILVALNLDGKGTCDISTGLGFFDHMLEQIGKHSGMDLTIRVKGDLEVDEHHTIEDTAIALGECIYQALGSKRGIERYGYALPMDDCLCRVCLDFGGRPWLVWDAEFKREKIGEMPTEMFLHFFKSLSDAAKMNLNIKAEGQNEHHKIEGIFKALARALKMALKRDIYHFELPSSKGVL

SEQ ID NO: 19921 - protein, 457 aa, Oryza sativa
MEWVRGKCVGRGAFGAVHVAVDRATGRAFAVKSVEAKGGAPAAAMACLESEIRILRRLSSPYVVEYLGDDGDAATTRNLHMELVPGGSAAAAAAMGGLGERGARGVVRRVAAALRYLHDVAGVVHGDVKGRNVLVGCDGDGRGAKLADFGAARLVSDAAVSRGPRGTPAWMAPEVARGGAPTPASDVWSLGCTAVELITGKRPWSELGGASEVGELLFLIGFGGKRPELPACASDSCRDFLDKCLRRDAGERWTCDQLLRHPFLSAADVHDGGEPSPFPSPRAVLDWAAASMSDSDSDDSGGAEARSEHEMMARAKGRLVELASNASWGREWGAGPTWEAADTWAPPSSPDTTATNAPVPSNPAAVADAGGPPAVIAGGRDSVLAVATAGAGRDRCDSQHGHYKCELARTRRARLAVASVAAVMYSYLIDSIIFWVQFKPPFSLQYFGPILFFFRCI

SEQ ID NO: 19922 - protein, 503 aa, Oryza sativa
MALATSTLPFAPSNPSPSSRSAAAAFSPRGGVHFAAARSGLPLACAAPRHRGRPPPRRRRGGCLVVWASADYYATLGVPRSASNKDIKAAYRKLARQCSGFPFRVRTPLSLVLAVLTLTPSTLKIPMPSSVDEWRERAMLEQPTLVPVAATLYHPDVNKEPGATDKFKEISAAYEVLSDEKKRALYDQYGEAGVRSAVGGSAGAYTSNPFDLFETFFGASMGGFSGMDQGTFRTRRRSTAVQGEDIRYDVNLGFSEAIFGTEKDIILSHLETCDACAGSGSKIGSKMRICSTCGGRGQVMRTEQTPFGLFSQVSICPTCAGEGEVISEYCKKCAGEGRVRVRKEIKVKIPPGVSKGSTLRVRGEGDAGPKGGPPGDLFVCLDIEEPADIKRDGINLYSTVSVSYIEAILGTVKKVRTVDGNSELRIPPSGREKELLEELASLSNGGFARAPVKPKSIRQENETTVAQENSDQPDEGEGDWLKKLQDFAGSIANGAAKWLKDNL

SEQ ID NO: 19923 - protein, 281 aa, Megacorax gracielanus
ERVRNGSWVGATGKELKDVIAVGIGGSFLGPLFVHTALQTDQEASKNARDRELRFLANVDPIDVARNISGLNPETTLVVVVSKTFTTAETMLNARTLREWISSVLGTSAVAKHMVAVSTNLPLVEKFGIDPNNAFAFWDWVGGRYSVCSAVGVLPLSLQYGFAVVEKFLQGAHSIDQHFSSAPFEKNIPALLGLLSVWNVSFLGYPARAILPYSQALEKLAPHIQQVSMESNGKGVSIDGLPLPFETGEIDFGEPGTNGQHSFYQLIHQGRVIPCDFIGVV

SEQ ID NO: 19924 - protein, 371 aa, Hauya elegans
ERVRNGSWVGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLHYGFAVVEKFLQGAHNIDQHFSSAPFEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGVVRSQQPVYLKGEVVNNHDELMSNFFAQPDALAYGKTPEQLQKENVPQHLIPHKTFTGNRPSLSILLPSLDAYRIGQLLAIYEHRVAVQGFI

SEQ ID NO: 19925 - protein, 316 aa, Unknown
  Synechococcus sp. CC9311
MGTPGTVLITGTTSGVGLNATQALVRQGWTVITANRNPQRAAGAADQLDIPRGRLHHILMDLGDLESVRHAVENLSIGIDALVCNAAVYEPKLKQPKRSPQGYELSMATNHLGHFLLIQLLLDRLKASSHPSKRIVILGTVTANSKELGGKIPIPAPADLGDLSGFEAGFQDPVSMASGQLFKPGKAYKDSKLCNMITTQELHRRIYADTGISCTSLYPGCVADTPLFRNTPKAFQVIFPWFQKKITGGYVSQSLAGERVAMVVANPAFNQSGVHWSWGNRQKKDGQQFSQELSDKATNPDVARRVWELSMKLVGL

SEQ ID NO: 19926 - protein, 269 aa, Lopezia grandiflora
ERVRNCSWVGATGKELKDVIAVGIGGSFLGPLFVHTALQTDQEASKNARGRELRFLANVDPIDVARNISGLNPETTLVVVVSKTFTTAETMLNARTLREWISSALGTSAVAKHMVAVSTNLPLVEKFGIDPNNAFAFWDWVGGRYSVCSAVGVVPLSLQYGFGVVEKFLQGAHSIDQHFSSAPFEKNIPVLLGLLSVWNVSFLGYPARAILPYSQALEKLAPHIQQVSMESNGKGVSIDGLPLPFETGEIDFGEPGTNGQHSFYQLIHQ

SEQ ID NO: 19927 - protein, 501 aa, Ralstonia metallidurans
MFAKIVATYRYFMSVVPFRLTPAIITTVVLVTLLLTPTPAGLKDNAWDLVAIFLTTIVAIILKVMPIGVMAMMAIVIVSLAQVTSNSSKGAIADALSSFDSPLIWLIVVAILISRGLKKTGLGSRIGLMFIALLGKRTVGIGYGLAICELVLAPFTPSNTARGGGIVHPIMRSIAGAFDSDPANGTQGKVGTYLALVNYHANPITSAMFVTATAPNPLVVDYVAKASGQSLHLSWTTWALCMLLPGLVCLLLMPLVIRVLCPPELKATPNAIEYAKGELARMGPLGGKERVMIGVFAMMLVLWANVPAMIWGPTFTLDPTVVAFLGLFALIITGTIDWDDVLSEKSAWDTLIWFGALVMLAEQLNKLGVIAWFSADMRDAIAASGMGWLSIAAILVLAFVFSHYLFASTTAHISAMMLAFLTVGAQLIPQPYIAPFMLMMTAGSAIMMTLTHYATGTSPIIFGSGYVTMGQWWRVGAVMCVFELVIFAVVGGIWWKILGFW

SEQ ID NO: 19928 - protein, 95 aa, Oxalis peduncularis
  misc_feature (87)..(87): Xaa can be any naturally occurring amino acid
LYAGINISGTNGEVMPGQWEYQVGPSVGIEAGDHIWASRYILERITEQAGVVLTLDPKPIDGDWNGAGCHTNYSTKSMRDEGGFEVXTKAIFNLS

SEQ ID NO: 19929 - protein, 128 aa, Moorella thermoacetica
MRIALIAHDRKKDDLVNFVDEHKELFAGHRLVATGTTGKRIMERTGLKVHRLMSGPLGGDQQMGSLVARGRLDLVIFLRDPLTPQPHEPDINALLRICDVHNVPAATNLATAAIFLRYMQDHPGNRQA

SEQ ID NO: 19930 - protein, 93 aa, Oxalis petrophila
AGINISGTNGEVMPGQWEYQVGPSVGIEAGDHIWASRYILERITEQAGVVLTLDPKPIDGDWNGAGCHTNYSTKSMRDEGGFEVIKKAILNLS

SEQ ID NO: 19931 - protein, 178 aa, Oryza sativa
MAAEAEQQHQLLSTAVHDTMPGKYVRPESQRPRLDLVVSDARIPVVDLASPDRAAVVSAVGDACRTHGFFQVVNHGIDAALIASVMEVGREFFRLPAEEKAKLYSDDPAKKIRLSTSFNVRKETVHNWRDYLRLHCYPLHQFVPDWPSNPPSFKEIIGTYCTEVRELGFRLYESTLKP

SEQ ID NO: 19932 - protein, 433 aa, Oryza sativa
MADQLISTADHDTLPGNYVRPEAQRPRLADVLSDASIPVVDLANPDRAKLVSQVGAACRSHGFFQVLNHGVPVELTLSVLAVAHDFFRLPVEEKAKLYSDDPAKKIRLSTSFNVRKETVHNWRDYLRLHCYPLHRYLPDWPSNPPSFREIISTYCKEVRELGFRLYGAISESLGLEQDYIKKVLGEQEQHMAVNFYPKCPEPELTFGLPAHTDPNALTILLMDQQVAGLQVLKEGRWIAVNPQPNALVINIGDQLQALSNGRYKSVWHRAVVNSDKARMSVASFLCPCNDVLIGPAQKLITDGSPAVYRNYTYDEEIISTYCKEVRELGFRLYGAISESLGLEQDYIKKVLGEQEQHMAVNFYPKCPEPELTFGLPAHTDPNALTILLMDQQVAGLQVLKEGRWIAVNPQPNALVINIGDQLQVMHISVSLSD

SEQ ID NO: 19933 - protein, 528 aa, Lactobacillus plantarum
MKFTELGLSDSLLKAVNRAGYEEATPIQAETIPMVLEGKDVIGQAQTGTGKTAAFALPILQRLDFDNHNIQALVVSPTRELAIQTQEEIFRLGKDERAKVQVVYGGADIRRQIRNLKQNPQVIVGTPGRLLDHIRRGTVKLDHVKMLVLDEADEMLNMGFLEDIESIIKQVPDERQTMLFSATMPPEIKRIGVQFMKEPHHVKIKSKEMTADTVDQYYVKAKEFEKFDIMTRLFDVQAPELTIVFGRTKRRVDELSKGLEARGYNAAGIHGDLSQQRRTQIMRQFKAGKLDILVATDVAARGLDVSGVTHVYNYDIPQDPDSYVHRIGRTGRAGHKGVSLTFVTPNEMEYLRVIEKLTKKRMLPLKPPTESEAFAGQLAAAEANVDSLVAKTSTEKYADQAAELLQKYDATDLVAALLNDLTKDDASAVPVKITPERPLPRHKGGGGNNRRGGYRGGNRNRNNSHGNGRGGYSHNGRNRDRDRNGGRGDRKSNGYKGRSRDDNRSSNRNHDEGRKQSSKRSYTIRTND

SEQ ID NO: 19934 - protein, 94 aa, Saccharomyces cerevisiae
  misc_feature (17)..(17): Xaa can be any naturally occurring amino acid
FNAKYVAEATGNFITVXDALKLNYNAKDQLHPLLAELLISINRVTRDDFENRSKLIDWIVRINKLSIGDTLTETQIRELLFDLELAYKSFYALL

SEQ ID NO: 19935 - protein, 92 aa, Oxalis nubigena
  misc_feature (2)..(2): Xaa can be any naturally occurring amino acid
  misc_feature (5)..(5): Xaa can be any naturally occurring amino acid
GXNIXGTNGEVMPGQWEYQVGPSVGIEAGDHIWASRYILERITEQAGVVLTLDPKPIDGDWNGAGCHTNYSTKSMRDEGGFEVIKKAILNLS

SEQ ID NO: 19936 - protein, 256 aa, Pinus chiapensis
CGIGSCAFAGGKISLLKPHTNQLLGVGAGVHGESRVTMRKSAAKKSFASASPSPWYGPDRVLYLGPFSGEPPSYLTGEFPGDYGWDTAGLSADPETFAKNRELEVIHSRWAMLGALGCVFPELLAKNGVKFGEAVWFKAGAQIFSEGGLDHLGNPSLIHAQSILAIWACQVILMGAVEGYRIAGGPLGEVTDPIYPGGSFDPLGLADDPDAFAELKVKELKNGRLAMFSMFGFFVQAIVTGKGPIENLADHLADPV

SEQ ID NO: 19937 - protein, 561 aa, Xanthomonas campestris
MTESFAELFEASQANLAKLKPGSIVTGTVVEVRGDVVVINAGLKSEGIVPIEQFRNDAGEINVGVGDQVKVALDSIENGFGETVLSREKAKRAMVWDELEEALEKNETITGRISGKVKGGFTVDIKDVRAFLPGSLVDVRPVRDPAYLEGKELEFKLIKLDRKRNNVVVSRRAVVESEHSEEREQLMDKLQEGAILKGVVKNLTDYGAFVDLGGIDGLLHITDMAWKRVRHPSEVVNVGDELDVRVLKFDRERNRVSLGLKQLGEDPWDNIARRYPANSRVFGKVSNVTDYGAFVEIEPGVEGLVHVSEMDWTNKNVNPSKVVQVGDEVEVMVLDVDEERRRISLGMKQVAANPWETFAATHKKNDKVSGQIKSITDFGIFIGLDGGIDGLVHLSDISWNTTGEDVVRNYKKGDTLEAVVLAVDPERERISLGVKQLEQDPFGQYMASNPKGSKVEGVVREVDAKGATIDLADGIEGYVAARDIANERVDDATQHLKVGDKIEAKFVGMDRKGRTLQLSIKAKDDAEMRETLEDYQSASASGGMTQLGALLRAQLNNNKSE

SEQ ID NO: 19938 - protein, 497 aa, Streptomyces nodosus
MTPQPPPPKADNGQAGRTGPTSPAEHGSGLQAGLKNRHLSMIAIGGVIGAGLFVGSSSGIATAGPGILLSYALVGTLVVLVMRMLGEMSAANPTSGSFSAHADRALGSWAGFSIGWLYWFFWVVVLAVEATAGAAILSSWVPAVPQWGWALIVMIVLTATNLISVGSYGEFEFWFAGIKVVAISIFIVIGLLAVFGVLPGVHADKAGLGNLTDHGGFLPHGLSAIFTGVLLVVFSFMGSEIATLAAGESEDPQRAVTKATNSIIWRIGVFYLGSVFVVVTLLPWNDKAIAEKGSYVAALDSLGIAHAGEIMKFIVLTSVLSCLNSGLYTASRMAFSLGERGDAPKAFARTNSRGVPMAAILSSVVFGFVAVFFNYRFPDSVFLFLVNSSGAVALFVWLVICFSQLRLRRIIQSEAPEKLIVKMWLYPYLTWAAAFLIILVFGYMLTDTEHDGRETVLLSMLVAVIVLAVAFIKQRVEGGRAKATEPAAAEAEKVSAG

SEQ ID NO: 19939 - protein, 107 aa, Unknown
  Nicotiana glauca x Nicotiana langsdorffii
LERSGGASVGIVVSESGWPSAGAFGATYDNAATYLKNLIQHAKEGSPRKPGPIETYIFAMFDENNKNPELEKHFGLFSPNKQPKYNLNFGVSGSVETNATASLISEM

SEQ ID NO: 19940 - protein, 256 aa, Pinus flexilis
CGIGSCAFAGGKISLLKPHTNQLLGVGAGVHGESRVTMRKSAAKKSFASASPSPWYGPDRVLYLGPFSGEPPSYLTGEFPGDYGWDTAGLSADPETFAKNRELEVIHSRWAMLGALGCVFPELLAKNGVKFGEAVWFKAGAQIFSEGGLDYLGNPSLIHAQSILAIWACQVILMGAVEGYRIAGGPLGEVTDPIYPGGSFDPLGLADDPDAFAELKVKELKNGRLAMFSMFGFFVQAIVTGKGPIENLADHLADPV

SEQ ID NO: 19941 - protein, 321 aa, Xylella fastidiosa
MSDYPASAKHSRLLILGSGPAGWTAAVYAARANLQPVLITGLQQGGQLMTTTEVDNWPGDAHGLMGPDLMERMQAHAERFETEVIFDQIYKADLSTRPFTLFGDSGLYTCDGLIIATGANAKYLGIPSEEAFKGRGVSACATCDGFFYRDQDVAVIGGGNTAVEEALYLSNIARKVYLIHRRDKLRAEKIMQNKLFSKAATGKIELIWNNAVEEVLGNDAGVTGVRIRSTQDSSRRDIDVQGLFVAIGHHPNTDLFAGQLAMNNGYLQIHSGTAGNVTQTSVEGVFAAGDVADQHYRQAITSAGFGCMAALDAERFLDKGN

SEQ ID NO: 19942 - protein, 467 aa, Thermoanaerobacter tengcongensis
MNDVGLIGLAVMGQNFALNMARKGYRVSVYNRTPERTKKFVEEKVRDESIFPFYTIEEFVKSLKKPRKIILMIKAGKAVDDMIAEILPYLELGDLIVDSGNSHFADTARRLEYLSQKNILFLGMGISGGEYGALHGPSLMPGGTKEAYDLIKDILLKAAAKTEDGPCCTYVGKGSAGHFVKMVHNGIEYAIMQLIAEVYDFMKKVLNMTNEQIGDVFEKWNKGELNSYLMEISYKIMRYKDKETGGFLIDYILDKAEQKGTGKWTAQTSLDLGVPTPTLNLAVEARIISHYKEERKILSKLYSKEKNIISVNKEEMIEHLKKALLFGVFMSFSQGLWLIDEASKQYNYGIDLSEILRIWKGGCIIRAEILDFLRDIIRENEEDANLLHSDKAIDFIKDKLNSIYQVTEIGKNYRIPLMTMNSALDYYFALTEENLPANIIQAQRDFFGAHTYERIDREGIFHTEWER

SEQ ID NO: 19943 - protein, 536 aa, Thermus thermophilus
MEDKATQTPEQTFSMEAALQETEARLEKRVRPGQILTGKVVLVGSEGVAVDIGAKTEGIIPFNQLTTKPLSEEELRNLLSPGDEVKVQVLRVDPETGQILLSRKKIEAQEKWDRIQELYEKGEPVTVTIKERVKGGVVAELDGIQGFMPASQLDLRRVPNLDEFVGQQVLAKIIEFHRRKGRVILSRRAVLEEEQKKAREAFLKSLEPGQVVEGTVVEVTDFGVFVNLGPVDGLVHRSEITWGRFNHPREVIQKGQKVKARVLSVDPEKERVNLSIKALIPDPWTTVAEKYPVGTRVRGKVVGLTQFGAFVEVEPGLEGLIHISELSWTKRPKHPSEVVKEGDEVEAVVLRLDPEERRLSLGLKQTQPDPWQQLTEKYPPGTVLKGKVTGVTDFGVFVEIEPGIEGLVHVSELDHKRVENPAALFKKGDEMEVVVLNIDPVEQRVSLSRKRLLPPPLPQEEERPRRARSGKERARRKGAPRREDRREYEYGAVAEYNLYDASSVPTTTATVKLGDLYGDLLASLGLEEEAEEKSRG

SEQ ID NO: 19944 - protein, 433 aa, Oryza sativa
MAAIDLSSPARSSPAPLSPRRGSLHLLLRRPRRPTLRCSLDAAPKQAQAQGPPAAVAAEEAPTARKECYGVFCTTYDLRADEKTKSWKSLVNVAVSGAAGMISNHLLFKLASGEVFGPDQPIALKLLGSERSIQALEGVAMELEDSLYPLLREVSIGIDPYVVFEDAEWALLIGAKPRGPGMERSALLDINGQIFAEQGKALNSVASRNVKVIVVGNPCNTNALICLKNAPNIPAKNFHALTRLDENRAKCQLALKAGVFYDKVSNMTIWGNHSTTQVPDFLNAKINGRPVKEVIKDTKWLEDEFTKTVQKRGGVLIQKWGRSSAASTAVSIVDAIRSLVNPTPEGDWFSTGVYTTGNPYGIAEDIVFSMPCRSKGDGDYELVKDVAMDDFLWERIKKSEAELLAEKRCVAHLTGEGNAFCDLPGDTMLPGEM

SEQ ID NO: 19945 - protein, 418 aa, Alteromonadales bacterium
MLERSMNISDFDPELFDAMSKETSRQEEHIELIASENYCSPRVLEAQGSQLTNKYAEGYPGKRYYGGCEHVDVVEQLAIDRANELFGTDYANVQPHAGSQANAAVFQALLSPLDTVLGMSLAHGGHLTHGSHVNFSGKTYNAIQYGLNEETGEIDYAQVEALALEHKPKMIIAGFSAYSGIVDWAKFREIADKVDAYLFVDMAHVAGLIAAGVYPSPVPFAHVVTTTTHKTLAGPRGGLIISACGDEAIYKKLNSAVFPGGQGGPLCHVIAAKAVAFKEALQPEFKEYQTQVVKNAQAMVSVLQERGYKVVSGKTDNHLFLLDLIDKDITGKDADAALGNANITVNKNSVPNDPRSPFVTSGLRIGSPAITRRGFKEAESKELAGWICDVLDNIADESVQAQVKEKVKAICAKLPVYA

SEQ ID NO: 19946 - protein, 294 aa, Xanthomonas campestris
MTRHLLPVALIQERNHGDAEANLAVIASRVAEAAAQGAKLVLLQELHNGAYFCQHESVDEFNLAEPIPGPSTERLSALAKQHGVVLVASLFERRAAGLYHNTAVVFEKDGRLLGKYRKMHIPDDPGFYEKFYFTPGDLGFTPIDTSVGRLGVLVCWDQWYPEAARLMALAGAELLLYPTAIGWDPDDQQAEQERQRDAWILSHRGHAVANGVPVLSCNRVGHEPSPLGASGIQFWGNSHVLGPQGEFIAEAGQDPTVLICDVDLQRSEHVRRIWPFLRDRRIDAYGDLLKRYID

SEQ ID NO: 19947 - protein, 132 aa, Vigna unguiculata
YATSLESMVDFSTSKLGKNVAVLSTEVDQETGLQQYTIAPGVKKVSGDNAVVCHKQSYPYAVFYCHKTETTRTYPVPLEGANGIRVKAVAVCHTDTSQWNPKHLAFEVLKVKPGTVPVCHFLPEDHVVWVQK

SEQ ID NO: 19948 - protein, 460 aa, Unknown
  Burkholderia sp. 383
MNQPEDQLHRGLEERHINLMALGATIGVGLFLGSASAIRVAGPAILLTYLLGGIAIFLIMRALGEMAIANPVAGAFSRYARDYLGPLAGYLTGWTYWFVWIVTCMAEITAVGVYMHMWFPGVPNWIWALAALMAMGSVNFIAVKLYGEFEFWFALIKIVTIVLMIIGGGLMIAFGIGNGGVAIGLSNLWAHGGFMPNGINGVIAALPIVMFAYLGVEMLGLTAGEARNPEKSLTKAVNSVFWRVLIFYIGALFVIMSLYPWDQIGTQGSPFVMTFSRLGIPAAAGIINFVVLTAALSSCNSGLFSTARMLYNLAQQGQAPSKLGKVNRNGVPVYGVIVSVALLLIGVLLNYLAPQHVFTWLTSVSTFGAIWTWCVILIAQMRFRRTLSADKIARLPIRVPFYPLGSFVALGFLVLVVVLMAFTPDTRVALVIGPVWIVLLGITYALFYANRPAASVPTKS

SEQ ID NO: 19949 - protein, 366 aa, Candida albicans
MATFAPHISKITKSSTKFNYGRIAKTFLGVAGSAAIATYFYNNGNPFNNNNNNNNNNGGSKNAAKALFGASAGANVKIAKVPEGKSASDYQKVYNDIATKISENLEFDENAGYYGQLLRLAWHTSGTYDKSDNSGGSYGGTMIFAPEEFDPENAGLQVGREFLMEFLVKYPWISRGDLWTLGGVAAVQESGGPKIEWRPGRVDDNTASKVPPNGRLPDASKDGKYVKDLFARMGFNERETVALLGAHVLGRCHKHNSGYDGPWGPSFNQFTNVFYTTLLGDWHVKKWDGKKQYEDDETGEFMMLPTDMALKEESYFLKYVKMYADDQDLFFKDFAKAFSKLISNGIKYPADSKPILFKTLDEQDEE

SEQ ID NO: 19950 - protein, 231 aa, Glycine max
MDPNAVKSTLSNLAFGNVMAAAARDYQKELHAQEKTHASSSVHQEVDLDELMDDPELEKLHADRIAALKKEAEKREEWKKKGHGEFREVTEGDFLGEVTGSEKVICHFYHKEFYRCKIMDKHLKSLAPKHIDTKFIKLDAENAPFFVTKLAIKTLPCVILFRQGVAVDRLVGFQDVGGKDDFTTRTLEALLIKKGIIEVKKAEDDEDDEYQDSTRRVVRSSMIAGSDSDSD

SEQ ID NO: 19951 - protein, 129 aa, Thermoanaerobacter tengcongensis
MNIALIAHDQKKELMVNFAIAYKHIFEKCNLYATGHTGQLIKEATGLDVHCLLPGPLGGDQQIGALIAENKIDLVIFLRDPLTVQPHEPDILALLRVCDVHSIPVATNIATAEVLLKGMEMGLLDWRQI

SEQ ID NO: 19952 - protein, 318 aa, Prochlorococcus marinus
METIETDVVIVGGGPAGCSCALYTSRADLRTVILDKNPDVGALAITHQIANYPGVSSEMSGEALLKLMRDQATQYGADYRRAQVFGIDSSGDWKTIYTPEGTFKAKALVVASGAMGRPASFKGEAEFLGRGVSYCATCDGAFYRDREVAVVGINKEAIEEANVLTKFASKVHWITSNDPKPDDHHAQDLLSKPNVNHWSKTRLMQIEGNDGGVTGIKVKNRSIDTHQNLALEGVFVYMSGSKPITDFLGEQVAFKEDGGVLVDDFMSTTVEGVWAIGDIRNTPFKQAVVAASDGCIAAMAIDRYLNSRKSIRVDWVHA

SEQ ID NO: 19953 - protein, 322 aa, Staphylococcus epidermidis
MKKIAVLTSGGDSPGMNAAVRAVTRTAIYNNIEVYGVYQGYQGLLDDDIHKLELGSVGDTIQRGGTFLFSARCPQFKEEDVRKKAIENLRKRGIEGLVVIGGDGSYRGAQRISEECKEIQTIGIPGTIDNDINGTDFTIGFDTALNTIIESVDKIRDTASSHARTFIVEVMGRDCGDLALWAGLSVGAETIVLPEVNTDIKDVAEKIEQGIKRGKKHSIVMVAEGCMSGQECADELTKYINIDTRVSVLGHIQRGGSPSGADRVLASRLGGYAVELLKQGETAKGVGIRNNQLTSTPFDEIFAESNRKFNSQMYELAKELSI

SEQ ID NO: 19954 - protein, 323 aa, Mycoplasma gallisepticum
MFLFEDLNVESAQAVKAEESPAQTVQSKEEQVPANSTDKVLVTHTKLLDVGAFNGVAKRKWNPKMKHYIIPRNAAQFSAQFDLINSDLLNLKLHEAFNYLTEAAKAKKNILFVGTKSKAVQELIQSIAERTNSFYINQRWLGGTLTNFKTISNSINQLKRLIHTRDNDLTKYTKKEQIMIMKKLAKLERFFGGIKDMQGLPHVLVIDDPIKEKNAVTEARKLRIPVIALCNTNSDPNVITLPIPANNYNIRSVTLLLNLLGDAVALAQGNPAKFAFKPDEEIDIPQLVKKETRTVVNRDRAGFNKKQPKAEEAAKPAEKKAEK

SEQ ID NO: 19955 - protein, 381 aa, Manihot esculenta
MCGGAIISDFIPATAAGRSSRRLTADFLWPDLKKPIGKIVGDLDDDFEADFQEFKDESDVDEEDDVLFDVKPFSFSATASPPPRNRSPSRGSTAVKSVEFNGLAEKSAKRKRKNQYRGIRQRPWGKWAAEIRDPRKGVRVWLGTFNTAEEAARAYDAEARRIRGKKAKVNFPDEAPRASPKRTMKANPQKPLPKRNATESMSYLNNPDQDYFNTLGSVDEKPLVSQFDLMDSFPANGDATVKSIPPCDNVPTFFNSDQGSNSFECSDFGWGEQASKTPEISSVLSATPEIDESLFMDDANPKKKMKSDSENAVPIEESNGKSLSEELLAFDNQMNFQMPYLEGSWEASLDGFLNGDVTQDGGNPMDLWSFDDLPNMVGGVY

SEQ ID NO: 19956 - protein, 523 aa, Aspergillus phoenicis
MRITSAIASLLLVGTATSLQNPHRRAVPAPLTHRSVASRAVPVERRSNDFEYLTNKTARFLVNGTSIPEVDFDVGESYAGLLPNTPTGNSSLFFWFFPSQNPDASDEITIWLNGGPGCSSLDGLLQENGPFLWQPGTYKPVPNPYSWTNLTNVVYIDQPAGTGFSPGPSTVNDEEDVAAQFNSWFKHFVDTFDLHGRKVYITGESYAGMYVPYIADAMLNEEDTTYFNLKGIQINDPSINSDSVMMYSPAVRHLNHYNNIFRLNSTFLSYINGKADKCGYNAFLDKAITYPPPTPFPTAPEITEDCQVWDEVVMAAYDINPCFNYYHLIDFCPYLWDVLGFPSLGFGPDNYFNRSDVQKILHVPPTDYSVCSETVIFANGDGSDPSSWGPLPSVIERTNNTIIGHGWLDYLLFLNGSLATIQNMTWNGKQGFQSPPVEPLFVPYHYGLAELYWGDEPDPYNLDAGAGYLGTAHTERGLTFSSVYLSGHEIPQYVPGALTASWSSCLVELIVFPRRGTTPLNFS

SEQ ID NO: 19957 - protein, 424 aa, Candida albicans
MNWKTPSKKIYDSADLKNFEKSIAFEKLQKTLQQIILSVENHKIPPGILNVDIVTRPGRIGSIPLPSLIEPTTTTTTRENKIGPSNGNVEILIELFQYLNKLIDETPPLKGPTRFGNFACRDWHDKIDIIPILKKFKFPQELSSSNNSSSKSNIDGFLLESSYYLLNSFGSKIRLDYGTGHELSFLAFIGSLIEFKILNHPTTTEEINGKEILIIFANYYDLVRRLILVYNLEPAGSHGVWGLDDHFHLIYILGASQFINDKLAPIVQRSLSSQVINSCKLTNFYINAIAFIFRLKTGPFNEHSPIIFDIHNKVFSWTKVRQGLIKMYMVEVFNKFPVLQHFWCGEVLYPWKDHQGNDLPVNEKEETELDKPPETTLNSTTTTTTTTKVSSSTSKIPFTPAPWANTTTTHAVPRNTRNTRNPRS

SEQ ID NO: 19958 - protein, 479 aa, Salmonella typhimurium
MSILVKNNIHWVGQRDWEVRDFHGTEYKTLRGSSYNSYLIREEKNVLIDTVDHKFSREFVQNLRSEIDLADIDYIIINHAEEDHAGALTELMAQIPDTPIYCTANAIDSINGHHHHPEWNFKVVKTGDTLDIGNGKQLIFVETPMLHWPDSMMTYMTGDAVLFSNDAFGQHYCDERLFNDEVDQTELFEQCQRYYANILTPFSRLVTPKITEILGFNLPVDMIATSHGVVWRDNPTQIVELYLKWATDYQEDRITIFYDTMSNNTRMMADAIAQGINEVDPNVAVKIFNVARSDKNEILTNVFRSKGVLVGTSTMNNVMMPKIAGLVEEMTGLRFRNKRASAFGSHGWSGGAVDRLSTRLQDAGFEMSLSLKAKWRPDLDALELCRQHGRDIARQWALAPLPETTQQIAPVEETITCTAADLGPKMQCSVCQWIYDPALGEPLQDVAPGTPWNDVPDNFLCPECSLGKDVFDVLATEAK

SEQ ID NO: 19959 - protein, 377 aa, Salmonella typhimurium
MSRGIIIIGSGFAARQLVKNIRKQDAHVPLTLIAADSMDEYNKPDLSHVISQSQRADDLTRQLAGEFAEQFNLRRFPHTWVADIDADAHVVKSQDKQWQYDKLVLATGATAFVPPIAGRELMLTLNSQQEYRACETQLRDAQRVLIVGGGLIGSELAMDFCRAGKTVTLMDNAASLLASLMPPEVSSRLQHHLTDMGVHLLLKSQLQKLEKTEAGIRATLVSQHSIEVDAVIAATGLRPETALARRAGVAVNRGVCVDSYLQTSHPDIYAIGDCAEINGQVLPFLQPIQLSAMYLAKNLLGGNAPLKLPAMLVKVKTPELPLHLAGETQRRDLSWHITAESDGMIAKGMSGEGQLRAFVVSEDRMKEAFALLKTLSV

SEQ ID NO: 19960 - protein, 495 aa, Candida glabrata
MSFENFHKATSEQLTKAVDELCKEFEVTPKMLDELTAYFIESMEKGLAAEADSENKGLPMIPSFVTGMPNGTENGVLLAADLGGTNFRVCSVTLNGDNTFKMEQMKSKIPDELLDDEGVTSEQLFGYLGRRTVAFVKKYHPEFLNKGDDIPPIRLGFTFSYPVDQTSLNSGTLIRWTKGFKIEDTVGKDVVQLYQQQLDAQGLGMIKIVAMTNDTVGTFLSHCYASGSHSSSGGEISEPVIGCIFGTGTNGCYMEEIENIKKLPEDMRHQLANEGKTHMCVNTEWGSFDNECRYLPTTKYDVDIDQKYSANPGFHLFEKRVSGMYLGEVLRNVLVDLHSRGLMLTQYRDYDQLPHRLKTPFELSSEVLSRIEIDDSTGLRETELSFLQSLRLPTTPSEREAIQKLVRAISRRSAYLASVPIAAILIKTNALNKRYHGEVEVGCDGSVIEYYPGFRSMLRHALSLSPIGADGERKIHIRIAKDGSGVGAALCALVA

SEQ ID NO: 19961 - protein, 524 aa, Arabidopsis thaliana
MESASDLGKLFIGGISWDTDEERLQEYFGKYGDLVEAVIMRDRTTGRARGFGFIVFADPSVAERVIMDKHIIDGRTVEAKKAVPRDDQQVLKRHASPMHLISPSHGGNGGGARTKKIFVGGLPSSITEAEFKNYFDQFGTIADVVVMYDHNTQRPRGFGFITFDSEESVDMVLHKTFHELNGKMVEVKRAVPKELSSTTPNRSPLIGYGNNYGVVPNRSSANSYFNSFPPGYNNNNLGSAGRFSPIGSGRNAFSSFGLGLNQELNLNSNFDGNTLGYSRIPGNQYFNSASPNRYNSPIGYNRGDSAYNPSNRDLWGNRSDSSGPGWNLGVSVGNNRGNWGLSSVVSDNNGYGRSYGAGSGLSGLSFAGNTNGFDGSIGELYRGSSVYSDSTWQQSMPHHQSSNELDGLSRSYGFGIDNVGSDPSANASEGYSGNYNVGNRQTHRGTLIDVLKHRKKSTKRSENCRSRRTAISVAEFEELLFRYQVEKETNFLHHSEFLVLFFSSLASQTQKREVYFYFKNSYIR

SEQ ID NO: 19962 - protein, 469 aa, Pseudomonas syringae
MSETTSPSGELKRGLKNRHIQLIALGGAIGTGLFLGSAGVLKSAGPSMILGYAICGFIAFMIMRQLGEMIVEEPVAGSFSHFAHNYWGGFAGFLSGWNCWLLYILVGMSELTAVGKYIHYWLPDIPGWVSAAAFFVLINAINLTNVKVFGETEFWFAIIKVVAIIGMIALGSYMLVSGSGGPQASVSNLWEHGGFFPNGVSGLVMALAIIMFSFGGLEMLGFTAAEAEQPKTVIPKAINQVIYRILIFYIGALVVLLSLTPWDSLLASLNASGDSYSGSPFVQVFSMLGSDTAAHILNFVVLTAALSVYNSGTYCNSRMLVGMAEQGDAPRALAQVDKRGVPVKAIFASAAVTLVAVLLNYFVPQQALELLMSLVVATLVINWAMISYSHLKFRQHMNRTAQVPLFKALWYPYGNYVCLAFVVFILGIMLMIPGIQISVYAIPVWLAVMWVCYRAKNRRSVVVPAESGK

SEQ ID NO: 19963 - protein, 238 aa, Yarrowia lipolytica
MVVQHHSSTTTSPHYYTIQTTMTVQENVNQEPIEHRFNPYGGDDFALLAGDTRNTTGYSINSRYQPKVFDVGDNILVTANGFSADGDALIENIKQHVELYHYQNNKPLKVQSCARAIQHMLYNKRFFPYYVHTIIAGLDEEGKGAVYSYDPVGSYEREFCRAGGSAASLVMPFLDSQVNKKNQQVENPPPLTLEEALKVVKDAFSSATERHIHVGDGLEILIVTKEGVRKEFFPLKRD

SEQ ID NO: 19964 - protein, 295 aa, Prosthecochloris aestuarii
MKTGFVGLGKMGLNMVENLLDHGHDVVVYDLSSAQVLQAVQKGAVGASSLKDLADTGLIWMMVPAGAPVDATIDELLPILKAGDIIIDGGNSNYHDTVRRALRVQGAGMHYLDVGTSGGLEGARNGACMMIGGSSEIVDRLDELFRDMCVPGGYGYVGPNGAGHFAKMVHNGVEYGMMQAIGEGFDILESAPFTFDHHAVAGIWSNGSVIRGWLMDLVAAAFEKDGALDYLSGEIADSGEGRWTIDAALDQGVSIPVIANALFRRYRSRSHDNFSDKVVAALRHEFGGHGFTPKS

SEQ ID NO: 19965 - protein, 244 aa, Methanothermobacter thermautotrophicus
MGAGPGDPELITLKAVRALRGADVVIYAGSLVNRDILEYAPEDAEVHNSAHMNLEEITDIMVEACRAGKTVARVHTGDPSIYGAIKEQIRVLEKNSIPYTIIPGVSSVFAAAATLNTELTLPEVSQTVIITRPAGRTPVPPGEDLEELAVHGSTMCIFLGVHMIEDVAEKLMTHYPPDTPVAVVKRASWPDEEVVRGTLSDIAERVRAAGISKTAMIIVGSVLEPGDFKPSKLYDAGFSHEYRP

SEQ ID NO: 19966 - protein, 401 aa, Arabidopsis thaliana
MRGRSLTLSRVKLELARRSMSATSVPSMADFLTKKPYSPPSWASHLRPLPSHTFSLAHLPTPIHRWNLPGLPNGTELWIKRDDFTGMELSGNKVRKLEFLMAEAVDQHADTVITIGGIQSNHCRATATASNYLNLNSHLILRTSKLLADEDPGLVGNLLVERLVGANVHLISKEEYSSIGSEALTNALKEKLEKEGKKPYVIPVGGSNSLGTWGYIEAAREIEEQLNYRPDDLKFDDIVVACGSGGTIAGISLGSWLGALKAKVHAFSVCDDPDYFYDFVQGLLDGLHAGVNSRDIVNIHNAKGKGYAMNTSEELEFVKKVASSTGVILDPVYSGKAAYGLINEITKDPKCWEGRKILFIHTGGLLGLYDKVDQMASLMGNWSRMDVSESVPRKDGVGKMF

SEQ ID NO: 19967 - protein, 298 aa, Moorella thermoacetica
MHIGLVGLGRMGLNLALNMLDHGHEVRGYARTKATVDKAAAQGIKGAYSLEELAGQLKTPRLVWLMIPAGKAVDEVIEQLAPLLAPGDIIVDGGNSHYRDTLRRYKFLKEKGIHLVDSGTSGGVEGARHGACCMVGAEDEVFAYLEPLFKDITVPGGYLHTGPPGSGHYVKMVHNGIEYGMMQAIGEGMEVLAGAPFKLDLKEVARVWRHGSVIRGWLMDLMEKALAKDNTLDGIKDIAYSSGEGLWTIEEALRLKVPAPVITAALLMRYRSEQEESFATKVVAALRHEFGGHDVARK

SEQ ID NO: 19968 - protein, 502 aa, Glycine max
MHAMEFLTLSVTVAAAAFSILFFFLRHAGAGAGSLPPVPAVPGLPVIGNLLQLKEKKPYKTFTQMAHKHGPIYSIRTGASTLIVLNSPLLAKEAMVTRFSSISTRKLSNALKILTSDKCMVATSDYNEFHKTVKRHILTNFLGANAQKRHHIHREAMMENILSQFSEHVKTFSDLAVNFRKIFVTQLFGLALKQALGSNVETIYVEELGSTLSKEDIYKILVVDIMEGAIEVDWRDFFPYLKWIPNRRLEMKIQNLYVRRKAVMKALMNEQKNRMASGKEVNCYFDYLVSEAKELTEDQISMLIWETIIETSDTTLVTTEWAMYELAKDKTRQDRLYEELQYVCGHENVIEDQLSKLPYLGAVFHETLRKHSPAPIVPLRYAHEDTKLGGYHIPAGSEIAINIYGCNMDNNLWENPNEWMPERFLDEKYDHMDLYKTMAFGAGKRVCAGSLQAMLIACTAIGRLVQQFEWELGQGEEENVDTMGLTTHRLHPLLVKLKPRIK

SEQ ID NO: 19969 - protein, 53 aa, Moorella thermoacetica
MEKYSCTVCGYVYDPAEGDPDNGIAPGTPFADLPEDWVCPLCSAGKEAFEPET

SEQ ID NO: 19970 - protein, 455 aa, Candida glabrata
MSSAEKIAKQARVAGNVLKTISDENRSKILYRIRDALANAKDEIESANKEDLEQARAGGLADSLVKRLDLFKGDKFDVMLQGISDVADLEDPVGKVKMAREIDNGLMLYQVTAPVGVILVIFESRPEVIANITALCIKSGNAGILKGGKESVNTFKAMAKVVNQTIEQYKDETGVPVGAVQLIETRQDVSDLLGQDEYIDLVVPRGSNSLVRQIKDSTKIPVLGHADGICSIYVDRDADLEKAKRIVLDAKTNYPAGCNAMEGLLLNPDFSQWDDVLHHLITEGGVTIHATTDVKEAFLKKLQDSGKLNDDIKAKIVDAKDGDFDKEFLSLDCAVKFIPNTVDAINHINEHSSKHTDAIITESKEDAEKFLKGIDSSGVYWNASTRFADGFRYGFGTEVGISTSKIHARGPVGLDGLVTYQYQIRGDGQVASDYLGAGGNKAFVHKDIDVTNIKL

SEQ ID NO: 19971 - protein, 289 aa, Oryza sativa
MSSGGELALRQEYVIGDEIGRGRFGTVRRCYAVATGEAFAVKSTPKAPLREAEAADALDLALAEQEPKVHLVASAPGPGASPHVVALHAAFEDDAAVHLVVDLCAGGDLLSLVSSRGRLPEHEAAGLTAQLASALASCHRRGVAHRDVKPDNLLFDGGGVLKLGDFGSAGWFGDGRPMTGLVGTPYYVAPEVVAGREYGEKVDVWSAGVVLYMMLSGTLPFYGATAAEVFQCVLRGNLRFPPRAFASVSPEAKDLMRRMLCKDVSRRFSADQVLRHPWIVSRGGAAVMG

SEQ ID NO: 19972 - protein, 368 aa, Photorhabdus luminescens
MMNSSQTLVVKLGTSVLTGGSRRLNRAHIVELVRQCAQQHEKGHRIIIVTSGAIAAGREHLGYPDLPATIASKQLLAAVGQSRLIQLWEQFFSIYGIHVGQMLLTRADLEDRERFLNARDTLQALLDNRIVPVINENDAVATAEIKVGDNDNLSALAAILGGADKLLLLTDIEGLYTADPRNNPDAKLIPEVYDISDELRMVAGDSISGLGTGGMATKLQAAGIAGRAGIDVIIAAGNKPDVISDVIEGNPVGTRFHGLESPMENRKRWIFGAPPAGEIIVDHGAETAICEKGSSLLPKGIKNIKGDFSRGEVICIRSLSGKDLAHGVCRYNSDALRLIAGHHSQQISQILGYEYGAVAVHRDDMIVS

SEQ ID NO: 19973 - protein, 95 aa, Oxalis tuberosa
LYAGINISGTNGEVMPGQWEYQVGPSVGIEAGDHIWASRYILERITEQAGVVLTLDPKPIDGDWNGAGCHTNYSTKSMRDEGGFEVIRKAIFNLS

SEQ ID NO: 19974 - protein, 417 aa, Photorhabdus luminescens [sequence omitted]

SEQ ID NO: 19975 - protein, 399 aa, Moorella thermoacetica
MSQPVAITDGIYWVGAVDWNIRYFHGPAFSTHRGTTYNAYLIVDDKTALVDTVYEPFKEELIAKLKQIKDPVKLDYLVVNHTESDHAGAFPAIMELCPDAHVLCTQRAFDSLKAHYSHIDFNYTIVKTGTSVSLGKRSLTFIEAPMLHWPDSMFTYVPEEALLLPNDAFGQHIATSVRFDDQVDAGLIMDEAAKYYANILMPFSNLITKKLDEIQKINLAIKTIAPSHGIIWRKDPGRIIEAYARWAEGQGKAKAVIAYDTMWLSTEKMAHALMDGLVAGGCEVKLFKLSVSDRNDVIKEILDARAVLVGSPTINNDILPVVSPLLDDLVGLRPKNKVGLAFGAYGWGGGAQKILEERLKAAKIELIAEPGPTVQWVPRGEDLQRCYELGRKIAARIAD

SEQ ID NO: 19976 - protein, 229 aa, Moorella thermoacetica
MDTKALHTLTYGLYIITAKKGDRFNGQVANTVFQITSDPPTIAVSINKQNLTHEFIQAGQGFVISVLAREVPLSLIGQFGFKSGREMDKFAGINYKLSEGGLPYLADHTLAYLEASLNQTVDAGTHSIFIGTVTDAAVLLQGEPMTYAYYHQVKRGTTPKTAPTFTVGREKDKTALASPKYQCTICNYVYDPVQGDPEHGIAPGTPFADLPEDWTCPICGAGKDAFEQI

SEQ ID NO: 19977 - protein, 409 aa, Moorella thermoacetica
MNYVLIGNSVAAVNAVAGIREYDREGDITIVSAENYYAYGRPLISYWLEQRVNEKNLPYRPETFFARNKVRVLLGRRAVRLDPEARQVFLDNGESLPYDRLLLATGGRPFLPSINGLTPENHYTFMTYDDARRLEKAASPGREAVILGAGPTGLKAMESLVRRGVKVTLVELADRIWAPALDPEAASMVAGFLQDRGVNIYLNDTLDGVRRGDNGRLDLELKSGRRLAADILVVAIGVRPNVELLQDLPGATINRGVVVGADLSTGLPGVYAAGDVVAGNPPLLPHAAIQGKIAGRNMAGGRETYKPIPPYNALGILGLHIISIGLSAAGEGYEILQEADPAARVYRKLVLQDNRLVGGLLINKIDRAGIYRYLIEEGIEVTSFKDRLLQPDFGLLSLPDTIWQQQLAK

SEQ ID NO: 19978 - protein, 256 aa, Pinus monophylla
  misc_feature (13)..(13): Xaa can be any naturally occurring amino acid
CGIGSCAFAGGQXSSLKPHTNQLLGVGAGVHGESRVTMRKSATKKSVASASPSPWYGPDRVLYLGPFSGEPPSYLTGEFPGDYGWDTAGLSADPETFAKNRELEVIHCRWAMLGALGCVFPELLARNGVKFGEAVWFKAGAQIFSEGGLDYLGNPSLIHAQSILAIWACQVILMGAVEGYRIAGGPLGEVTDPIYPGGSFDPLGLADDPDAFAELKVKEIKNGRLAMFSMFGFFVQAIVTGKGPIENLADHLADPV

SEQ ID NO: 19979 - protein, 95 aa, Oxalis tuberosa
LYAGINISGTNGEVMPGQWEYQVGPSVGIEAGDHVWASRYILERITEQAGVVLTLDPKPIEGDWNGAGCHTNYSTKSMRDEGGFEVIKKAILNLS

SEQ ID NO: 19980 - protein, 376 aa, Methanothermobacter thermautotrophicus
MAKRDYYEILGVDRGADKKEIKKAYRRLARKYHPDVSDDPDAAEKFKEISEAYAVLSDDEKRARYDRFGHAGMDGFSQEDIFNNINFEDIFSGLGFDIGNIFDMFGFGGGRRHGPQRGADISYTLDISLEDAYNGLETDIRVPHTKKCPVCHGSRAEPGTGTRTCQTCGGSGQVRQVRNTILGQMMNITTCPDCQGEGTVVEKPCSNCNGKGVVRKTSTIHVKVPAGVETGSRLRVPGEGEMGLRGGEPGDLYVVIKVKPHSIFRREGANLYTEKPISFVQAALGDTVEVPTLDRPVKLRIPAGTQSGTTFRVKGHGMPHLKWNGYGNLYVKVKVVTPRKLSPRQKELLREFASISGDEIHEDKGFFDKVKDAIIH

SEQ ID NO: 19981 - protein, 256 aa, Pinus remota
CGIGSCAFAGGQLSSLKPHTNQLLGVGAGVHGESRVTMRKSATKKSVASASPSPWYGPDRVLYLGPFSGEPPSYLTGEFPGDYGWDTAGLSADPETFAKNRELEVIHCRWAMLGALGCVFPELLARNGVKFGEAVWFKAGAQIFSEGGLDYLGNPSLIHAQSILAIWACQVILMGAVEGYRIAGGPLGEVTDPIYPGGSFDPLGLADDPDAFAELKVKEIKNGRLAMFSMFGFFVQAIVTGKGPIENLADHLADPV

SEQ ID NO: 19982 - protein, 253 aa, Pinus longaeva
GSCAFAGGQISSLKPHTNQLLGVGAGVHGESRVTMRKSATKKSVVSASPSPWYGPDRVLYLGPFSGEPPSYLTGEFPGDYGWDTAGLSADPETFAKNRELEVIHCRWAMLGALGCVFPELLARNGVKFGEAVWFKAGAQIFSEGGLDYLGNPSLIHAQSILAIWACQVILMGAVEGYRIAGGPLGEVTDPIYPGGSFDPLGLADDPDAFAELKVKEIKNGRLAMFSMFGFFVQAIVTGKGPIENLADHLADPV

SEQ ID NO: 19983 - protein, 472 aa, Bacteroides fragilis
MARKKKELPLLEKVTITDVAAEGKAIAKVDDLVVFVPYVVPGDVVDLQVKRKKNKYAEAEAVKFHELSPVRAVPFCQHYGVCGGCKWQVLPYAEQIKYKQKQVEDNLRRIGKIELPEISPILGSAKTEFYRNKLEFTFSNKRWLTAEEVKQDVKYDQMNAVGFHIPGAFDKVLAIEKCWLQDDISNRIRNTIRDYAYEHNYSFINLRSQEGMLRNMIVRTSSTGELMVILICKITEEHEMDLFKQLLQYVADQFPEITSLLYIINNKCNDTINDLDVHVFRGNDHIFEEMEGLRFKVGPKSFYQTNSEQAYNLYKVARDFAGLTGDELVYDLYTGTGTIANFVSRQARKVIGIEYVPEAIEDAKVNAEINGIENTLFFAGDMKDILTQDFINQYGRPDVIITDPPRAGMHQDVVDVILFAEPKRIVYVSCNPATQARDLQLLDVKYRVKAVQPVDMFPHTHHVENVVLLELK

SEQ ID NO: 19984 - protein, 368 aa, Streptococcus pyogenes
MEHKWKLWLFIVGVVLLIGGASVLIQKGQAKAFSQGKPQIPAKKVKSTKVDPNAPVDQKVIYLAGGCFWGVEEYFSQVDGVLDAVSGYANGRGDTTNYQLIHQTGHAETVEVAYDANRISLKELLLHFFRIIDPTSLNKQGNDRGSQYRTGIYYTDKADLAIIDEVFKEKAKDYKKKIVVEKAPLKHFIKAEDYHQDYLKKNPNGYCHIDINQATYPVIDESKYPKPSATEIKEKLSADEYRVTQKNETEKAFSNRYWDSFDAGIYVDVVTGEPLFSSKDKFESGCGWPSFSRPISPDVVRYKEDKSFNMTRTEVRSRSGNSHLGHVFTDGPKDQGGLRYCINSLSITFIPKADMEAKGYGYLLSSVE

SEQ ID NO: 19985 - protein, 256 aa, Pinus nelsonii
CGIGSCAFAGGQISSLKPHTNQLVGVGAGVHGESRVTMRKSATKKSVVSASPSPWYGPDRVLYLGPFSGEPPSYLTGEFPGDYGWDTAGLSADPETFAKNRELEVIHCRWAMLGALGCVFPELLARNGVKFGEAVWFKAGAQIFSEGGLDYLGNPSLIHAQSILAIWACQVILMGAVEGYRIAGGPLGEVTDPIYPGGSFDPLGLADDPDAFAELKVKEIKNGRLAMFSMFGFFVQAIVTGKGPIENLADHLADPV

SEQ ID NO: 19986 - protein, 340 aa, Arabidopsis thaliana
MSSTQEASVTDLPVKRPREAEEDNNGGAMETENGGGEIKEPSCMSSIIPGWFSEISPMWPGEAHSLKVEKILFQGKSDYQDVIVFQSATYGKVLVLDGVIQLTERDECAYQEMITHLPLCSISNPKKVLVIGGGDGGVLREVARHSSVEQIDICEIDKMVVDVAKQYFPNVAVGYEDPRVNLIIGDGVAFLKNAAEGTYDAVIVDSSDPIGPAKELFEKPFFESVNRALRPGGVVCTQAESLWLHMDIIEDIVSNCRDIFKGSVNYAWTSVPTYPSGVIGFMLCSSEGPQVDFKKPVSLIDTDESSIKSHCPLKYYNAEIHSAAFCLPSFAKKVIDSKAN

SEQ ID NO: 19987 - protein, 521 aa, Triticum aestivum
MANPLAGLQDHLKHARDYALEGLYDTSIIFFDGAIAQINKHLANLDDTFIRTKWMNCKKAISEEVEIVRQLDAQLKSFKEAPGTMRSSSPPIRSNNKSFLFQPLDEYPTSSPSTFDDPDVWAPPRDTNTPNRRSARGQSSARKSSQDGAWARGPSKTGTPSRGAKPSGSKANSAVRSSTASSTGGRKGKSSSSKADSASSDAEEGKSKKAQYEGPDGDLAAMLERDVLDSTPGVRWDDVAGLSEAKRLLEEAVVLPLWMPEYFRGIRRPWKGVLMFGPPGTGKTLLAKAVATECGTTFFNVSSATLASKWRGESERMVRCLFELARAYAPSTIFIDEIDSLCTSRGASGEHESSRRVKSELLVQIDGVNNSSTNEDGQPKIVMVLAATNFPWDIDEALRRRLEKRIYIPLPSFESRKSLISINLRTVEVATDVNIDEVARRTEGYSGDDLTNVCRDASMNGMRRKIAGKTRDEIKNMSKDDISKDPVAMCDFEEALVKVQKSVSPSDIERHEKWMAEFGSA

SEQ ID NO: 19988 - protein, 253 aa, Picea sitchensis
  misc_feature (235)..(235): Xaa can be any naturally occurring amino acid
CGIGSCAFAGGQISSLKPHNNQLVGVGAGVHGEARVTMRKSSTKKVSASASTSPWYGPDRVLYLGPFSGEPPSYLTGEFPGDYGWDTAGLSADPETFAKNRELEVIHSRWAMLGALGCVFPELLARNGVKFGEAVWFKAGAQIFSEGGLDYLGNPSLVHAQSILAIWACQVILMGAVEGYRIAGGPLGEITDPIYPGGSFDPLGLADDPDAFAELKVKELKNGRLAMFSMFGFFXQAIVTGKGPIENLADHLA

SEQ ID NO: 19989 - protein, 352 aa, Daucus carota
MASLTDLINLDLSDTTDKFIAEYIWIDAVGGLRSKARTLSGPVDDPTKLPKWNFDGSSTGQGPGDDSEVIIYPQAIFKDPFRRGNHILVMCDTYTPAGEPIPTNKRCNAAKIFSHPDVAAEVPWFGIEQEYTLLKKEVNCPIGCPTGGYPGPQGPYYCGIGADKAFGRDIVDAHYKACLYAGINISGINGEVMPGQWEFQVGPAVGISAGDELWVARYILERITEIAGVVVSLDPKPIPGDWNGAGAHTNYSTKSMRNEGGFEIIKKAIAKLETKHAQHIAAYGEGNERRLTGKHETASIHKFSWGVANRGASVRVGRDTEKEGKGYFEDRRPASNMEPYVVTSMIAETTIL

SEQ ID NO: 19990 - protein, 432 aa, Daucus carota
MAQILAPSVQWQMRFTKNSTEVSSMTSKMWGSLFLKQNKKAPARSSTKYRALAVKSEDGTINRMEDLLNLDVTPYTDKIIAEYIWIGGTGIDVRSKSRTISKPVEHPSELPKWNYDGSSTGQAPGDDSEVILYPQAIFKDPFRGGNNILVICDTYTPQGEPIPTNKRHKAAQIFSDAKVLGEVPWFGIEQEYTLMQQDVNWPLGWNVGGYPGPQGPYYCAAGADKSFGRDISDAHYKACLYAGINISGTNGEVMPGQWEFQVGPSVGIEAGDHIWCARYLLERITEQAGVVLTLDPKPIDGDWNGAGCHTNYSTKSMREEGGFEVIKKAILNLSLRHKEHISAYGEGNERRLTGKHETASIDSFSWGVADRGCSIRVGRDTEKEGKGYLEDRRPASNMDPYVVTGLLAETTLLWEPTLEAEALAAQKLSLNV

SEQ ID NO: 19991 - protein, 605 aa, Oryza sativa
METHIGSVDGAAAAADNGAVGCPASAVGCPMTSARPAPVSAGEASLGRHLARRLVQVGVSDVFAVPGDFNLTLLDHLIAEPGLRLVGCCNELNAGYAADGYARARGVGACAVTFTVGGLSVLNAIAGAYSENLPVICIAGGPNSNDYGTNRILHHTIGLPDFSQELRCFQTVTCHQAVVTNLEDAHEQIDTAIATALRESKPVYLSISCNLPGLPHPTFSRDPVPFFLAPRLSNKMGLEAAVEATVEFLNKAVKPVLVGGPKLRVAKAGKAFVDLVDASGYAYAVMPSAKGLVPETHPHFIGTYWGAVSTAFCAEIVESADAYLFAGPIFNDYSSVGYSFLLKKDKAIIVQPERVIVGNGPAFGCVMMKEFLSELAKRVNKNTTAYENYKRIFVPEGQPLESEPNEPLRVNVLFKHVQKMLNSDSAVIAETGDSWFNCQKLKLPEGCGYEFQMQYGSIGWSVGALLGYAQGAKDKRVIACIGDGSFQVTAQDVSTMIRCAQNSIIFLINNGGYTIEVEIHDGPYNVIKNWNYTGLVDAIHNGEGKCWTSKVKCEEELTEAIGMALGEKDCLCFIEVIAHKDDTSKELLEWGSRVSAANSRPPNPQ

SEQ ID NO: 19992 - protein, 145 aa, Salmonella enterica
GKVKGGFTVELNGIRAFLPGSLVDVRPVRDTLHLEGKELEFKVIKLDQKRNNVVVSRRAVIESENSAERDQLLENLQEGMEVKGIVKNLTDYGAFVDLGGVDGLLHITDMAWKRVKHPSEIVNVGDEINVKVLKFDRERTRVSLG

SEQ ID NO: 19993 - protein, 112 aa, 'Chlorella' ellipsoidea
MVRVSENGVVENVSLDDKFAVKKSKPSATLSAMELHGAPGACKNGELPEGNLPWEPVTEIDTKDVGTPDQWIPRHPDLIRLTGRHPLNVEPPPTTLMDRGFITPSSLHYVRN

SEQ ID NO: 19994 - protein, 311 aa, Photobacterium profundum
MDFFPVFLSLKSKKILVIGGGEVACRKVDLLLKAKADITLVSPQLHPHLSRLVDNKKLNYISREYQSNDVIGFHQVWATTDVRELNHQIFNDANALGIWTNVVDDPKYCNFITPSMIDRTPIQVAVSSGGASPVLVRFIREKLETQLPQNLSLLAAYSGKQRSRIKQYFGTVDERRKFWEAYFRLPAVENAATESDLEAAFTSLLENNTAQTGNLYLIETGDDAEMLSLKALRLMQQSEYVLFPETKDDIFVDLCRRDAERESYSNETVVNQVQHLLNEDLRVCVLAPKGTHIESLKALNTSFGGQFVPCL

SEQ ID NO: 19995 - protein, 481 aa, Bacillus licheniformis
MNHENREQYTLKRTMKSRHLFMISLGGVIGTGFFLGTGYTINEAGPIGAILSYLAGGMIMYFTMLCLGELAVAMPVSGSFQTYATKFIGPATGFAVGWIYWLGWSVTVALEFLSAGQLMKRWFPDVGVWIWCLIFGLLLFSLNALSAKAFGESEFWLSGIKIIVILLFIILGGGAMFGLIDLKDGQAAPFFSNLIGDGIFPNGFGAIFITMITVNFAFQGTELIGIAAGESENPEKTVPRSIKQTVWRTLVFFGLSVFVLAGLIPWEKAGVVESPFVVVFEQIGIPYAADLMNFVILIALLSVANSGLYASTRMLYSLAKEGMAAQALSRVNKRGIPMNALWITLGFAGLSLISSVVAAETLYIWLLSLAGLSAQVGWITITVSQLLFRRRYVKEGGKVEDLKFKTPLYPYLPLTGFILNSAVLVSLAFDSEQRMALYCGILFMSACYFVYHVFVKKRQALDRQEAMIYQNKTNDEVVIDE

SEQ ID NO: 19996 - protein, 490 aa, Aspergillus oryzae
MSDIRVCFPDRPQFSGFMKPCRVEGDVSQLEVYGEIPKEIDGVFYRVMPDPQLPPFIDNDPWFNGDGNVSAFRIKDGRASFRQRYVRTEKFVREREAQRALIGKYRNKFTDAVEFKVRSTANTNVVYFNGQLLALKEDSPPYAMDPVTLETKGLYDFEGQLPSLTFTAHPKFDPVTGEMVCFGYEARGDGTPDVCYYSVSPTGKFTEVVWLVAPVVAMIHDFAVTDNWVSEPVPRSVCDIQRMKQGGEHWQWSPETPLYLGSCPSNVMQWFQYKNSFPGHTANAYEDEQGHLVIDLGLSEKNVFFWWPDAQGSAPEPSSIVSQLVRFTIDPQSEKRALSKPEILQHGNSEFYRIDDRFATCPYRHCYFDLMDPQLGTDLERIGPKLGGGFPLYNAVAHFDNVTGETEVYFPGDVHLVQEPVFLPRKDSTTEGDGYILVLVNNYETMASELHLLDTRDFTRAQARILLPVRLRQGLHGSWVDGGDLNPRTA

SEQ ID NO: 19997 - protein, 1103 aa, Haloarcula marismortui
MSTDKSIPRVPDLHDPQPETPVTHEFETGTANDPDVGTDTDDPTTLTVDGERVTVAPGSTIIDALQDLDDDIVSVDPGAEGVEDDADVPALCYYDRDGDCSDEVGPRSECRTCMVETEEHGLVPSCSFPAEDGLSVSTDTPDAEEARSVNLDLVLSNHNLRCTTCNGNGRCELQDAAISEGVDHPRYGVFDERDQYEPIDDTSSFIQIDRNKCILCNRCVDACNDVQVEGVLRIEGHGEDTRIGFQSDAETMHDSECVSCGHCATVCPTGSLTEKGIDGAATLPLPGFTQRNSIGKVIEHEDAETIDDTTAPNRGFEPGDPRAAKSKQGLAKFASQAKRRAGDIAKDYGKKAFLAGEHTAESIAANTMPEGRLFDIADIVSDYRLSKIDKEETTCGFCAVGCRFEMWGKDGDSLGVVPVDDPDDAPANNFSTCVKGKFGHEFANSEQRVTEPLIRNDDGELEPTTWDEALEYVAERFTEIQDAHGIDSLGCLASSKGSNEEAYLVQKFARQVLGTKNIDNCARLCHSSTVAALQQTLGYGAMTNRINEDIGEADAYLISGSNTTESHPVLATRIKQNVRDGADLVVFDPRKVGIAEHADQYTRTNPGYDVAWLNGLIRYIIEHDLHDEAFIERNTKNFEEVREKVQAFTPEKVKELAGVSPEELASAAETLAEADTVVFGWAMGMTQQSHGTENLIAMADLALVLGQVGKPGAGLSPFRGQNNVQGGGGDMGTLPGSLPGYQNPADDEVGEKFADAWGERPPKEPGLKVPEMLAEAHAGNLRGMYVVGENPALSEPDIQHAAEALEDLEFLVVQDIFMTETAEYADVVLPAATSPEKHGTFTNTERRIQRVRPTSEPPGKARQDWEITQALARRLGYDWDYDHPREVMDEINSLAPIYGGVTYDRLESGEEHGLQWPCWDEDHDGTPYLYDYDEGNFNFEDGKARFVPADGGHPGEIPDEEFPLTLTSGRVLYHWHTGQITRRVEGLMSHVGESFVEVHPETAEKLGIADGEYVRVESRRGDIVVKAQVTDRVGPGTLFIPMHFAAGAVNKLTGETFDPTAGIPEYKVSSVRVEVLGPETDETVLRTPDAGGKQIRKRGTGDD

SEQ ID NO: 19998 - protein, 577 aa, Triticum aestivum
  misc_feature (353)..(353): Xaa can be any naturally occurring amino acid
  misc_feature (385)..(385): Xaa can be any naturally occurring amino acid
MMGGGVAMMDRRMAFPAADGDVEKGFGFFGAGCFVGAGDLVDPVTAPAPEQRDRFADEEESEEEDDDDDVDGIEELERRMWRDRMRLKRLKELQQRQSQRPDGGAAASKGRPRRPASQQDQQARRKKMSRAQDGILKYMLKMMEACSAQGFVYGIVPENGKPVGGASDNLRAWWKEKVRFDRNAPAAIAKHRSDNAAPLCGGEDGAAAAAGPRSLHELQDTTLGSLLSSLMQHCDPPQRRFPLEKGVPPPWWPQGPSEAWWPEAGVPDDLGPPPYKKPHDLKKAWKVAVLTAVIKHMSPDVDKVRRLVRQSKCLQDKMTAREIVTWLAVLKAEEELSHKLHPGRLPPTAALRXALSFDASSGEYDVDFFGEEAANQIKARSEGSXFVDLPVDASSSNEFMIMPPALMKEETTDADFTHAQKRSAPPAAADAEPDLMLNGNGRVYTCENVQCPHASHALGFLDRNARSAHQYSCRYNNPAVAAAQSKPPSSFFPGPPYSPQSQALGGFDFGLPVADQRCLAGLMSMYETGVAAHRGATSDATTPGMQIGAGSLLAPRSLSGTNNLMQQQQSAAFFIGD

SEQ ID NO: 19999 - protein, 508 aa, Ralstonia eutropha
MEQSKVKHIGMLVETDILIIGSGFSGLGMAVAMKREGKHDFLVLERAEDVGGTWRDNHYPGAACDIQSHLYSYSFRPNPRWSRVYASQPEIHAYLRDTAEAEGVLSHLRFGETVLKAEWLVERGGWRVATTNGEYFAPVLVSAAGHLSDPSYPDIPGLDKFKGKVFHSARWDHSYDYSGKRVGVLGTGASAIQIVPELAKSAGRLTVFQRSAPYVIPRRDHVYSEAEKGLFERFPDVAQELRDELFWGNESRFPQRRQVPAFIEQIKSTALNHLRNQVLDDSLREKLTPQYAIGCKRILISNDYYPTLQKENVALETSGIASMDENGVILKNGERVDLDLLVVATGFEAADLPIAEVIHGTNGLSLAEKWKSGGQAFACTSVAGFPNFFFMLGPNTGLGAGSMVFMIETQINYIREGTNYVFENEVTVDPNAAAEREYVEGIYRRSAGTVWVEGGCSSWYLHPSNGKLTTLWPDFMTQFRKENGSFSPRGYEISPRNVAAMPAQMEEA

SEQ ID NO: 20000 - protein, 248 aa, Picea glauca
MEHLNAAAAQASSSLYGVSMAEYGDVGVSSMMALMTQHEPHERDSILTTSMPSSFSSFHGHAECLLSAAMFQASQGDHKLKRQPEMDQLVSEQAVMSDSSMPSVKTEGCSSLRNQFEIRREQTGNCYTDQSSNAPVSPLVTSLVPQAGGEVRMITSLEADSSHFSGGNEAEAIKAKILAHPQYPSLLGAYIDCQKIGAPPEVVARLDALTHEYENQQHRTTVSIGMDPELDQFMEAYCEMLTKYHEEL

SEQ ID NO: 20001 - protein, 159 aa, Listeria monocytogenes
MNVHDFSEKAMNGKEIALSDYKGKVLLIVNTASKCGLTPQLEGLEAMYKKLGGDNFEILGFPCNQFLRQDPGSDEEILEFCQMNYGVTFQMFSKIKVKGKDASPLYKYLTEQTGGKKVEWNFAKFLIDENGEVVERFPSKMKPEDFEDKVEALVAKVNN

SEQ ID NO: 20002 - protein, 373 aa, Oryza sativa
MERSIGGGTCSRLHCRALFASSSVRDPLVVGFSRCTHCVVNDETSHAQLILTVDRARRSAGGILRRFRSSDTRRGGRGVGDQRRRKKRGEENRGDSMSSGGELALRQEYVIGDEIGRGRFGTVRRCYAVATGEAFAVKSTPKAPLREAEAADALDLALAEQEPKVHLVASAPGPGASPHVVALHAAFEDDAAVHLVVDLCAGGDLLSLVSSRGRLPEHEAAGLTAQLASALASCHRRGVAHRDVKPDNLLFDGGGVLKLGDFGSAGWFGDGRPMTGLVGTPYYVAPEVVAGREYGEKVDVWSAGVVLYMMLSGTLPFYGATAAEVFQCVLRGNLRFPPRAFASVSPEAKDLMRRMLCKDVSRRFSADQVLSTH

SEQ ID NO: 20003 - protein, 225 aa, Triticum aestivum
  misc_feature (4)..(4): Xaa can be any naturally occurring amino acid
MVQXLDGVKHLLAVLFKCCDLELKQPRGLEDPQVLARETVFSVSEVEALYELFKKISSAVIDDGLINKEEFQLALFKTSKKESLFADRVFDLFDTKHNGILGFEEFARALSVFHPNASVEEKIDFSFQLYDLKQQGFIERQEVKQMVVATLAESGMNLSDEIIENIIDKTFEEADTKHDGKIDREEWHNLVLRHPSLLKNMTLQYLKDITTTFPSFVFHSQVDDT

SEQ ID NO: 20004 - protein, 1080 aa, Candida albicans
MYATAHTIKQQQQQQQQHPPPPLNGGLHASGAPPNSHEAAAIAQQQQQQQQHHNGPGMIVAAAAASANQQAVQARAQQQQQQQQQRLPSSAALNETTVSTWLAIGSLAESLGDIERATASYNSALRHSPNNPDILVKIANTYRSKDQFLKAAELYEQALNFHVENGETWGLLGHCYLMLDNLQRAYAAYQRALFYLENPNVPKLWHGIGILYDRYGSLEYAEEAFVRVLDLDPNFDKANEIYFRLGIIYKHQGKLQPALECFQYILNNPPHPLTQPDVWFQIGSVYEQQKDWNGAKDAYEKVLQINPHHAKVLQQLGCLYSQAESNPSTPANGAAPPHKPFQQDLTIALKYLKQSLEVDQSDAHSWYYLGRVEMIRGDFTAAYEAFQQAVNRDARNPTFWCSIGVLYYQISQYRDALDAYTRAIRLNPYISEVWYDLGTLYETCNNQISDALDAYRQAERLDPNNPHIKARLEQLTKYQQEGNTHPPQPPPSSQQPRLPQGMVLESTQQQQQQQPPPPPQQQQQQLQHQSQSQPQPQQPPQTQSQPSLLQHQSSLPPQQIQPLHQQAAKPLVNQQQSPPPPHLMNLGQPGQQPQQLPPHLPPHTQQPSQIQEKPPTQEQPHYQPPPPPQHQQQSQSQPQPPHQPQHTQNQSPQLAQLPPHHSNPPAKPHGAPQQRTGLPDLLHNSANIISAPSQVPQPQQQYQQPHIAPVRQEQVNHVPSIYSAPRPTETTLPQINNPNESTTTQVPQLKKEEPKPEATVSAPVPEAIKVQDQVTIQESAPAAAAAVSAPASAPVGDIKTDTVSTTTPATSTTADAVPVSVSQVGEAPNVVQEKKVPDTEQIVSQVEKPVESQPEVTPAPTPAPALATAPTEPAPTDKDVVMAPSKSATPVPQSIVEQNTRVSEATKAPESNGKHDLEDKNDEEKILKRPTVETTTESVPVNQPVEKENEKVEVPPPSEQPSSEKREKEVNGSIKKPLENESKVDIPQFSSNITAQNEEAKSGEETKKDTTKTSPAKQGEVKEVIPSSTETVSKPDVEKDNKEKDKDEDEVMADEDDVKKDENPEPPMRKIEEDENYDDE

SEQ ID NO: 20005 - protein, 271 aa, Unknown
  delta proteobacterium MLMS-1
MKQPQNIIHFVGAGPGDPELITVKGSRLLAAAELVVYTGSLVPRELLRGLAAEIHDSAGLTLAEVIDLLAAGWRAGKKVVRLHTGDPTIYGAIGEQMARLAELGIPWRVVPGVSSATAAAAALDAELTLPEISQTVIITRRGGRTPVPAAEDLTGLAAHQATMLILLSAGMIEQVVAELLAGGYPSTTPAAVVEKASWPEQRIVRGTLADIAAQTTAAGITKTAIIAVGRVLAAAPPPVLSKLYDAGFSHGYRSGGEQQTADRKRERKRRN

SEQ ID NO: 20006 - protein, 786 aa, Unknown
  Bradyrhizobium sp. BTAi1
MTPPMPNPTGASSEALLEAMQAPPPAAGALSFRMFLASVLAAAATVVAVELLTDLQKDRIVSLLMLAFGAVVVMIVLTSMLIRKSRHAIALANALARQNDQLAQTTRLLGDAQRIGRLGHWVTDPSGEFAVWSDELFEIAGLEPVDQVAFAKMLDIIHPEDVGAYVRARDRSRATGCAFIQELRFVTPNGQVRWVRIEANASDEADGVFRERFGIVQDITERKLAEINADQARLLLMDAIESLTNGFVLFDKDDRFVMSNTMFREMFPAWTVLMKPGISFTELMRRAYEHGLIRSKGDRFEEWLARKTAWHLGGSRMIEHRELNGRWIQSVDHRISDGGTVCLVTDITAFKTVQAELEQKLAYVEAIRSDLEQQTQELEARGAELRAARDAAEAANRAKSDFLAIMSHEIRTPLSGMVGMVDLLRGTSLSEEQKRYTALAKESADLLLEVINDILDFSKLEAGRLQSECIDFDVPNLVESAVSFMGEKARRRGLDLKVSLAPGLPQYLEGDPTRIRQVMLNLVGNAIKFTEQGSIEVRASHRQLDGGVVDLRIEVIDTGIGMSPEILAQIFDPFVQADTSISRKYGGSGLGLAICRQLCTIMGGSIGVDSELGRGSRFWFETKCRCGEALALPAETVVASVDRPLDILVAEDSPIIATLIQSLLVKQGFRPTMVVNGAEAIAAISDKVYDLVLMDVQMPEMDGISATKAIRQLPGPERCVPIIALTANALVGQRETYLAAGMNDYVTKPIQPPLLFAAIRRWALPQYADAPPLQAGGNGQLEMFVS

SEQ ID NO: 20007 - protein, 163 aa, Unknown
  Azoarcus sp. BH72
MTTPLYDIPLQRLDGSAATLADYAGKVLLIVNTASQCGFTPQYAGLEMLYRNYKDRGLVVLGFPCNQFGAQEPGDASEIADFCERNYGVSFPMFAKLDVNGDNAHPLYVALKQQAPGVLGTEAIKWNFTKFLVDRHGEVIERYAPTTTPQDLAGDIEAQLARA

SEQ ID NO: 20008 - protein, 89 aa, Triticum aestivum
  misc_feature (80)..(80): Xaa can be any naturally occurring amino acid
MPSLQKALPPELADNALRLYRECLRRAKFIGSQQHNTGLLVSMVRQQFKKNMHETDPEKIQKMKDDAARGLINHIIYESXKMTGRKFSS

SEQ ID NO: 20009 - protein, 742 aa, Clostridium thermocellum
MKKMGLGRFSNKFVLTVLLFFLTAVLLPSSSFESKVQAASSPRYGGAYYNYGEALQKAILFYKANRLGDLPDDYILPYRADAAMTDGQDVGLDLTGGWADAGDGIKFTHPMSYAAGQLGWAVYEYRQAFEKAGLLDDILDEIKWATDFFIKAHPEPNVLYYMCGYNDSDHSVWVPHELLDYVTDRKSFVLNPSTPGSDVAGQTAACLAIALIIFEPTDPEYAETCLTHAKQIFEFGDKYRAKKSSGCFYTPSGGYLDDLAWGAVWLYIKTGDSTYLEKAKSFLPVTSLGGGHTHCWDDVSYGAALKIAQLTHDEGYAAMVEKNLDFWLPGGGITYTPGGLAWLSPWGSLRYASTAAFLAFVWADDPTVGTPSKKETYRAFAEKQINYILGDNPRKGSYVVGFGENSPKHPHHRTAHGSWVSMLEVPSFHRHILYGALVGGPTDDDSWEDDISDYTRNEVATDYNAGFVGALAKMYDMYGGEPLENWPQPEDFRAPGDDIVEYFCRGWIIYEGYGTLNLLLQVNNSSGWPPTMKDKLSVRYFMDLTEVFESGGTVDDVQISLGQNEGAKLIGLKHYRDNIYYFTVDFTGTMIMPAEWEMCEKDAHVTIKYRDGITGSNENDWSYQNLRKDPDYDATSFAGLTPYIPVYDNGVLLWGEEPPAVDDPGSSPPPTPTEPVIVYGDLNGDGNINSTDFTMLKRAILGNPAPGTNLAAGDLNRDGNTNSTDLMILRRYLLKLIGSLPI

SEQ ID NO: 20010 - protein, 291 aa, Ashbya gossypii
MSEILRAKVKVALVQLAGSSASKAANLARAGQFIERAMTEQPDTGLVVLPECFNAPYEIGKFREFAEVAAEGPESPSVGFLAGQARRWGVTLVGGTIPELEPDTQRVYNTCLVFDGKGALVGKHRKVHLFDVDIPGKITFTESRTLAAGRHVTQVDTPAGALGVGVCYDLRFPELAMVCARRGAYAMVYPSAFNTTTGPLHWHLLARARSVDNQIYTLLCSPARVAGASYQAYGHSLVVDPTGRVVAEAGEGEEILYATLDPAELDWVRRAIPVTRQRRFDVYADVAASSP

SEQ ID NO: 20011 - protein, 715 aa, Unknown
  marine gamma proteobacterium HTCC2207
MTPITKSFQYGNHTVTLETGRIARQATGAVLCSIDDTSVLCTVVGAREAKPGMDFFPLGVHYIEKAYAAGKIPGGFFKREGRPNEKETLTSRLIDRPIRPLFPNGFKNEVQVVCTVMSAEKNIDPDIAAMIGTSAALSISGIPFNGPVGGARVGYTDEQGYLLNPTYSELADSALDMVVAGTKDAVLMVESEASELSEDIMLGGVLFAHQEMQSVITVIAELAAEVGKPRWDWVAEVENADLKTALNDLVGADLDAAYQTVDKQARVVKINALRDIANAQLIAEDGPTAEDIKDSFKKLEKSIVRGRIIRGEPRIDGRDTTTVRGIDVEVGILPKVHGSSLFTRGETQAIVAATLGSTRDAQMIDALEGRRDDPFMLHYNFPPYSVGEAGRIGFTSRREVGHGRLARRGINAVLPSPEEFPYAMRVVSEITESNGSSSMASVCGSSLALMDAGVPLKAPVAGIAMGLVKEDSGYAVLTDILGDEDHLGDMDFKVAGTAAGITALQMDIKIEGITEEIMEIALEQAMQARLHILGEMNKVISTGRDEVADTAPRMGVMQIDSDKIRDVIGKGGATIRGLCEEHNSTIDIDDSGAVKVYSEDTAGLNAAMDAIAAIVADPEPGTIYEGKVVRIVEFGAFVNFMPGTDGLVHISQIAQERVAKVTDYLSEGQTVRVKVLEIDNRGRVKLSIKEAQSDEGTTPEAPAVPAATEEAAPEA

SEQ ID NO: 20012 - protein, 289 aa, Pseudomonas aeruginosa
MSDTPYIFDVTGANFEQLVIENSFHKPVLVDFWADWCAPCKALMPLLAQIAESYQGELLLAKVNCDVEQDIVMRFGIRSLPTVVLFKDGQPVDGFAGAQPESQIRALLEPHVKAPALPDEDPLEVAQALFAEGRIGDAEATLKALLAENNENAAALILYARCLAERGELEEAQAILDAVKSDEHKQALAGARAQLTFLRQAADLPDSAELKSRLAADAGDDEAAYQLAVQQLARQQYEAALDGLLKLFLRNRGYQDDLPRKTLVQVFDLLGNDHPLVTAYRRKLYQALY

SEQ ID NO: 20013 - protein, 773 aa, Oryza sativa
MAPADIPPPLEGKKRRIGVMTSGGDAPGMNGSVRAVVRMALHSNCEAYAIYEGYDGLVKGGDMIKEMKWEDVRGFLSEGGALIGTARCMEFMQRDGRRTAAKNMILKGIDALVICGGDGSLTGADRFRDEWPSLLEELVERKELTKDQVAPFKHLNIVGLVGSIDNDLSMTDATIGCYSSLARICEAIDSVDTTATSHQRAFVVVTMGRHCGWLTLMAGVATGSDFIFIPKQPAKEGWEGNMLHIIQKHRAMGKRKTIVIVAEGAIDENLNKITPHQIKEILSEAGLDTRVTTLGHVQRGGQPAAYDRMLSTLQGAEAVKAVLEATPETPSPVICMIENKIVRRPLLEAVAQTKKVAEAIEKKDFKTAMDLRDAEFSEYFKAYQITTAAEQPNLMLPKEKRMRVGIIHVGAPAGGMNAATRAAVAYCLARGHTPVALHNGFPGLIRHHSDKPLGAVRDIDWLDAETWANKGGSEIGTNRGLPSEDLETVAYVFKEYKIEALFVVGGFEAFTAVSELRKGREHYKSFKIPMVILPATISNNVPGTEYSIGSDTCLNALIQYSDACRQSASASRRRVFVVETQGGESGYIATIAGLSIGAFAVYTPEDGISLKMLDHDIDALRDAFTKDKGQNRAGKVILVNEKASKTYSVQIIADMIAEAGKGKFESRHGVPGHFQQGTIPSPMDRVRAVRFAFRSMEHIEQYAGMDPDDIDDDAMSTAVIGIKGAKVLFSPMEAIEKKETDWHRRRPKKEFWMELKQYVDILSGRPPNNKAQH

SEQ ID NO: 20014 - protein, 179 aa, Lactobacillus plantarum
MAIEVGTKVTGKVSGITNFGAFVNLGNNQTGLVHISEVSDGFVKDIHDVLSVGDDVTVKVLSVGDDGKIGLSIRKAVDKPQGEHEHHGNHQGGNRPNNHQGNNHGHGERQTNGNHHDRSNNFHSRGGNGGGRYQSRQHEPKKQDFDSLMSGFLKDSEDRLATLKRNTEGKRGGRGGRRS

SEQ ID NO: 20015 - protein, 267 aa, Lactobacillus plantarum
MKTKPEALMRDLYNLIINPATRDWERHLLVQAKNNRQQLSPTGQLKQLEADLRPLAMRNNLTPDVMDFYLAITGNAPMPTKNNVSAYPTLSSPYEERAVFAGGCFWCMVEPFDQRPGINNVISGYTGGSWAQPTYEQVSGQYTGHVEAVEIRYDSRKISYQNLVDIYWQLIDPTDRFGQINDRGSQYRPVIFYANQHQLTIAQASKQALVDSQRYQKPIVVAIEPLQQFWPAENYHQDFYRKQPRRYRQLKKAHDHYLNWLKFKNKF

SEQ ID NO: 20016 - protein, 534 aa, Oryza sativa
MGNSCQNGTYGNNYQNSNRFQNDRFASRYVDGNDTEDCYSGSSRASLAGALRQGLNLKSPVLGYKTPNVRELYTLGRELGQGQFGKTYLCTEISTGCQYACKTILKSNLRCVSDIEDVRREIQIMHHLSGQKNIVTIKDTYEDEQAVHIVMELCAGGELFSKIQKRGHYSERKAAELIKIIVGIIETCHSHGVMHRDLKPENFLLLDADDEFSVKAIDFGLSVFFRPGQVFREVVGSPYYIAPEVLEKRYGPEADIWTAGVILYVLLTGVPPFWADTQSGIYEKVLDGRIDFKSNRWPRISDSAKDLIKKMLCPYPSERLKAHEVLKHPWICDNGVATNRALDPSVLPRLKQFSAMNRLKKLSLQIIAERLSEEEIVGLREMFKAMDTKNRSVVTFGELKGLKRYSSVFKDTEINDLMEAADDTTSTINWEEFIAAAVSLNKIEREKHLMAAFTYFDKDGSGFITVDKLQKACMERNMEDTFLEEMILEVDQNNDGQIDYAEFVTMMQSNNFGLGWQTVESSLNVALREAPQVY

SEQ ID NO: 20017 - protein, 613 aa, Moorella thermoacetica
MCGITGWVDWELDLTGQKNILEAMTATLACRGPDAAGTWVAPRVALGHRRLVVVDPAGGGQPMVRRRGNQTFVLTYNGELYNTGEIREELLSRGYTFRGHSDTEVLLTAYMEWGVECVRRFNGIFAFAIWDEARERLFLARDRLGVKPLFYATLPHSFLFGSELKALLAHPAIKPEVDAEGLAEVFVLGPARTPGHGVFHNLAELKPGYYMTYDRQGLRLHQYWALQSHPHTDNLETTIAKVRQLLQDTVERQLVADVPVCTLLSGGLDSSAVTVFAARAFQGRGQGHIHTWSVDYIDNDRYFQPSHFQPNPDAPWVKLVSEHLETIHHYVYIDTPELVDSLKAAMRARDLPGMADVDSSLLLFCREVKREATVALSGEAADEVFGGYPWFRSEKALAANTFPWNRAGQERIRLLSPELKAMVRPEEYVARRYREALAEVPALPGEEARAARLREISYLSLTRFMPVLLDRKDRMSMAVGLEVRVPYCDHRLVEYVWNIPWEMKFVGQMEKGILRRALAGILPAEVINRRKSPYPKTYNPAYLEAVRNWMLDILADPASPLLPFIDVAAVKALTQSREVFNLPWFGQLMSGPQLFAYLAQIDTWMREYGVSVR

SEQ ID NO: 20018 - protein, 112 aa, Moorella thermoacetica
MKKIEAIIRSSRLEAVKEALGKYNIHGLTVTHVLGCGLQRGQTEYYRGNLYTVNLLPKVKLEIIALDNRVPEIVEIISREARTGEIGDGKIFIYPVETAIRIRTGEQGEDAI

SEQ ID NO: 20019 - protein, 112 aa, Wolinella succinogenes
MKKIEAVIKPFKLEEVKSALVERGISGMTVSEVKGYGRQKGHTELYRGAEYVVDFIPKIKLEIVVRDEEVEGIIEAIIKSAKTGKIGDGKIFVTPVERAIRIRTQESDEEAI

SEQ ID NO: 20020 - protein, 328 aa, Streptomyces ambofaciens
MTLRRTLTPSAMCDSLCYMTRQRWTAEQIPDQTGRVSVVTGANSGLGLATTKTLARKGAQVVLAVRDEEKGRRAADAIIAEQPGAHLEVRRLDLADPASVRAFAHQLHTDGYRVDVLVNNAGLMAPPRTLTLQGHELQFAANHLGHFALTGLLLDLMTDSDDPRVVTVTSANHRQARIAFDDLSGERKYSPMGHYNQSKLANAAFGWELHRRLSAAGSPVRSVLAHPGYTATNLQTSTPAGMVKLLFGRLLLPLAQSPDQGALPQLYAATAPEVQGGELFAPDGMGELRGAPKRAQLAPRATDPDTVSRLWQLSEQLTDVRYVLRAAT

SEQ ID NO: 20021 - protein, 352 aa, Oryza sativa
MATTASSLLKTSFAGARLPAAARNPTVSVAPRTGGAICNSISSSSSTPPYDLNAIRFSPIKESIVSREMTRRYMTDMITYADTDVVVVGAGSAGLSCAYELSKDPSVSVAVIEQSVSPGGGAWLGGQLFSAMVVRKPAHLFLDELGVAYDEQEDYVVIKHAALFTSTVMSRLLARPNVKLFNAVAVEDLIVKEGRVGGVVTNWALVSMNHDTQSCMDPNVMESRVVVSSCGHDGPFGATGVKRLQDIGMIDAVPGMRALDMNTAEDEIVRLTREVVPGMIVTGMEVAEIDGAPRMGPTFGAMMISGQKAAHLALKALGRPNAIDGTIKKAAAAAAHPELILASKDDGEIVDA

SEQ ID NO: 20022 - protein, 391 aa, Arabidopsis thaliana
MTKENPSTLNLGQPKAQEKYSTSLAKINPKPSGSSTVESKSQDNNSPSLKRWRSSSGFNLFSNSLLCFTTNRLRLPRSASTTRADLRLRINCVDGIKHLCTSVLGCFDLDLYKQSGGLGDPELLARDTVFSVSEIEALYELFKKISSAVIDDGLINKEEFQLALFKTNKKESLFADRVFDLFDTKHNGILGFEEFARALSVFHPNAPIDDKIHFSFQLYDLKQQGFIERQEVKQMVVATLAESGMNLKDTVIEDIIDKTFEEADTKHDGKIDKEEWRSLVLRHPSLLKNMTLQYLKDITTTFPSFVFHSQSKLSDVTSPPNDEFSEISSTRINLHDDKKWIFDETPLERRGDDLTNKGIRKQSFGGWLRSRDMNNVLPKRRRGEKREKKPN

SEQ ID NO: 20023 - protein, 185 aa, Arabidopsis thaliana
MASEARESPANNPGLSTNRDEATKGYIMQQTMFRIKDPKASLDFYSRVLGMSLLKRLDFSEMKFSLYFLGYEDTTTAPTDPTERTVWTFGQPATIELTHNWGTESDPEFKGYHNGNSEPRGFGHIGVTVDDVHKACERFEELGVEFAKKPNDGKMKNIAFIKDPDGYWIEIFDLKTIGTTTVNAA

SEQ ID NO: 20024 - protein, 147 aa, Staphylococcus epidermidis
MSIRQITFKCKNSCYIRYILMEHGDIMSKTPYELIGQKALYQMIDHFYQLVEKDSRINHLFPGDFKETSRKQKQFLTQFLGGPDLYTQEHGHPMLKRRHMEFTISEYERDAWLENMHTAIQHAELPAGVGDYLFERLRLTAHHMVNS

SEQ ID NO: 20025 - protein, 97 aa, Glycine max
  misc_feature (72)..(72): Xaa can be any naturally occurring amino acid
  misc_feature (86)..(86): Xaa can be any naturally occurring amino acid
MASSMISSPAVTTVIRAGAGMVARFTGLKSMAGFRSSKTINDITSIATNGGRVHCMQVWSPVGNKLFETLSXLPFLDDVQLAHELXYLLMNGWIPCL

SEQ ID NO: 20026 - protein, 882 aa, Unknown
  Frankia sp. CcI3
MSSRSLVVVGHGMVGHRLLAALRDRDVEGRWDVTVLAEEPRPAYDRVGLSAYFTGATAEDLSLVEDGFLEHPRLRVRLGEPVVAVDRAARTVTTGAGRTYRYDALVLATGSYPFVPPVPGREATGCHVYRTIEDLDAISASARGSRTGTGVVVGGGLLGLEAANALRSLGLATHVVEFAPRLMPAQVDEAGGQTLRAHITGLGIGVHTDTATERIEADADGRVARMVFARHPEGLAGLDTDVVVFSAGIRPRDALARECGLDVGDRGGIVVDEGCRTSDEHIYAVGECALAAGRVYGLVAPGYAMAEVVADRLLGGDATFTGADMSTKLKLLGVDVASFGDAFGTTPGALPITFADPVAKVYKKLVLSDDARSVLGGILVGDAGEYGTLRAMVGSAGVVPDDPARLILPAGDVAGAGGSGAGVALSAGAQICSCNNVTHGQICAAISANGLTDVAGIKGCTNAGTSCGSCVPMLRTILGQQLAAAGLEVSKALCEHFDVSRAELFEIVRVRGITTFSQLIAEHGRGRGCEVCRPVVASILASLYNGYVLVGEQAALQDTNDHLLANMQKDGTYSVVPRLPGGEVTPETLILIGEVARDFNLYTKITGGQRIDLFGARAEQLPKIWKRLTDAGLESGHAYGKALRTVKSCVGETWCRYGVQDSTTLAVDLELRYRGLRSPHKIKMAVSGCARECAEARSKDVGVIATEQGWNLYLGGNGGHRPRHAELFASDLDTETLVRYIDRFLMFYVRTADRLQRTAPWVESLDGGLGHVREVIVDDSLGICAELDTAMAYHVATYQDEWKTTLADPVALRRFASFVNAPEGADPDVIHVLERGQPRPARPAERAALIAGATLPVVADRFLAYPGSLPIQRDETDTKASG

SEQ ID NO: 20027 - protein, 437 aa, Bacteroides fragilis
MTVLRSMKDFSSMNITASILLFVTAIAAAVIANSPAASVYQEFLSHELHFRIGGFNLLSHAGHNLTMIEFINDGLMTIFFLMVGLEIKRELLVGELSSFRKAALPFIAACGGMVVPVVIYSMVCAPGTEGGQGLAIPMATDIAFSLGVLSLLGKRVPLSLKIFLTAFAVVDDIGGILVIAIFYSSHVAYEYLLWAALLYVLLYFIGKKGATNKIFFLVVGVVIWYLFLQSGIHSTISGVILAFVIPAKPQLNVGTYIERIRRIISTFPEMGANNIVLTNQQIAKLKEVESASDRVISPLQSLEDNLHGAVNYLVLPLFAFVNAGVMFSGEGEVIGGVTLAVALGLLAGKFLGIYSFTWLAVKSGLTPMPLGMNWKNISGVALLGGIGFTVSLFIANLSFGSAHPVLLNQAKLGVLSGTVMAGILGYLVLHWVLPQRR

SEQ ID NO: 20028 - protein, 276 aa, Unknown
  Frankia sp. CcI3
MTGAQTAPGGWVALVGGGPGRADLITVRGLRLLQAADVVVVDRLAPRELLDEVRPGTEIIDAGKAPHGHNLTQDEINAVVVDRGLRGFGVVRLKGGDPFVFGRGGEEALACAAAGLPCEIVPGVTSAVAVPALAGIPVTHRGITQDVAVVSGHIDPSHPGSTADWDALATGPGTVVVLMGVGALFEISHELVKRGRRPETPTAVIHAGGTADETIIIGPLVDIAQLAAEAAISSPAVIVIGDVVTLRDRLAGVIGTVGAVPAWPGSGDVTGGEDRQ

SEQ ID NO: 20029 - protein, 145 aa, Salmonella enterica
GKVKGGFTVELNGIRAFLPGSLVDVRPVRDTLHLEGKELEFKVIKLDQKRNNVVVSRRAVIESENSAKRDQLLENLQEGMEVKGIVKNLTDYGAFVDLGGVDGLLHITDMAWKRVKHPSEIVNVGDEINVKVLKFDRERTRVSLG

SEQ ID NO: 20030 - protein, 295 aa, Methylobacillus flagellatus
MYKTLDDFVGNTPLVKLQRMAGKTSNTILLKLEGNNPAGSVKDRPALSMIKRAEARGDIKPGDTLIEATSGNTGIALAMVAAMRGYKMVLVMPDNQSVERRQSMKAYGAELVLTPRDGGMELARDVATKLQAEGEGIVLDQFANQDNPLAHYEGTGPEIWRDTAGKITHFVSSMGTTGTIMGTSRYLKEQNRDIRIVGVQPEEGAQIPGIRKWPEEYLPKIYDAKRIDELVYVNQENAEKTTRRLAQEEGIFAGISSGGALYAALQLSKRVENAVIVTIVCDRGDRYLSTGVFPS

SEQ ID NO: 20031 - protein, 485 aa, Saccharomyces cerevisiae
MVHLGPKKPQARKGSMADVPKELMDEIHQLEDMFTVDSETLRKVVKHFIDELNKGLTKKGGNIPMIPGWVMEFPTGKESGNYLAIDLGGTNLRVVLVKLSGNHTFDTTQSKYKLPHDMRTTKHQEELWSFIADSLKDFMVEQELLNTKDTLPLGFTFSYPASQNKINEGILQRWTKGFDIPNVEGHDVVPLLQNEISKRELPIEIVALINDTVGTLIASYYTDPETKMGVIFGTGVNGAFYDVVSDIEKLEGKLADDIPSNSPMAINCEYGSFDNEHLVLPRTKYDVAVDEQSPRPGQQAFEKMTSGYYLGELLRLVLLELNEKGLMLKDQDLSKLKQPYIMDTSYPARIEDDPFENLEDTDDIFQKDFGVKTTLPERKLIRRLCELIGTRAARLAVCGIAAICQKRGYKTGHIAADGSVYNKYPGFKEAAAKGLRDIYGWTGDASKDPITIVPAEDGSGAGAAVIAALSEKRIAEGKSLGIIGA

SEQ ID NO: 20032 - protein, 520 aa, Gossypium hirsutum
MVGNSLAGLQDHLKLAREYALEGLYDTSIIFFDGAIAQINKHLNTLDDPLIRSKWMNVKKALSEEAEVVKQLDAERRSFKEAPNGRRPSSPPIHAKSSFVFQPLDEYPTSSGAPMDDPDVWRPPSRDTSTRRPARGGQAGMRKSPQDGISGRGSTRTAATGRGAKAGASSRTNTGVRGSTTGKKGTGSGKPSKGDSANGDAEDGKSKRSQYEGPDPDLAEMLERDVLETTPGVRWDDVAGLTEAKRLLEEAVVLPLWMPEYFQGIRRPWKGVLMFGPPGTGKTLLAKAVATECGTTFFNVSSATLASKWRGESERMVRCLFDLARAYAPSTIFIDEIDSLCNARGASGEHESSRRVKSELLVQVDGVNNTGTNEDGSRKIVMVLAATNFPWDIDEALRRRLEKRIYIPLPNFESRKELIRINLKTVEVAADVDIDEVARRTEGYSGDDLTNVCRDASLNGMRRKIAGKTRDEIKNMSKDEISKDPVAMCDFEEALAKVQRSVSQADIEKHEKWFSEFGSA

SEQ ID NO: 20033 - protein, 521 aa, Gossypium barbadense
  misc_feature (399)..(399): Xaa can be any naturally occurring amino acid
MVGNSLAGLQDHLKLAREYALEGLYDTSIIFFDGAIAQINKHLNTLDDPLIRSKWMNVKKALSEETEVVKQLDAERKAFKEAPNGAAVLLPTRSCQIIFLCFHPLDEYPTSSGAPMDDPDVWRPPSRDTSTRRPARGGQAGMRKSPQDGISGRGNTRTAATGRGAKAGASSRTNTGVRGSTTGKKGTGSGKSSKGDSANGDAEDGKLKRSQYEGPDPDLAEMLERDVLETTPGVRWDDVAGLTEAKRLLEEAVVLPLWMPEYFQGIRRPWKGVLMFGPPGTGKTLLAKAVATECGTTFFNVSSATLASKWRGESERMVRCLFDLARAYAPSTIFIDEIDSLCNARGASGEHESSRRVKSELLVQVDGVNNTGTNEDGSRKIVMVLAATNFPWDINEALXKRLEKRIYIPLPNFESRKELIRINLKTVEVAADVDIDEVARRTEGYSGDDLTNVCRDASLNGMRRKIAGKTRDEIKNMSKDEISKDPVTMCDFEEALAKVQRSVSQADIEKHEKWFSEFGSA

SEQ ID NO: 20034 - protein, 250 aa, Manihot esculenta
MPKNYPKVSEEYQKAIDKARRKLRGFIAEKGCAPLMLRIAWHSAGTYDVKTNTGGPFGTMRHAAEQGHAANNGLDIAVRLLEPIKEQFPILSYADFYQLAGVVAVEITGGPDIPFHPGREDKPEPPPEGRLPNATKGADHLREVFGKTMGLTDKDIVVLSGGHTLGRCHKERSGFEGPWTPNPLIFDNSFFQVLLDEPTEDLLQLPTDSVLVTDPVFRPYVEKYAADEEAFFADYAESHMKLSELGFAEA

SEQ ID NO: 20035 - protein, 1112 aa, Ashbya gossypii
MSAVEKEILRILDIDDTVVSEFVLNIYAQSDDIQSFKKQLLDLDVGIDEARTDELYCCIEKHKGQIPGDGDASGTTNELQQLLKAELGVDDPVVAEYVADIYSKHKSLTKFHEKLSEIDSGLSSASIFKIHKLLRQTCPTGEKTEAPKADVSALCLPNREARWDDIRGEGFMEPELDVTPIEGKIYRAVIRNIKPFGCFARVLGTKRSCEGLIHISQLSHSRVGSPNDVVSVGDHVYVKITKVQDNGKLSLSMREVDQATGQTATVNRGRSDERTVYRRQLSSPERWEIRQMIQSGVSSIDDYPELKEELSHLQQQTQVAGSKHSNESDELIDVELNTEHEPKFLSGHTATAKKPELPTIVKLPKGSLNNTAMTGSKLLQEHRQEKLALQKSTDKKERLLRELDDSGHKKKAFEDKQRALTAWERKRMAEKVTYGKRTNLSIKQQRESLPVFKMRETLVSAIRDNQFLVIVGETGSGKTTQITQYLDEEGFSVGGMIGCTQPRRVAAVSVAKRVSEEMGCKLGEDVGYTIRFEDQTSRKTRIKYMTDGMLQVEALLDPTMSRYSVIMLDEAHERTVSTDVLFSLLKQAALKRPDLRVIVTSATLDSEKFSKYFLDCPVIKISGKTFPVDVIYSETPQLDYIEAALDTVMEIHINESPGDILVFLTSQEEIDACCEILYERVQALKETIQELLILPVYSALPSEVQSKIFEPTPKGSRKVIFATNIAETSITIDGIYYVVDPGYAKSNIYNPKIGIEQLVVSPISQSQADQRKGRAGRTGPGKCYRLFTEAAFHREMVPNSVPEIQRQNLEHTILMLKAMGINDLLNFDFMDPPPRSSMVHALEALYNLQALDEDGYLTQLGKRMSQFPMEPALSKSLIASVEQGCSDEILTIIAMLSVQNVFYRPKDKIQETRYSKKHGFHHPFGDHLTLLNIHNRWQENNFSKSFCAENFLHERHLRRAKDVKEQLKRIFKNLDLPIRSCHGNVDLIRKTLVSGFFRNAAKRDPQVGYKTIVDETAVSIHPSSCLFGKECDYVIYHSLVLTSKEYMSQVTLIDRKWLMDNDLPLDTLYDHFRRQARELHLVPLPDTVRSDQDSWRLSSIRQSKERALGIKR

SEQ ID NO: 20036 - protein, 474 aa, Pichia angusta
GLEHHHHHHQDITELPFPVRQDSPLTEVLPTDLKTKDNFVARDPDLLRLTGSHPFNSEPPLTKLYDSGFLTPVSLHFVRNHGPVPYVPDENILDWEVSIEGMVETPYKIKLSDIMEQFDIYSTPVTMVCAGNRRKEQNMVKKGAGFNWGAAGTSTSLWTGCMLGDVIGKARPSKRARFVWMEGADNPANGAYGTCIRLSWCMDPERCIMIAYQQNGEWLHPDHGKPLRVVIPGVIGGRSVKWLKKLVVSDRPSENWYHYFDNRVLPTMVTPEMAKSDDRWWKDERYAIYDLNLQTIICKPENQQVIKISEDEYEIAGFGYNGGGVRIGRIEVSLDKGKSWKLADIDYPEDRYREAGYFRLFGGLVNVCDRMSCLCWCFWKLKVPLSELARSKDILIRGMDERMMVQPRTMYWNVTSMLNNWWYRVAIIREGESLRFEHPVVANKPGGWMDRVKAEGGDILDNNWGEVDDTGQAG

SEQ ID NO: 20037 - protein, 599 aa, Campylobacter upsaliensis
MSKNKILSLLFCLAVLGVFYLTPIPMGLEANSWHFLGLFVAVILAVILQVMPLGAVCLIAIAIVALSGITTPQSQIRAVHIKSLQGIVMSDNANSQKIAMDKATEEAILNALLNTSKMPKEKLDELLSIKDKNRQIDLLAKFYAKQTSQVQKNKLIDESKIFALNTLALQNMSQKDIDERVNKAISSLKSKTGINDALSGFSNSLIWLIVVSIIIARGVIKTGLGKRLAYYFISIFGKRTLGIAYSIVASETILAPVTPSNTARAGAIINPIVQAISRSFKSSPEDNTQSKIGTYLSLVNYQANPISSAMFITATAPNPLVVDLVAQATNMDISLTWTQWALGMFLPGICAMFIMPLVIYFLSPPEIRQTPNASKFAKERLAELGAMKRAEKIMLGVFLLLLALWAGALGLFFGISLNATTVALLGLSLVLVSGVLSFDDVLKEKTAWNTLVWFSALVMMATMLGKLGVTQFLAEALGGLASSMGLGEISVMIFLSLAFLYAHYFFASTTAHISAMFFVFYSAGLALGAPPLLYAFIMITSSNIMMALTHYATGTAPVIFGTNYVTLKRWWGVGFVISVVDMLVMISVGLVWWKFLGFY

SEQ ID NO: 20038 - protein, 70 aa, Glycine max
VFYTPFLRHLWTWLGLTPATKKNFISLLASGHSCILIPGGVQEAFHMQHGTEVYCFSFLLLNAYVIYLFF

SEQ ID NO: 20039 - protein, 424 aa, Pichia angusta
GSHPFNSEPPLTKLYDSGFLTPVSLHFVRNHGPVPYVPDENILDWEVSIEGMVETPYKIKLSDIMEQFDIYSTPVTMVCAGNRRKEQNMVKKGAGFNWGAAGTSTSLWTGCMLGDVIGKARPSKRARFVWMEGADNPANGAYGTCIRLSWCMDPERCIMIAYQQNGEWLHPDHGKPLRVVIPGVIGGRSVKWLKKLVVSDRPSENWYHYFDNRVLPTMVTPEMAKSDDRWWKDERYAIYDLNLQTIICKPENQQVIKISEDEYEIAGFGYNGGGVRIGRIEVSLDKGKSWKLADIDYPEDRYREAGYFRLFGGLVNVCDRMSCLCWCFWKLKVPLSELARSKDILIRGMDERMMVQPRTMYWNVTSMLNNWWYRVAIIREGESLRFEHPVVANKPGGWMDRVKAEGGDILDNNWGEVDDTGQAG

SEQ ID NO: 20040 - protein, 311 aa, Streptomyces avermitilis
MSDNGGVTGPDVPEALDLAALRPRLPSPVQAVDDERFARHGVRLLLKRDDLIHPDLIGNKWRKLAPNLRAAAGRPLVTFGGAYSNHLRATAAAGRLLGLATIGVVRGQELADRPLNPSLTRCAADGMRLHFVDRSTYRRKTEPGTLAAILRAVAAEDAYVVPEGGSNSPAVRGCRALGEELRGHADVVALACGTGGTLAGLAAGLGPGQRALGVPVLKGDFLTAEVTALQERAFGGRQGAWSLDDRFHFGGYARTSPGLHAFAADFERRHGLPVERLYVAKMLYGLVALAEEGGFARGTTVAAVITGRPLG

SEQ ID NO: 20041 - protein, 483 aa, Candida glabrata
MTEPIVPQALTNEELEKQILPETYQWALSNGLLMYPPDFQLTQAQIAPFTLYPTPIARKNFEEAIEVQQSFNELYAEISRDQGEHWLSQETEKLAHSDEGFTGKLWDLYKSVRNEGIAQKLRLGIFRSDYLIDKNIDQIKQVEFNTVSVSFVGFSTRVGEVHKYLNDSGAYGKSSYADKDIPVPTSVQEMTKSFADAFQKYDALNDEKKIILMVVQRGERNVFDQRIIEYSLQKDYGIRVIRMTFDDIISRLTSDNADKNRLFFKETGDEIAIVYYRTGYTTTDYQNEQDWEARKFLEKSYAIKAPDLLTQLSGAKKIQQLLTDDNILSQFVKSENSRRALQKTFVKIYPLDDSELGNIGKKLAFDEPHRFVLKPQREGGGNNVYKEDIPSFLSTIGESKWDAYILMEIIDPLPYENNVIIRGNEIFKESIISELGIYGSILFDDEKIHFNRNSGWLLRSKFTTSNEGGVAAGFGCLDSVVMY

SEQ ID NO: 20042 - protein, 959 aa, Unknown
  Azoarcus sp. BH72
MPQTLLSAPLAQLEQRDAFIHRHLGPNPDEIARMCATIGVPDIDTLIAQTVPASIRLPQALPLAGPRPEHEALELLRGLAERNAVKKSMIGMGYYGTHTPAVILRNVMENPGWYTAYTPYQAEIAQGRLEALLNFQQMVIDLTGLELANASLLDEATAAAEAMAMARRVSKSKSNAFFVDAACFPQTLDVVRTRAEYFGFNLVLGDAAEAAEHDVFGALLQYPNVHGTVGDLGAVIAALKGRGAITALATDLMALVLLKSPGAMGADIALGSAQRFGVPMGFGGPHAAFFATREAYVRSMPGRIIGVSRDARGKTALRMTLQTREQHIRREKANSNICTSQVLLANMAGFYAVYHGPQGLRTIAARIHRLAALLDAGLRAAGFAVRSSAYFDTLEVDADERAAAILSAADQAGFNLRDAGHGRIGLSVDETTTRADIAAVLACFGANVDLETLTPASALPAGLLRDDAILAHPVFNTHHTEHEMLRYLKKLQNRDLALDHSMISLGSCTMKLNATSEMIPVTWPAFANLHPFAPPAQTQGYMAMIDGLADYLKAVTGFDAICMQPNSGAQGEYAGLVAIRRYHASRGEAHRDVCLIPRSAHGTNPATAQMCGMEVVVVDCDGSGNVDLENLQSKAAQYADRLAAMMITYPSTHGVFEENIREICAAVHAHGGQVYMDGANLNAQVGLTSPAIIGADVSHMNLHKTFCIPHGGGGPGMGPIGLKAHLAPFMADHAVAATGDAERVNKGQGAVSAAPFGSASILPISWMYITMMGGEGLKRATEVAILNANYLASRLAPHYPVLYTGSRGRVAHECILDIRPIKAATGISEVDIAKRLMDYGFHAPTMSFPVAGTIMVEPTESEDLAELDRFIEAMVAIRGEILRIERGEWPADDNPLRNAPHTQGEIAAAQWERPYSREQAVFPLPWVADNKFWPSVNRIDDVYGDRNLFCACVPMEAYS

SEQ ID NO: 20043 - protein, 115 aa, Kluyveromyces lactis
ESSNKHIYNNQTMSGRGKGGKGLGKGGAKRHRKILRDNIQGITKPAIRRLARRGGVKRISGLIYEEVRNVLKTFLESVIRDAVTYTEHAKRKTVTSLDVVYALKRQGRTLYGFGG

SEQ ID NO: 20044 - protein, 373 aa, Unknown
  marine gamma proteobacterium HTCC2207
MAKRDYYDVLGVDKGASAAEIKKAFRRVAMKFHPDRNPEGADAEDKFKEAQEAYEILGDDDKKAAYDRFGHAGVDGNSGGGQRGGGGGFGDVFGDVFGDIFGGGGGRGGPARGSDLRYDLQLDLEDAVRGKTVQIDVPTMTTCDPCDGSGARRGSSPVTCTTCNGAGQVRMSQGFFSVQQACPQCRGRGQMISDPCGSCHGQGVIEEQKTLSVKIPAGVDTGDRIRLGGKGEAGPQGGPPGDLYVQMVVRDHPIFVRDDANLHCEVPISFAQAALGGELEVPTLSGKVKLKIPAETQSSKLFRLRGKGVAPVRGGGVGDLLCRVVLETPVNLSSEQRELLKKFEESLAGKSKHSPRSSNWFDGVKKFFDNLTS

SEQ ID NO: 20045 - protein, 387 aa, Campylobacter upsaliensis
MTLFERLKNFVYNEAFGGVLLIICTIFALLVQNSFLSDHYRELLNLNMGFIAGEFRLEKPFLLWVNDGLISIFFFVIGLELKKEFMQGVFKEVRSIILPFAAAVGGIIVPASIFALVNVGDAYTLKGWAIPTATDTAFALAILMMCGKHIPSSLKIFLLSLAIFDDVGAILIIAIFYTSKLSIVAFIVASCVILVLLTLNLLGITRKSFYFICALILWVSVLKSGVHATLAGLIAAFFIPLFTKEGKPFLKEIDESLKFWLVFVILPLFAFANAGVNLANIDLKSIFSGASVGIFLGLFVGKQVGVFAFSYLAIKSGLARLPEGANFKQLYGVCILTGIGFTMSLFIDGLAYEVSDIFNYADNLSILVASFCSGILGFVYLKFFARA

SEQ ID NO: 20046 - protein, 180 aa, Lactobacillus plantarum
MNNDIERVLYSREDIHQVAQKLGKELTTAYAGKNPLIICVLKGAVLFTTDIIREMDIYADLDFINLSSYGNETISSGEVQLTKDLDADVTGRDVLVIEDIIDTGRTLKFLIDLLKRRDVNSVKVCTLLDKPAGRLVDIKADYIGFEVPNEFVVGYGLDYAERYRNLPYVGILKPAIYEHK

SEQ ID NO: 20047 - protein, 138 aa, Glycine max
  misc_feature (126)..(126): Xaa can be any naturally occurring amino acid
TPPLPQSARYGNVSYRTWHEKMSNSAESLIQTLLPENFHPATVELAPYFADSFGNSSRIDYGTGHETNFAAWLYWLARLGVIGEEDFPAVGARGFVKYLDLMRKLQLQYWLEPGWAHGVWGPEDYXFLPFIFGGFQVD

SEQ ID NO: 20048 - protein, 382 aa, Campylobacter upsaliensis
MQRIKKVVLSETFPGILLIFFTFFALLCKNSALSVIYTDFFHANFTVGFDNFQISKSLALWINDGLIAIFFLCIGLELKYEVLRGQLKNVRAVSLPIFGALGGMIVPALIFAFINFHDAFAMKGWAIPTATDIAFAVGILMLLGNKIPASLKLFLLSLAIFDDLGAIIIIALFYTDQLSTLAMLICLMCIFALFALNYFHITHLPLYVLVGVILWIAMLKSGVHATLAGVIIALFIPLNTKDKRPYLHNVLESLNPWVVYFILPLFAFANAGIDLRDMHLAALFSPVSLGIILGLFVGKQVGVFLFSYLAIKLKLAKLPENVRYSQFYGICILTGIGFTMSLFIDSLAYKNSDIFEHTDKLAILVASFLSAIVGYIYLKIVK

SEQ ID NO: 20049 - protein, 72 aa, Mesorhizobium loti
MPKEEVLEFPGVVTELLPNAMFRVKLENEHEIIAHTAGRMRKNRIRVLTGDKVLVEMTPYDLTKGRITYRFK

SEQ ID NO: 20050 - protein, 156 aa, Unknown
  Synechococcus sp. CC9311
MERPLPRLFVFWQHEERTGGISNMRMLHTMLRVGDLERSIRFYTEVLGMQLLRRKDYPSGRFTLAFVGYGDERDNTVLELTHNWDTAEYALGDGYGHIALGLDDIYSACTAIAEKGGRVVREPGPMKHGNTVIAFVDDPDGYKVELIQVSSRSDAA

SEQ ID NO: 20051 - protein, 238 aa, Zea mays
MAGGDDLKLLGLWASPYVLRVKLALSLKGLSYENVEEDLRDKSELLLKSNPVHQKVPVLIHGGKPICESQVILQYIDEAFAGTGPSLLPADPYERAVARFWAAYIDDKMLPAWNQSTMGKTEEERAEGKKQSVVTVETLEGALRDCGGQGKPFFGGDSVGYVDVVLGGLLGWVRASEELHGVRPFDPERTPLLAAWSERFGALDAVQTVMPDVGRLLEFGKALMARLAAAAAAGASNN

SEQ ID NO: 20052 - protein, 216 aa, Schizosaccharomyces pombe
MASHLASIYGTEQDKVNCSFYYKIGACRHGERCSRKHVKPNFSQTILCPNMYKNPIHEPNGKKFTQRELAEQFDAFYEDMFCEFSKYGEVEQLVVCDNVGDHLVGNVYVRFKYEESAQNAIDDLNSRWYSQRPVYAELSPVTDFREACCRQHETSECQRGGLCNFMHAKKPSPQLLRDLVLAQRKYLALNAAEEMKKEPNSDSTNRWVSVTAERKN

SEQ ID NO: 20053 - protein, 528 aa, Zea mays
MESFGVPPAPVAAPEKRKKPLDLKDPVPAAAAAAANGGGATKASPAAKWAEKKKLVGGDAGYVLEDVPHLTDYLPQLPTYPNPLQDNPAYSVVKQYFVNPDDTVTQKIVVHKTSARGTHFRRAGPRQRVYFQPDEVNAAIVTCGGLCPGLNTVIRELVCGLYDMYGVTSVVGIEGGYKGFYSKNTVALTPRSVNGIHKRGGTVLGTSRGGHDTAKIVDCLQDRGINQVYIIGGDGTQKGASVIYEEVRRRGLKCAVVGVPKTIDNDIAVIDKSFGFDTAVEEAQRAINAAHVEAESAENGIGVVKLMGRNSGFIAMYATLASRDVDCCLIPESPFYLEGKGGLLEFVERRLKDNGHMVIVVAEGAGQDLIAKSMNSVDTQDASGNKLLLDVGLWLSQKIKDHFKKKPRFPITLKYIDPTYMIRAVSSNASDNVYCTLLAHSALHGAMAGYTGFIVAPVNGRHAYIPFYRITEKQNKVVITDRMWARVLCSTNQPCFLSHEDVENMKHDDDEHHLHNTLLLDSPENSSK

SEQ ID NO: 20054 - protein, 505 aa, Glycine max
MPNPEAHHPSRSRARPSTSAAARPPARARVSLRQLLRVASVASGIQFGWALQLSLLTPYVQQLGIPHQWASIIWLCGPVSGLFVQPLVGHMSDRCTSRYGRRRPFILVGAVAIVAAVLVIAYAADIGWLLGDTADYRPAAITVFIVGFWILDVANNVTQGPCRALLGDLTSKDPRRTRVANAYYSLFMAIGNILGYATGSYSGWYKIFTFALSPACTISCANLKSAFFLDIAFIAVTTYISIMAAHEVPLNSSEAAHAEAGAGESGSAEEAFMWELFGTFKYFTTPVWIILSVTALTWIGWFPFTLFDTDWMGREIYGGDPNQGLVYDTGVRMGALGLLLNSVVLALTSLFMERLCRKRGAGFVWGISNIMMTVCFLAMLVVTYVANNMGYIGKDLPPTGIVIAALIIFTILGFPLAITYSVPYALISTHIESLGLGQGLSMGVLNLAIVVPQIIVSLGSGPWDQLFGGGNSPAFAVAAVSALISGLIAVLAIPRSGAQKARSHV

SEQ ID NO: 20055 - protein, 77 aa, Triticum aestivum
MSAPVSERDLFEREPCPGRIIDDAGSAFAMGAVGGSVYHFFKGLHNSPNGARITGGMQAARMNAPRLAGSFAVWGTL

SEQ ID NO: 20056 - protein, 148 aa, Photorhabdus luminescens
MTTLTIEQEYEIVSKHLSRMSVLRRFAQTKDVEWLEDVYKALEIVVQDSKETFRLMSLEAEQKEQKRLEILRLIEETGLNLKTINIPITLSDFKPKKSNAGKGKTRKPKYQFNENGEVKYWSGNGKKPSGLQKLLNEGHSLNEFLIKK

SEQ ID NO: 20057 - protein, 542 aa, Oryza sativa
MEAATVVAAPIPAADAAAKALEKKLLDLELPPFPAPAKKAAAKVVAAAPKKKLAGGAGGYVLEDVPHLTDYLPNLPSFPNPLQNHPAYSVVKQYFVNADDTVAKKIVVHKGSARGTHFRRAGPRQRVFFQPDEVSAAIVTCGGLCPGLNTVIRELVCGLHDMYGVTSVVGIEGGYRGFYARNTVELTPRSVNGIHKRGGTVLGTSRGGQDTGKIVDSIQDRGINQVYIIGGDGTQKGAATIHAEVQRRGLKCAVVGVPKTIDNDIAVIDRSFGFDTAVEEAQRAINAAHVEAESAENGVGVVKLMGRNSGFIAMYATLASRDVDLCLIPESPFYLEGKGGLLEFAEKRLRENGHMVIVVAEGAGQDVIARSMRLADAHDASGNKVLLDVGLWLCAKIKDHFKKKANFPITLKYIDPTYMIRAVPSNASDNVYCSLLAHSAIHGAMAGYTGFTVAPVNGRHAYIPFYRITEKQNKVVITDRMWARVLCSTNQPCFLSTEDVEKAGQDDEEPIVPLVEGENSLVKAPPLLANAGDRAALCNGAA

SEQ ID NO: 20058 - protein, 626 aa, Blastopirellula marina
MNANPAEATYSFGAIVRSSGVDFTVWAPQRTRVELALVDEQGNAKRLLAMQRQESGFFFVHAADAGAGDLYMYRMDGQGQLFPDPASRFQPSGVHGPSQVIDSSVYAWQDDEWAGLPLEGQVLYELHLGTFTNEGNWAGAKSKLPYLKEIGVTAVEIMPLADFQGDFGWGYDGVYWYAPSRIYGTPDDFRDFVDAAHQIGIGVMLDVVYNHFGPTGNYWNAYTPYFPSSKHGTDWGDAINYDGKGSKPIRRFVIENAAYWIREFHLDGLRLDATQTIFDDSTPHVLTETTSAARAAAGDRPIIVVAENDAQEICHVQSPESGGYGMDGVWNDDFHHACRVAATGHSEFYYADFAGTPQEMVSAMRWGYLYQGQWNQRQGRKRGSASLKTPQKHFIHFLQNHDQVSNSASALRTHALTSPGRFRALTALMLLGPQTPMLFMGQEFAASSPFYFFADHEVGIDQLAQDGRLEFMRCFPRAAGYFQTFMPNDPIGREAFERSKLNWDEVETNAPVVALHRDLLHLRKTDVTISQQDDVMLEGAVIGDEAFLLRWITPSGDDRLMFVNLGRDLSWRPVAEPLVAPPQNTNWSLLWSSEEPRYGGSGTALLDTQQWLIPGHTAVLMRPNPR

SEQ ID NO: 20059 - protein, 428 aa, Brassica napus
MAQILAASPTCQMKLTKPSPIASSKLWSSVMLKQKKQNSSKLRSFKAMALQSDNSTINRVESLLNLDTKPFTDRIIAEYIWIGGSGIDLRSKSRTLEKPVEDPSELPKWNYDGSSTGQAPGEDSEVILYPQAIFRDPFRGGNNILVICDTYTPAGEPIPTNKRARAAEIFSNKKVNEEIPWFGIEQEYTLLQPNVNWPLGWPVGAYPGPQGPYYCGVGAEKSWGRDISDAHYKACLYAGINISGTNGEVMPGQWEFQVGPSVGIEAGDHVWCARYLLERITEQAGVVLTLDPKPIEGDWNGAGCHTNYSTKSMREEGGFDVIKKDILNLSLRHMEHISAYGEGNERRLTGKHETASIDQFSWGVANRGCSIRVGRDTEKKGKGYLEDRRPASNMDPYIVTSLLAETTLLWEPTLEAEALAAQKLSLKV

SEQ ID NO: 20060 - protein, 264 aa, Beta vulgaris
MATSTIQQSAFAGQTILKPQNELVRKFGGNGGRASMRRTVKSAPQSIWYGPDRPKYLGPFSEQTPSYLTGEFPGDYGWDTAGLSADPETFAKNRELEVIHSRWAMLGALGCVFPEILSKNGVKFGEAVWFKAGSQIFQEGGLDYLGNPNLIHAQSILAIWASQVVLMGLIEGYRVGGGPLGEGLDKLYPGGAFDPLGLADDPEAFAELKVKELKNGRLAMFSMFGFFVQAIVTGKGPIENLSDHLADPVANNAWAFATNFVPGK

SEQ ID NO: 20061 - protein, 312 aa, Oryza sativa
MGGLSMDQAFVQAPEHRAKPSVAEADGIPVIDLSPLFAADGVDVDALAAEVGRASQDWGFFVVVRHGVPEEVVARAAEAQRAFFALPPARRAAVARSEAAQMGYYASDHTQNVRDWKEAFDLVPTRHPPPPPPAGVLDNKWPDDLPGFRSFGSLTSSSSSRRLVPHQILEQRSNGGDAGALTVLYQDAVGGLDVRRRCDGEWVRVRPIPQSFIINVGDIIQVWSNDRYESAEHRVAMNVEKERFSMPFFFYPASYTMVEPLEEIVSEESPARYNPYCWGEFFSTRKNGDFKKLDVDNIQIAHFRKKALVHIQ

SEQ ID NO: 20062 - protein, 462 aa, Thermosynechococcus elongatus
MQQRIKDILHQGQVGDRITVKGWVRTKRELKECTFVNLNDGSTLAGLQVVIPNTVAAATPTMKDLTTGAAAEFTGELVRSPGKNQAIELHAEEIHLWGTADPETYPLQKKRHSFEFLRTIAHLRPRTNTLGAVMRVRNACATAIHQFFQERGFLWVHTPIITASDCEGAGELFTVTTLDLTQPPKTPEGKIDFSQDFFGRRAYLTVSGQLEAEIMATAFTNVYTFGPTFRAENSNTSRHLAEFWMVEPEMAFCDLRGDMELAEAFLQFVFRYVLDHCPEDMAFFQERIDHSVMATAEQMATQPFAHLSYSEAIQVLEKSGRAFEFPVAWGLDLQSEHERYLAEEYCQRPVIVYDYPAAIKAFYMRLNDDGKTVAAMDILAPKIGEIIGGSQREERFDVLQERIVTQGLDPAPYWWYLDLRRYGSVPHAGFGLGFERLVQFMTGMDNIRDVIPFPRTPGNAEF

SEQ ID NO: 20063 - protein, 234 aa, Triticum aestivum
  misc_feature (183)..(183): Xaa can be any naturally occurring amino acid
NKFVQKSRLVPVRNSRDIVDPRVRCDPPQRRFPLEKGISPPWWPSGDEEWWPELGIPKDQGPPPYKKPHDLKKAWKVSVLTAVIKHMSPDIEKIRRLVRQSKCLQDKMTAKEISTWLAVVKQEEELFMRLHPGARPPASAGGIASAISFTASSSEYDVDLADHCKGDEAGTHKMAMGEPTAFXLGAGLLNDQFLMPGPCKRKPADMDYGPGRGVVWAAPTRTLCLNNRGLPLNQ

SEQ ID NO: 20064 - protein, 104 aa, Glycine max
  misc_feature (82)..(82): Xaa can be any naturally occurring amino acid
MGREPARCYRPIKNKPYPKSRFCRGVTDPKIKIDDVGMKKKGVGELSFCVHLDSGEKENVWREALDAAEDAGRTYMVDVRGXDALHLRVKVHSLHVPTINMTLT

SEQ ID NO: 20065 - protein, 427 aa, Synechococcus elongatus
MTETNFDFLAQGDPAIAAIIGRELQRQQEHLELIASENFASPAVMAAQGSVLTNKYAEGLPSKRYYGGCEFVDQAEELAIERAKELFGAAHANVQPHSGAQANFAVFLTLLQPGDTFLGMDLSHGGHLTHGSPVNVSGKWFNAGHYGVNRETERLDYDAIRELALQHRPKLIICGYSAYPRTIDFAKFREIADEVGAYLLADMAHIAGLVAAGLHPSPIPHCDVVTTTTHKTLRGPRGGLILTRDAELGKKLDKSVFPGTQGGPLEHVIAAKAVAFGEALRPEFKTYSAQVIANAQALARQLQARGLKIVSDGTDNHLLLVDLRSIGMTGKVADLLVSDVNITANKNTVPFDPESPFVTSGIRLGTAAMTTRGFKEAEFAIVADIIADRLLNPEDSSMEDSCRRRVLELCQRFPLYPHLSPATPVAV

SEQ ID NO: 20066 - protein, 238 aa, Hordeum vulgare
MAVRPSSVSVRAGASVSAKLTPWRAARAGLGGRVSVSSGRRCGGPVRASLFSPKPAVAMDARPSKVQELHVYELNERDRESPAYLRLSANQSQNALGDLVPFTNKVYNGSLDKRIGITAGICILIQHVPERNGDRYEAIYSMYFGDYGHISLQGPYLTYEESYLAVTGGSGVFEGVYGQVKLNQIVFPFKIFYTFYLKGIPDLPKELLCTPVPPSPTVEPTPAAKATEPHACLNNFTD

SEQ ID NO: 20067 - protein, 201 aa, Unknown
  Synechococcus sp. RS9917
MRTGTIHRVTGETDVRVKLNLDGSGSCTVSTGVPFLDHMLHQISSHGLIDLEIEARGDTHIDDHHTNEDVGIAVGQALAQALGDRRGIHRFGHFLAPLDEALVQVALDCSGRPHLSFGLQIPAQKIGSYDTELVKEFFVAVVNNSGLTLHIRQLDGVNSHHIVEACFKAFARALRLATEIDPRRAGAVPSSKGVLEQAGAG

SEQ ID NO: 20068 - protein, 472 aa, Coxiella burnetii
MTTIFWFRQDLRLSDNPALVEAAKSADHLIPLYILDDQLKMLGDAQRWWLHHSLSSLQTALSKKGTSLILKKGDTKRVLLELIKKYKVEKIYWNRSYEPPYREIDTYLENRLPPLSVEIYHSTLLTEPQKIKNKSGGYYKIFTPFWKHINASLQPRKTLAAPKKFSQHRAIKSDNLETWNLLPKHPDWSQGFDQWKPGEKNAQIVLKKFIKENLKNYPAHRDRPDISSTSHLSPYLHFGEISIRQVWTAITQATIQDKNLQKAADVFLRQLIWREFAYYLLWHFPQMGRSNFRNQFDNFKWKKNKNWLRAWQKGLTGYPIVDAGMRELWCTGYMHNRVRMIVASFLVKDLMIDWREGEKWFWNTLLDADLANNALGWQWIAGCGPDAAPYFRIFNPILQSKKFDPDGTYIKRWIPELAKVPSKYIHYPADMPDNISESSKVNLGVDYPFPIVNHHKAKELALKAYKDSTYRL

SEQ ID NO: 20069 - protein, 469 aa, Pseudomonas syringae
MSETTAPSGELKRGLKNRHIQLIALGGAIGTGLFLGSAGVLKSAGPSMILGYAICGFIAFMIMRQLGEMIVEEPVAGSFSHFAHNYWGGFAGFLSGWNCWLLYILVGMSELTAVGKYIHYWLPHIPSWVSAAVFFVLINAINLTNVKVFGETEFWFAIIKVVAIIGMIALGSYMLVSGSGGPQASVSNLWEHGGFFPNGVSGLVMALAIIMFSFGGLEMLGFTAAEAEQPKTVIPKAINQVIYRILIFYIGALVVLLSLTPWDSLLASLNASGDSYSGSPFVQVFSMLGSDAAAHILNFVVLTAALSVYNSGTYCNSRMLVGMAEQGDAPKLLAQVDKRGVPVKAIFASAAVTLVAVLLNYFVPQQALELLMSLVVATLVINWAMISYSHLKFRQHMNRTGQVPLFKALWYPYGNYVCLAFVVFILGIMLMIPGIQISVYAIPVWLAVMWVCYRAKNRRSVVVNAETGK

SEQ ID NO: 20070 - protein, 515 aa, Aspergillus oryzae
MGDIYTNYPPPLNPAQKEYLVTTIKDWATQNGLLVRPAPSFVPKEIDPSGVLATNAPVTLFPSPFPKSCFNEATALQTVYNRLYAAITCNEEWIGKIMEDLIDVDDFISHLWKVHLAVKEEGYVQTLSLGLYRSDYMVHAPSSSTTPSLKQVEFNTISSSFGGLSSLVTSLHTELLDSPPGKPIAYPSHPLFESNAPPENTAVETLSAGLAAAHNAYGPSKSTPALPTCIIFLVQENERNTFDQLALFRQLTKVHKIPVFRLLSSEILDHTSIPSSNPSRPLVYSPPHSPETQFEVTTAYLRCFYAPSDFKSERDWEARTHVERSAAIKCPTVLNQLAGCKIVQQVLAETTGPDNLTSFLPDTDPAVVARLRETFAPQYDLSSGGRGRDLALNVETAMNHVLKPQREGGGNNIYKEAIPDFLRSIPESEWKRWILMELIRPPAEARNIALRTDGEVLSGEVIGELGVYGTILWDQANGKISHNEQGGWLMRTKSKDVNEGGVATGFSSLDSILLY

SEQ ID NO: 20071 - protein, 238 aa, Picea glauca
MEHLNTAAAQASSSLYEVGMAEYGDAGVSSMMALITQHEPHDSESIMSTRMPSSFSSFHGHADCLLSAAMFQASQGDHKLKRQPGMDQLVSEQAGMSDSSMPSVKTEVCSGLRNQFEFHREQTGNCYTDQSSNTPVNPLVTSLASQARGEAQMIPSLDANSPHFNVDNEEYAIKSKILAHPQYPSLLGAYIDCQKIGAPPEAVARLDALTREYQNQQRRTVSIGMDPELDQFMEAYCE

SEQ ID NO: 20072 - protein, 59 aa, Oryza sativa
PRVRPRVRPRVRDKLQFKDLSLGHSMIPFGSCTMKLNASGEMMAVTFPKFGNMPPFGPS

SEQ ID NO: 20073 - protein, 322 aa, Saccharomyces cerevisiae
MYKYSYYIRRKNEREKKVLKVCIQLALQQETQSIKQSKMAIDAQKLVVVIVIVVVPLLFKFIIGPKTKPVLDPKRNDFQSFPLVEKTILTHNTSMYKFGLPHADDVLGLPIGQHIVIKANINGKDITRSYTPTSLDGDTKGNFELLVKSYPTGNVSKMIGELKIGDSIQIKGPRGNYHYERNCRSHLGMIAGGTGIAPMYQIMKAIAMDPHDTTKVSLVFGNVHEEDILLKKELEALVAMKPSQFKIVYYLDSPDREDWTGGVGYITKDVIKEHLPAATMDNVQILICGPPAMVASVRRSTVDLGFRRSKPLSKMEDQVFVF

SEQ ID NO: 20074 - protein, 187 aa, Brassica napus
  misc_feature (180)..(180): Xaa can be any naturally occurring amino acid
VFYLALSMEFGSSSGTCFKAANPSVLISTISRNRNISLRSKHQRFSFRVSAVSYKKFAESALQETIKRVVLEPSPLQERYSSMTGLDGKTQLQMLAFKSPKIRLLRSMAIENETIQVFDFAGFMKPEYDIPIFCANFFTSANMNIVVLDLNPLHQLTEHTNYQEKYYKNIMSIYHKYDEXFPWEGKL

SEQ ID NO: 20075 - protein, 73 aa, Dehalococcoides ethenogenes
MPKKDAIEVEATVLEALPSAAFRVQLSNGHEVLAHISGKMRVHYIRILPGDRVLVELSPYDLTRGRVTYRFKS

SEQ ID NO: 20076 - protein, 583 aa, Aspergillus oryzae
MTQTSTSKGTIKVADYLFARLCQLGIQSIFGVPGDYNLRLLDFVEPSGLHWVGTCNELNGAYAADGYARINGLGALITTFGVGELSAINGIAGAYAEKAPVIHIVGTPSRALQDARTLVHHTFADGEYNRFAAMHAQVTVAQANLIDPRTAAEQIDWVLQQCLVHSRPVYIQVPDDMVDVMIPASNLETRKIELPATPSTKNETSVLTTVLERIYSAKRPLIFVDGESRALNILPQVDELIQTTHWPTWTSAYGKGLVNEQYNNVYGFYGASYGTEQEKAYFDSADLVLVLGPHYSNTNTLGFATIPKQEVSISFSGTSIQIGKDLHRDYSIKQFLIQVLESLDRSRIPKIDGAPPKPKGDLSHINKSDPITQDDFYRFVDRLFREGDIVATETGTASYGGRTFTLPPNTRMFCAVTWLSIGYMLPACFGAALAQQETNSFKPSNSTGTGKGRLFLFIGDGSLQMTVQEISSIIREKLDVTIFVINNAGYTIERAIHGRNQAYNDIAPWRHLQALSFFGGSEEDAAKNNFSARTFGELEEVLQSDRIQKGNGLRIVEVHMGREDCQGLLRTLMNNQIAQDAKQ

SEQ ID NO: 20077 - protein, 507 aa, Gossypium hirsutum
MAKPQLLFLFSFSLLCLISFSAADSSITADLRLTDSSFPSVHAKKLIRELNLFPKGEVNVVDEHRVSLPEGPKLVEKRFKFPTLEVPGGVSFEDLGHHAGYYKLPNSHDARMFYFFFESRNSKKDPVVIWLTGGPGCSSELALFYENGPFTIADNMSLVWNEYGWDKASNLLYVDQPIGTGFSYSSDQRDIRHNEDEVSNDLYDFLQAFFAEHPEFAKNDFFITGESYAGHYIPAFAARVHRGNKAKEGIHINLKGFAIGNGLTDPAIQYKAYTDYALDMGVIKKSDHDRINKLVPVCEMAIKLCGTDGTISCMASYFVCNNIFNGIMALAGDTNYYDVRKKCEGSLCYDFSNMESFLNKKSVRDALGVGNIDFVSCSPTVYQAMLVDWMRNLEVGIPVLLEDGIKLLVYAGEYDLICNWLGNSRWVHAMEWSGQKEFVASPEVPFIVDGAEAGVLKTHGALGFLKVHDAGHMVPMDQPKAALEMLKRWTKGTLSDASDSEKLVAEM

SEQ ID NO: 20078 - protein, 146 aa, Rickettsia sibirica
MVEPGIHDTLCRAIIALFIPVNIKGEFNTSFKKLENLTRPFVNYFILPLFVFMNSGILLEYFAFKGICSNSILALIYGIIFGLFVGKQLGIMLFSYPFVKFKLCNLPSDTSWLKFYSIAILGGIRFTLSLFIGSILRLRAAALQTL

SEQ ID NO: 20079 - protein, 337 aa, Haemophilus somnus
MNDNSPSPTPITVIGAGAYGTALAIAFSRNGYPTYLWGHRPQHCQRLRNERKNQAFLPNIHFPDSLYVEDNLAQAIQHSRELLIVVPSHVFGDVIMQIKPHLRSDQRIAWATKGLERNTGRLLQEVVEEHVGYGYPLAVLSGPTFAKELAAGMPTAITLASNNEQFALEFQERIHCSKFRVYVNQDMIGVQLGGAVKNVIAIAAGISDGMGFGANARTALITRGIAEISRLGISLGANPNTFMGTSGLGDLVLTCTDNQSRNRRFGLMLGQGFDCTTAINELGPVIEGFYNTKETFLLAQQQGVEMPITEQVYQILFCGKKPEDAAITLLGRKRKRE

SEQ ID NO: 20080 - protein, 328 aa, Arabidopsis thaliana
MSSPERKRKKRSLEPSPESTPNPSLPDDLIVSILARVSRLYYPILSLVSKSSRTLVTSPELYKTRSFFNRTESCLYVCLDFPPDPNPRWFTLYRKPNQNITEKTKNSSGSHTWHEAPSMRMKRNYPAANVVDGKIYVAGGLEEFDSSKWMEVFDIKTQTWELVLSPLAERFIYRSLVIEGEIYIFGDKVVTYKPKEDRWGGVGEHQSMDLGLFFHSYCVIDNVLYCYRPGGIKWYESEKRSWRKLRGLKGLSKLASSCVKLADYGGKMALLWDKYIPCSGNKSHSISCAVVSLERCKNQGIRGKVEWFDDMLTVPSSYNFVGALAATL

SEQ ID NO: 20081 - protein, 417 aa, Pseudomonas syringae
MFSRDLTIAKYDADLFAAMEQEALRQEEHIELIASENYTSPAVMEAQGSALTNKYAEGYPGKRYYGGCEYVDIIEQLAIDRAKELFGADYANVQPHAGSQANSAVYLALLQGGDTILGMSLAHGGHLTHGASVSSSGKLYNAVQYGIDANGMIDYDEVERLAVEHKPKMIVAGFSAYSQILDFPRFRAIADKVGAYLFVDMAHVAGLVAAGVYPNPVPFADVVTTTTHKTLRGPRGGLILARANAEIEKKLNSAVFPGSQGGPLEHVIAAKAVCFKEALQPEFKTYQQQVVKNAKAMAGVFIERGFDVVSGGTENHLFLLSLIKQDISGKDADAALGRAFITVNKNSVPNDPRSPFVTSGLRFGTPAVTTRGFKEAECKELAGWICDILADLNNEAVIDAVREKVKAICAKLPVYGA

SEQ ID NO: 20082 - protein, 140 aa, Rickettsia sibirica
MNIKIKKLILPAAAALGGVVILIYMFFNYDKPGLIKGWAIPIATDTAFVLGILSFFSRHISLELRAFIIGFSLIDDAFALIMLVYTKTINTPALLISSIIIFILFILNYRQVKQLFYYIVYYYGLVWWSQVFTIPYAEPL

SEQ ID NO: 20083 - protein, 347 aa, Unknown
  Bradyrhizobium sp. BTAi1
MAASFPMNAWYAAAWDAEVKQALLPRTICGKHVVMYRKADGSIAALEDACWHRLVPLSKGRLEGDTVVCGYHGLKFSPQGRCTFMPSQETINPSACVRAYPAVERHRFIWLWMGDPALADPATIPDMHWNHDPAWAGDGKTIQVKCDYRLVVDNLMDLTHETFVHGSSIGNDAVAEAPFDVTHGERTATVTRWMRGIEPPPFWAKQLGKPGLVDRWQIIRFEAPCTVTIDVGVAPTGTGAPEGDRSQGVNGMVLNTITPETDKTCHYFWAFARNYQLTEQRLTTEIREGVSGIFREDELILEAQQRAMDANPGRVFYNLNIDAGAMWARRIIDRMIARETPLREAAE

SEQ ID NO: 20084 - protein, 386 aa, Nicotiana sylvestris
NEKGLFYALDLGGTNFRVLRVQLGGKEERVIATEFEQVSIPQELMFATSEELFDFIASELGKFSQSEGGKFEMQQGRTREIGFTFSFPVKQTSVKSGILIKWTKGFAVSGTAGKDVVACLNEAMERRGLGMQVSALVNDTVATLAGARYWDNDVMVAVILGTGTNACYVERVDAIPKLPKRMSNSPVTIVNTEWGAFSNGLPLTEFDREMDAESINPGEQIFEKTISGMYLGEIVRRVLVKMAKVGGLFGGGYVPEKLVTPFVLRTPDICAMQQDTSRDLEAVESVLYDIAGVKSDLNARKTVVDICDTIAKRGGRLAGAGIVGILQKMEEDSKSVVFGKRTVVAMDGGLYEHYPQYREYIQEAVTELLGSEISKNVVIEHSKDGS

SEQ ID NO: 20085 - protein, 375 aa, Xanthomonas campestris
MTPILFVDRDGTLITEPADYQIDAYEKLRFVDHVIPAMLKLRDAGYQFVIVSNQDGLGSESYPRASFEGPNNLMLQIFASQGIEFRDVLIDCSWPADNAPTRKPGIGLMVPYLQDRSIDWARSAMVGDRITDIQFAHNLNIRGFQLRTDEFGGEWDWPGIAHELADAPRRAVVQRNTKETRIRVELDLDRVAEPKTATGLPFFDHMLEQIGKHGGFALEIRAEGDLHIDEHHTIEDTGLALGQALREALGNKRGIGRYGFDPESSPWRVAGDKAQHGFTLPMDETIASAALDFSGRPYFVFDGEFKRERVGDMPTELVPHFFRSICDASGLNLHLTVRGENDHHKVEACFKALARALRQAIRREGTALPTTKGAL

SEQ ID NO: 20086 - protein, 151 aa, Brassica napus
MAFSQALFLVTLSMVLVSFSLAQSPMMAPSGSMSMPPMPSGGSPMPMMTPPPMPMMTPPPMPMTPPPMPMAPPPMPMAPSPMTPMSPSTTPMGPSPASVPDMASPPMPAMESAPSPGPMPPTMASPDSGAFNVRNDVVAFSFVVAAHLLLV

SEQ ID NO: 20087 - protein, 609 aa, Oryza sativa
MSALTTSQLATSATGFGIADRSAPSSLLRHGFQGLKPRSPAGGDATSLSVTTSARATPKQQRSVQRGSRRFPSVVVYATGAGMNVVFVGAEMAPWSKTGGLGDVLGGLPPAMAANGHRVMVISPRYDQYKDAWDTSVVAEIKVADRYERVRFFHCYKRGVDRVFIDHPSFLEKVWGKTGEKIYGPDTGVDYKDNQMRFSLLCQAALEAPRILNLNNNPYFKGTSGEDVVFVCNDWHTGPLASYLKNNYQPNGIYRNAKVAFCIHNISYQGRFAFEDYPELNLSERFRSSFDFIDGYDTPVEGRKINWMKAGILEADRVLTVSPYYAEELISGIARGCELDNIMRLTGITGIVNGMDVSEWDPSKDKYITAKYDATTAIEAKALNKEALQAEAGLPVDRKIPLIAFIGRLEEQKGPDVMAAAIPELMQEDVQIVLLGTGKKKFEKLLKSMEEKYPGKVRAVVKFNAPLAHLIMAGADVLAVPSRFEPCGLIQLQGMRYGTPCACASTGGLVDTVIEGKTGFHMGRLSVDCKVVEPSDVKKVAATLKRAIKVVGTPAYEEMVRNCMNQDLSWKGPAKNWENVLLGLGVAGSAPGIEGDEIAPLAKENVAAP

SEQ ID NO: 20088 - protein, 335 aa, Moorella thermoacetica
MKESIAVLGAGSWGTALAVLLAHKGFRVNLWARRPELATALRETGENKTYLPGVRLTGTIIPTADLPAAVKGAGLVVLSVPSHAVRSTARLLKPFLPKGTVVVNTAKGLELETKKRLSQVLVEEGLDRVAVLSGPSHAEEVGRGLPTTVVVAAADRETAEYVQDVFMDPTFRVYTNPDIIGVEFGGALKNIIALATGMADGLGLGDNTRAALMTRGMAEIARLGVALGGKVLTFAGLSGIGDLIVTCTSMYSRNRRAGILLGKGQSLEEVLDAVGMVVEGVRTTAAARELACQHGIKMPITEEIYQVLYKGKPVGDCVAALMERPRTHEVESGDW

SEQ ID NO: 20089 - protein, 496 aa, Nicotiana sylvestris
MKKATVGAVVVGTAVAVAVAALIMRHRMGKSSKWARARAILKEFEEKCATPDGKLKQVADAMTVEMHAGLASEGGSKLKMLISYVDNLPTGDEGGVFYALDLGGTNFRVLRVQLGGKDGGIIHQEFAEASIPPNLMVGTSEALFDYIAAELAKFVAEEGEEFHPPPGRQRELGFTFSFPIMQTSINSGTLIRWTKGFSIDDTVGKDVVAELTKAMQKREIDMRVSALVNDTVGTLAGGRFTNKDVSIAVILGTGTNAAYVERAQAIPKWHGPLPKSGEMVINMEWGNFRSSHLPLTEYDHAMDTDSLNPGEQIFEKICSGMYLGEILRRVLLRMAEEAGIFGEEVPPKLKNSFILRTPEMSAMHHDTSSDLRVVGDKLKDILEISNTSLKTRRLVVELCNIVATRGARLAAAGILGIIKKMGKDTPRESDPEKIVVAMDGGLYEHYTEYSKCLENTLVELLGKEMATSIVFKHANDGSGIGAALLAASNSVYVEDK

SEQ ID NO: 20090 - protein, 355 aa, Nicotiana sylvestris
MKKVTVGAAVVGAAAVCAVAALIVNHRMRKSSKWGRAMAILREFEEKCKTQDAKLKQVADAMTVEMHAGLASEGGSKLKMLITYVDNLPTGDEAGVFYALDLGGTNFRVLRVQLGGKDGGIIHQEFAEASIPPSLMVGTSDALFDYIAAELAKFVAAEEEKFHQPPGKQRELGFTFSFPVMQTSINSGTIMRWTKGFSIDDAVGPDVVGELTKAMKRKGVDMRVSALVNDTVGTLAGGKYTQKDVAVAVILGTGTNAAYVERVQAIPKWHGPVPKSGEMVINMEWGNFRSSHLPLTEYDHALDNESLNPGEQIFEKMTSGMYLGEILRRVLLRVAEEAGVFGDEVPPKLKDSFVL

SEQ ID NO: 20091 - protein, 437 aa, Nostoc punctiforme
MYNQGAVEGAANIELGSRIFVYEVVGLRQGEETDQTNYPIRKSGSVFIRVPYNRMNQEMRRITRLGGTIVSIQPITALEPVNGKASFGNATSVVSELAKSGETANSEGNGKATPVNAHSAEEQNKDKKGNTMTQAKAKKDHGDVPVNTYRPNAPFIGKVISNEPLVKEGGIGIVQHLKFDLSGGDLKYIEGQSIGIIPPGLDKNGKPEKLRLYSIASTRHGDDVDDKTVSLCVRQLEYKHPETGETVYGVCSTHLCFLKPGEEVKITGPVGKEMLLPNDPDANVIMMATGTGIAPMRAYLWRQFKDAERAANPEYQFKGFSWLIFGVPTTPNLLYKEELEEIQQKYPENFRLTAAISREQKNPQGGRMYIQDRVAEHADELWQLIKNEKTHTYICGLRGMEEGIDAALTAAAAKEGVTWSDYQKQLKKAGRWHVETY

SEQ ID NO: 20092 - protein, 96 aa, Phytolacca acinosa
ATYKVTLVTPSGTQTIDCPDDTYVLDAAEEAGLDLPYSCRAGSCSSCTGKVTAGTVDQEDQSFLDDDQIEAGFVLTCVAYPKGDVTIETHKEEDIA

SEQ ID NO: 20093 - protein, 497 aa, Nicotiana tabacum
MKKVTVGAAVVGAAAVCAVAALIVNHRMRKSSKWGRAMAILREFEEKCKTQDAKLKQVADAMTVEMHAGLASEGGSKLKMLITYVDNLPTGDEAGVFYALDLGGTNFRVLRVQLGGKDGGIIHQEFAEASIPPSLMVGTSDALFDYIAAELAKFVAAEEEKFHQPPGKQRELGFTFSFPVMQTSINSGTIMRWTKGFSIDDAVGQDVVGELTKAMKRKGVDMRVSALVNDTVGTLAGGKYTQKDVAVAVILGTGTNAAYVERVQAIPKWHGPVPKSGEMVINMEWGNFRSSHLPLTEYDHALDNESLNPGEQIFEKMTSGMYLGEILRRVLLRVSEEAGVFGDEVPPKLKDSFVLRTPDMSAMHHDTSPDLKVVGEKLKDILEISNTSLKTRKLVVELCNIVATRGARLAAAGVLGILKKMGRDTPKQGGSERTVIAMDGGLYEHYTEYRMCLENSLKDLLGEELATSIVFVHSNDGSGIGAALLAASHSMYLEDQA

SEQ ID NO: 20094 - protein, 720 aa, Coxiella burnetii
MKRMLINATQPDEVRVAITDDSKLIDLDIEIPGQEQKKSNIYKGIITSIEPSLGAVFVNYGSERHGFLPLKEISREYFLQDIEGDFDSIDINRVLKLGQELVVQVDKEERGTKGAALTTFISLAGSFLVLMPNNPRAGGISRRIEGNERDQLRETINQLSLPEGMGLIVRTAGLGRPKEELEWDLKILLRYWEAVKQAAVAKPGPYLIHQESDVIIRAIRDYLRQDVEEILIDDEVAFENARHYINQVRPQFVERLKLYREHLPLFSRFQIEQQIENAHQREIRLPSGGSLIIDHSEALIAIDINSARATRGASIEETALSTNLEAAEEIARQLRIRDIGGLIVIDFIDMTPLRNQREVENCLRNALSQDRARIQIGRISRFGLLEMSRQRLRSSLTRSTQIACPRCNAEGTIRSIESLGLSIIHIIQEQASKAKNIHFQLQAPVDLATYLINEKRELLRGIEHHYPVKITIVPNQYMETPLYQLRQIKIDPASLEHGKGMASYKLTKVFKTEAPQKQEIRALSEPAIQQFLTSPPAPTTPRKTPTPGLFKRLMGKMFGSEEEPSTAVTPPVKPHVPERHKPSSPPRGRRQGGYASRKSTGPRRHHPRSGGGGGGHGQNRHGARSRRGTRGGRRDHGGGRGGPGYHTQSTGPMPPLGEDVVDVNQLPMSTPPSPPPPFLTDADVPPSRDERRSGGINGDADHGAKPHPNGKVSDDNRGNR

SEQ ID NO: 20095 - protein, 342 aa, Streptomyces hygroscopicus
MAQPPALPVIDISRFRAPDAADRDAFLAELRSAAHEVGFFYVTGHGVPAPLRDEVLSAARAFFALPVERRLEIENLNSPQFRGYTRTGTEYTAGSAYWREQIDIGPEREALALGPDDPDYLRLIGPNQWPSALPELRDIVLRWQAEALRVSREVLRALAAALGQDEGYFDQWFDDEAAVHVKIVHYPPRAAEDADQGVGAHKDYGYLALLQQDEVGGLQVQREDGEWIDAVPVPDAFVFNIGEMLEIATQGYLKATQHRVVSPQAGVHRYSIPFFLGPRLDAVVKPLNLPAELAALSRGVTDDPDNPLLAAFGENAVVGWLRSHPRVAERWWSDVLEKRESR

SEQ ID NO: 20096 - protein, 335 aa, Antirrhinum majus
MEGERVQAIASLSKYADTIPSEFIRSENEQPAATTLRGVVLEVPVIDLSDDFNEKILVKNISEASRDWGIFQVVNHGISNEVISKLQKVGKEFFELPKEEKEFVAKTPESGIEGYGTILQKEVEGKKGWVDHLFHKIWPPSAINYKFWPKNPPSYREANEEYTKKIRDVSDKLTNWLSLGLGIKGHELKAAMGGDDTIFLMKINYYPPCPRPDLALGVVAHTDMSFLTILVPNEVQGLQVFRDEHWYDVKYIPNALIVHIGDQIEILSNGKYKAVFHRTTVNKKNTRMSWPVFLEPHPEFEVGPIPELVSEESPSKYKTKKYKDYVYCKLNKIPQ

SEQ ID NO: 20097 - protein, 493 aa, Unknown
  Synechococcus sp. RS9917
MNALRTLFWHRRDLRLADNTGLQAAVGLGPAVTGVVVLDPAILSPPPHLPPMAPARLWFLVESLIELQQRWREAGSRLLVVAGDPATVLPRLASLLDAPAVVWSRDVEPYARERDRAVARALQADGRKVLVDWDQLLVNPELLKTGGGDPYRVYGPFLRNWRGQVERSEPSTVASPSGLIDLEPETLALISSGEGELGRLCLEGQRQLEHLRAAHGFAGIELCPCRPGEAAAAEQLATFVAGPLMAYEPDRNVPSVVGTSSLSAALSVGTLSPRQAWCAAQEVKQCVRSDEQLQAITVWEQELGWREFYQQALFHFPELADGPYRPQWRRFPWENNDDWFDFWKDGQTGMPIIDAAMRQLNQTGWMHNRCRMIVASYLVKDLICDWRWGERAFMELEVDGDLAANNGGWQWSASSGMDPKPLRIFNPATQASKFDAEGEYIRRWLPELRHVNTNDLLSGEIPALERRGYPEPLVNHKSQQARFKALYATIRST

SEQ ID NO: 20098 - protein, 414 aa, Xanthomonas campestris
MTIKTLALQCRDAAQVVSQLSAPAKHALLDAMAAALEADAAAILAANARDLEAARAKGTGSAMLDRLALDDKRLAGIAAALREVAQLPDPVGRITREDVRPNGIRVQKVRVPLGVIAMIYEARPNVTADAAALCIKAGNGVILRGGSEAIHSNTAIARALQRALREANVPDAALTLVEDLRRETMLELLQLNDIVDLAIPRGGEGLIRFVAEHARVPVIKHYKGVCHLFVDASAEMELALRLLIDGKATRPSACNSLETLLVHAGIAERFLPLAAQALRERKVELRGDAATQAVLPDIAAASDDDYAAEFLDLILAIRVVPDLDTALAHIRQYGSDHTEVIATQDADNAERFVQSLRSAVVMVNASSRFSDGGELGLGAEIGISTTRLHSYGPMGLEALTVERFVVRGEGQVRH

SEQ ID NO: 20099 - protein, 344 aa, Oryza sativa
MVGAVQEGIVREMNGGFEVMSGYDRSSMAPKQQQREEESKWYEEEIDDDLKLCYALNSVLHRGASKYQEIALIDTKHFGKALIIDGKMQSTEVDEFIYHESLIHPPLLFHPNPKTVFIMGGGEGSAAREVLRHNTVHRVVMCDIDQEVVDFCRTYLTVNWDAFASDKLCLIINDARAELEKSREKFDVIVGDLADPVEGGPCYQLYTKSFYQHIVKPKLNDRGVFVTQAGPAGVLTHKEVFSSIYNTLRHVFKYVKAYTAHVPSFADTWGWVMASDYPFSMNAQQINERIKERIDGELVYLSGESLISSTILNKSVYQSLLNETHVYTEDDARFIYGHGRARCA

SEQ ID NO: 20100 - protein, 520 aa, Antirrhinum majus
MQHQYYSLITMDDISITSLLVPCTFILGFLLLYSFLNRKVKPLPPGPKPWPIVGNLPHLGPKPHQSMAALARVHGPLIHLKMGFVHVVVASSASVAEKFLKVHDANFSSRPPNSGAKHVAYNYQDLVFAPYGPRWRMLRKICALHLFSAKALNDFTHVRQDEVGILTRVLADAGETPLKLGQMMNTCATNAIARVMLGRRVVGHADSKAEEFKAMVVELMVLAGVFNLGDFIPPLEKLDLQGVIAKMKKLHLRFDSFLSKILEDHKINSSDETKGHSDLLNMLISLKDADDAEGGRLTDVEIKALLLNLFAAGTDTTSSTVEWCIAELVRHPEILAQVQKELDSVVGKNRVVKEADLAGLPFLQAVVKENFRLHPSTPLSLPRIAHESCEVNGYLIPKGSTLLVNVWAIARDPNVWDEPLEFRPERFLKGGEKPNVDVRGNDFELIPFGAGRRICAGMSLGIRMVQLLTATLIHAFDFDLADGQLPESLNMEEAYGLTLQRADPLVVHPKPRLAPHVYQT

SEQ ID NO: 20101 - protein, 239 aa, Oryza sativa
MAGRGGGGGGGELQLLGTWYSPYAMRAKIALGLKGLSYEYIEQDLFGKSELLLKSNPVHKKVPVLIHAGRPVCESRVVLEYVDEAWPGAAPPLLPADPHDRATARFWATYFDSTFFPPWRALMRATTAEQRAEAFMNAVPQVEVLERAFVECSKGKAFFGGDAVGLVDVVVGGFVVWFKVVDEVAGSSLLDEAKFPGLAAWAERFLAVDAVREAMPDAGKLLEHYKGFLAKLASPAGST

SEQ ID NO: 20102 - protein, 273 aa, Oryza sativa
MSSSSSSSASSAAAAAFRPAVVQREQQVVEEKFPAAAAAMREMVLPPVAAAAADSEQEQLCYVHCHYCDTVLVVSDLRSNHAHFLSICVHLALDSRAFLVHPWRRVLQDEISTANSPTQLLLEQHGLGGLMASAASCRNNNSPAAAAAPPPPTSQGKAAAKEPSPRTNTAVINRPPEKRQRVPSAYNRFIKDEIQRIKAGNPDISHREAFSAAAKNWAHFPHIHFGLMPDHQGLKKTSLLPQDHQRKDGLLKEGLYAAAAAAAAAANMGVAPY

SEQ ID NO: 20103 - protein, 411 aa, Bacillus cereus
MSIFRSQNERKTEKSIDKHALLFGLISVFLCGIGFSIIMPVVPFLVQPYTSNPEEQALVVTLLTSVYAACVFLAAPVLGALSDKYGRRPLLLICLFGSAIGYLVFGIGGALWVLFAGRIIEGITGGSISTIFAYFADIIPQEQRTKYFGWVSAVVGAGTIIGPTLGGLLAKFGHSVPLYFGALITLINVLYGMKYMPESLDKNNRLTEITFVRLNPFAQLANILSMKNLKWLLVSAFLLWIPNGSLQAIFTQFTMDTFNWQPALIGIMFSIMGFQDIISQAFIMPKLLIKLSDKQIAILGMVSEIIGYSFIAVSALFSLYPLLIVGMLLFGFGDSIFGPSFNGMLSKSVSSSEQGRIQGGSQSIQALARMIGPIIGGQTYVSLGHAAPAFMGMILIVAAIVVLYRGTHVTA

SEQ ID NO: 20104 - protein, 455 aa, Bacillus anthracis
MIALGGVIGTGLFLGSGYTIHEAGPGGAIVAYLVGGFVMYLTMLCLGELAVAMPDAGSYQTYATKHISPAAGYVVGWMSWLNWSATIGIELIAVSILMKRWFPDVPSWIWCVVFAVLLFAINALSSRSFAEVEFWFASIKVITIIAFIILGGAAMFGFLDMKGNEPAPMFSSFTDYGGLFPNGLSAILITMIAVNFSFQGTELVGIAAGESENPEKTIPKAINNTVWRILVFFVLSIFILAGLFPWQQAGVIESPFVVVFDKIGIPYAADIINFVIITAVLSVANSGLYATSRMLWSMSNQGMISPIFGKLSKNGVPIYALIVSTIVGCLSLLSGIYAEDTVYLWLLSIAGFGAILVWASIALSNLLARRSYIKQGGDVKDLKFKTPLYPFVPLLALVLNVTVIVGMAFIPEQRMALYCGIPFMIVCLLFYRATRNKAHKVEHIEKTDTTEVDSL

SEQ ID NO: 20105 - protein, 112 aa, Methylobacillus flagellatus
MKKIEAVIKPFKLDEVREALSEIGANGLTVTEVKGFGRQKGHTELYRGAEYVVDFLPKIKVELVVTDDVVDAAVESIIKAARTGKIGDGKIFVTPVEQIIRIRTGETDEAAI

SEQ ID NO: 20106 - protein, 415 aa, Dehalococcoides ethenogenes
MSFLKTSDPAVYNAIMQETTRLKETIDLIASENYTSKAVLEAQGSVFTNKYAEGYPGKRYYAGCEYADAIEELAIDRAKTLFHAEHANVQPHSGAQANMAAYFAMVKPGDTIMGLTLSHGGHLTHGSKANFTGKLYHVIEYGLNAETERIDYDNLEKLALEHRPRLIVTGASAYPRILDFERFRAICDKVDAKLMVDIAHIAGLVAAGLHPSPVPYADVVTSTSHKTLRGPRGGFILCKEQYAKAIDQAVFPVIQGGPLMQVVAAKAVAFQEAMQPGFVTYQKKILENTQVMAEELRKLGLRLVSGGTDNHLVLVDLSPIGVNGYDAQLALRRAGIVINRNTVPFAENQTANVPAGIRLGCPAATSRGFGPAEIRQTVSWIGKILKNIGNEDIEKQVLAEVIHLCRKFPVPGIDA

SEQ ID NO: 20107 - protein, 546 aa, Hordeum vulgare
MGPDLGALALRYTGLAVSDHDSIVAINIFIALLCGCIVFGHLLEGNRWVNESTTAIVLGLITGGVILLCTKGVNSRILIFSEDIFFIYLLPPIIFNAGFQVKKKQFFRNFATIILFGAVGTLISFVIITLGAMGLFRKLDVGPLELGDYLAIGAIFSATDSVCTLQVLNQDQAPLLYSLVFGEGVVNDATSVVLFNAIQNIDLNHFDVLVLLQLIGKFLYLFLTSTVLGVAAGLLSAYIIKKLCFARHSTDREVAIMILMAYLSYMLSMLLDLSGILTVFFCGIVMSHYTWHNVTESSRVTTKHTFATLSFIAEIFLFLYVGMDALDIDKWKLASSSPKKPIALSAVILGLVMVGRAAFVFPLSYLSNLSKKESHPKISFNQQVIIWWAGLMRGAVSIALAYNKYTTSGHTAVRVNAVMITSTIIVVLFSTMVFGLLTKPLINLLVPPRPGTAADISSQSFLDPLTASLLGSDFDVGQLTPQTNLQYLLTMPTRSVHRVWRKFDDKFMRPMFGGRGFVPFVPGSPIERSVHGPGLLGTVTEAENRS

SEQ ID NO: 20108 - protein, 535 aa, Methylobacillus flagellatus
MKIAIAQINATAGDLTGNAAKIVEQARRAEAAGATLLLCPELALSGYSPEDLLLRDDFYHACERALYALAQELPATLTVVVGHPRKYLGNRYNAASVLEAGRICHTYHKALLPNDSVFDEVRYFSEGSEALVINHLGCKLGIVICADVWAPEPARRARDAGATVLLVLNASPYHIGKQQERYAVVRDRIKETGLPVVYANLVGGQDELVFDGASFVMNDEGALTQQLPSFDEALGIVSFSDGAPEPAEIHPLPGLEPAVYQALSLGFRDYVLKNNFPGVLLGLSGGIDSALTLAIAVDALGAGKVQAVMMPSAFTASISLEDAQAMAAGLNVRYSEIAIGPVFESFCAALAPEFAGRPFDTAEENLQARIRGTLLMALSNKFGSMVVTTGNKSETAVGYSTLYGDMAGGFALLKDVSKTLVYQLAKYRNTISQVIPERIILRPPSAELRHGQTDQDSLPDYAVLDGIMEAYVENDYSWEEILALGYREQDVLRVTRLVDRNEYKRRQAPIGVRVTKRGFGKDRRYPLTNKFVFNR

SEQ ID NO: 20109 - protein, 161 aa, Pseudomonas syringae
MSENLLSIPVTTIKGEQKTLADFSGKALLVVNTASQCGFTPQYKGLEKLWQDYRDQGLVVLGFPCNQFGKQEPGDEGAISGFCELNYGVSFPLFKKIDVNGEQAHPLFVQLKQQAPGLLGTERIKWNFTKFLIGQDGRLVKRFAPLTKPEELTGEIEALLR

SEQ ID NO: 20110 - protein, 173 aa, Flaveria bidentis
MASIPATFATVAQANMVAPFTGLKANAAFPVTKKVNGFSTLPSNGGRVQCMKVWPPVGKKKYETLSYLPELTEAQLAKEIDYLIRNKWVPCLEFELEHGFVYRENARSPGYYDGRYWTMWKLPMFGCTDSAQVMKELQECKKEYPQAWIRIIGFDNVRQVQCVSFIASKPTGF

SEQ ID NO: 20111 - protein, 173 aa, Flaveria bidentis
MASIPATVAAVPQTNMVAPFTGLKANAAFPVTKKVNGFSTLPSNGGRVQCMKVWPPVGKKKYETLSYLPELTEAQLAKEVDYLIRNKWVPCLEFELEHGFVYRENASSPGYYDGRYWTMWKLPMFGCTDSAQVMKELQECKKEYPQAWIRIIGFDNVRQVQCVSFIASKPTGF

SEQ ID NO: 20112 - protein, 137 aa, Glycine max
  misc_feature (29)..(29): Xaa can be any naturally occurring amino acid
  misc_feature (64)..(64): Xaa can be any naturally occurring amino acid
  misc_feature (103)..(103): Xaa can be any naturally occurring amino acid
PASVRNDHAYSCGLSESNLYDYAFKSLIXTCGTTKLLLAIPPLLKFTETLSLKAYSVNYTRGRXIYPRADSYSHHHLSDEVAIRERFFVPLVAGCNAHIAGGXDKTQSWRVYCVLADTVSDCDNEYTVEMCMTGPNR

SEQ ID NO: 20113 - protein, 600 aa, Yarrowia lipolytica
MTATSATASTKKDGNVHLGEYLFSRIKQLGIDNILGVPGDFNLHLLDYIYRVPDLNWVGCCNELNAAYAADGYGRVKHLPGVLVTTYGVGELSALNGVSGAFAEQAPLLHIVGTTGRPIQEESWLVHHVLPKENSLQEPDHLVYQGMSEKVRCCSAFLNDKETAAAEIDRVLTTICQKSLPGYLFIPVDMTWQPLDAARLDSKLDYSVKNEDPKLENEIVDSILSEIYASKNATVFADVLTARHRATDLVRELAKKTNFPNYTSPLGKGILNENEDRFVGVYNGQLSLEGVAKSIEASDCVLFTGPLLSDSNTGGFSHNLKDENTIYLSPDYVKVKGKLYEGVHFFPVLKKVVEQLDVEKISAESKTAAMPTISPPPVIDSPLPISQTFLVDSMSKMMRPDDLLIVETGTFQFACSDVKFNTNNSLLTQIFYSCIGFTLPATLGAALAKREDAAAKNDKGRVILVEGDGSAQMTIQELGTMVRQGLNPIIFLLNNDGYSIERAIHGPEQSYNDICPKWKWTKLLEAFGGTEGVDSFSTTVKTREELEALIGDEKFMNSDKAQLVEVIMDVNDYPWRLNEQIKLMGGKNMKVFAEYQKKNP

SEQ ID NO: 20114 - protein, 488 aa, Arabidopsis thaliana
MSSPRSNKPKIVNGPGGYILQDVPHLIDYLPDLPTYPNPLQDNPAYSVVKQYFVHADDSVPEKVVVHKDGPRGVHFRRAGPRQKVYFESDEVHACIVTCGGLCPGLNTVIREVVSSLSYMYGVKRILGIDVSLGGYRGFYAKNTIPLNSKVVNDIHKRGGTIIGTSRGGHDTNKIVDSIQDRGINQVYIIGGDGTQRGASVIFEEIRRRRLKVAVVGIPKTIDNDIPVIDKSFGFDTAVEEAQRAINAAHVEAESNENGIGFVKLMGRYSGYIAMYATLASRDVDCCLIPESPFYLEGEGGLFEFIERRLKDHGHMVIVLAEGAGQDLMCKSMESTPMDASGNKLLKDVGLWLSQSIKDHFKKNKMVMNLKYIDPTYMIRAVPSNASDNVYCTLLAQSAVHGAMAGYTGYTSGLVNGRQTYIPFYRITETQNNVVITDRMWARLLSSTNQPSFLGPKDTSEEKKELPETPLLDDGAVDIPPVTKEVTK

SEQ ID NO: 20115 - protein, 349 aa, Oryza sativa
MANLTDLVNLNLSDCSDKIIAEYIWVGGSGIDLRSKARTVKGPITDVSQLPKWNYDGSSTGQAPGEDSEVILYPQAIFKDPFRRGDNILVMCDCYTPQGEPIPTNKRHSAAKIFSHPDVVAEVPWYGIEQEYTLLQKDVNWPLGWPGPYYCAAGAEKAFGRDIVDAHYKACIYAGINISGINGEVMPGQWEFQVGPSVGIAAADQVWVARYILERVTEVAGVVLSLDPKPIPGDWNGAGAHTNFSTKSMREPGGYEVIKKAIDKLALRHKEHIAAYGEGNERRLTGRHETADINTFKWGVANRGASIRVGRDTEKEGKGYFEDRRPASNMDPYVVTGMIAETTLLWKQN

SEQ ID NO: 20116 - protein, 469 aa, Bacillus cereus
MEKLQIGVVGVGVMGKSLALNFESKGYSVALYDISKEKVDETIEENRGKNLVGTHIVEEFVNSLESPRKILLMVNAGEITDKAIDSLVPHLDKGDILIDGGNTYFVDTIRRNKRLAEEGINFIGAGVSGGEEGALKGPSIMPGGQKDAYEKVKDMLENISAKVNNEPCCSYIGPNGAGHYVKMVHNGIEYGDMQLICEAYFFLKQTLDLTAEEFHEIFAEWNKGELNSYLIEITADIFKKKDEETGKPLVDVILDTAGQKGTGKWTSQSALDLGISLPIITESVFARCISALKEERVNASKVLSGPKNKTAIGVEKAELIEAVRQALYMSKICSYAQGFTQLKAASEEYDWNLDFGSISMLWRGGCIIRAAFLQNIKEAYETNTDLPNLLLDPYFKEIVESYQGGLRQIISMAVQQGIPIPAFSAAISYYDSYRTAKLPANLLQAQRDYFGAHTYKRVDKEGTFHTKWI

SEQ ID NO: 20117 - protein, 482 aa, Propionibacterium acnes
MQEGDSVTPHTSTTVDKGDAGYDKALKNRHLQMIAIGGSIGTGLFLGTGGRLAQGGPGLAISYAVCGIFAFLMVRALGEMAIRRPSSGAFVSYAREFMGEKGAYATGWFFFLDWSVTVMADITAVALYLHYWTPLRAIPQWVLALIALGVVFTLNMLSVKMFGEAEFWFAAIKVAAIILFMIAAIWAIVTGARVGNYTAGLHNIAQHGGFFPAGLAPVFALTLGVIFAFGGTEMVGVAAGETKDASKILPKAINSMILRIFVFYVGSIILMALVLPYTAYSSNESPFVTFFTGIGIPYAGDIIQVIVLTAALSSLNAGLYSTGRTLRSLAVAGEAPKAAAKLNRHHVPSGGIAMTAALGLLGVALNAFLPDSAFEIVMNLAGIGIAGTWAMVLLAHTRFVSAVRRGKDNRPEYRMPGAPVTNYISLAFLLIVVLSNVTSESGRWTLALFALVAIAMVAGWYAVRNSIKPDLLDNVVPSDEGM

SEQ ID NO: 20118 - protein, 432 aa, Prochlorococcus marinus
MASSDDAKLRPLPNTAALSGVLEAFAFFRDPAFAQKRFKRHGNVFETSLLGQPMVFIQGGQAISDLLAQPNAVEGWWPESVRKLLGSHSLANRNGASHRARRRVIGQLFSASALQRYSAGIISMVKDLADELQAATTALPLAERMRRFAFSVIATTVLGLEGTDRDELFVDFEIWTRALFSIPIALPGSSFAKALKARERLLKRLQKVLLKASNGNGGLDLLAGGLDEAGIPLTDEDVVEQLLLLLFAGYETTASSLSCLMRELLLNPQVETWLREEIDGLDWPPAPEQATTAYDQVNAPKLDAVVSEIMRLTPAVGGFFRRTKCALVIDGVEVPKNRVVQVALAASNRHGAGDLEAFRPQRHLDDGCSATLLPFGGGERVCLGKPLAELEIRLMVVGLFHQLRLHLIPDQDLTLQMLPSPTPRDGLLTKVL

SEQ ID NO: 20119 - protein, 736 aa, Moorella thermoacetica
MEVIVADYAGFCFGVKRAVEKAREAPKPVASLGMLIHNRQVVDQLAREGVRPVASLDEVNCGRILIRSHGTTPETLVRARDKGLEIIDATCPYVKRAQHLAQKMAAEGYQVIIVGDAAHPEVQGMLGWAGPGAVVVPDKKAAAALPFHPRRAVLAQTTQPESRLEEVAAALRSNTDTLVVHNTVCQATHQRQEAAVRLARQVDVMVVVGGKESANTRHLAELCRATGTPTYHVERAGELCRQWFINTRRVGVTGGASTPAWIIEEVVGMLTGEEKIMVPEEEKEPVTTQEPVASGQPVAPAEPEGNPAITGPEGGAEPPAAEAAKSGAFGGQEGPGVAPGETGTPEEQRNEMQQITARMPELRRGNVVAGTVVQITDNEVMVDVGGKSEGVIPLNELSHRNVTDPHEVVAVGDTINVMVLRPENEEGHPVLSKRRADRRVAWEKLEEHLASGEEIQGEVIEVVKGGLLVDVGVRGFLPASLVERGYVEDLNAYLGQTLRLRVIELDRSKNKVVLSRKAILEEEYEKQRQATWNSLEVGQVRKGIVRRLTNFGAFVDLGGVDGLLHVSEISWGRVEHPRDALSEGQEIEVKILGIDREEGKVSLGRKQLLPNPWDTAAERYPVGTIVEGKILRLAPFGAFVEVEPGIEGLVHISQLADRHVDKPEDVVSIGDIIPVKVLGVDQQAQRMSLSLRQAIREKNRKQAKPAEKPAENQNESGVKLGDLFGDLFEANQSTNQ

SEQ ID NO: 20120 - protein, 451 aa, Streptococcus pyogenes
MVVKVKQKIPLKIKRMGINGEGIGFYQKTLVFVPGALKGEDIFCQITAVKRNFAEAKLLMVNKASKNRVKPACSVYETCGGCQIMHLAYPKQLDFKDDVIRQALKKFKPTGYEQFEIRPTLGMKKPDHYRAKLQFQLRSFGGTVKAGLFSQGSHRLVPIDNCLVQDQLTQDIINKITQLVDKYKLPIYNERKIAGIRTIMVRKAQASDQVQIIVVSSKEVRLARFIGELTKAFPQVKTVALNSNCSKSSEIYGDETEILWGQEAIHEEVLDYGFALSPRAFYQLNPQQTEVLYGEVVKALDVGSKDHIIDAYCGVGSIGFAFAGKVKSVRGMDIIPEAIEDAQKNAKSMGFDNAYYEAGKAEDIIPKWYKQGYRADAIIVDPPRTGLDDKLLKTILHYQPKQMVYVSCNTSTLARDLVQLTKIYDVHYIQSVDMFPHTARTEAVVKLQKRV

SEQ ID NO: 20121 - protein, 607 aa, Medicago truncatula
MDTNLGSLEACKSPCNDIITTPTSNGTVSTIQKSPSTQSLASSESTLGSHLARRLVEVGITDIFTVPGDFNLTLLDHLIAEPKLKNIGCCNELNAGYAADGYARSRGVGACVVTFTVGGLSVINAIAGAYSENLPVICIVGGPNSNDFGTNRILHHTIGLPDFSQELRCFQTVTCYQAVVNNLEDAHEMIDTAISTALKESKPVYISISCNLASIPHPTFSREPVPFSLSPKLSNPMGLEAAVEAAAEVLNKAVKPVLVAGPKLRVAKACEAFIELADKSAYPYSVMPSAKGLIPEDHKHFIGTFWGAVSTAFCAEIVESADAYLFAGPIFNDYSSVGYSLLLKKEKAIIVQPDRVVIGNGPTFGCVLMKDFLSALAKRLKRNNTAYENYFRIFVPEGLPVKSEPREPLRVNVLFQHIQNMLSSETAVIAETGDSWFNCQKLKLPKGCGYEFQMQYGSIGWSVGATLGYAQAVPEKRVIACIGDGSFQVTAQDVSTMLRCGQKTIIFLINNGGYTIEVEIHDGPYNVIKNWNYTGLVDAIHNGQGHCWTTKVFCEEELVEAIETATGPKKDCLCFIEVIVHKDDTSKELLEWGSRVSSANSRPPNPQ

SEQ ID NO: 20122 - protein, 134 aa, Haemophilus somnus
MSDLLKTLTSIRALRVATKEFTLQELESILEKFQLITNERRQLIEENQRKEQDRLERIAKYKALLAQDGLTLTDLVDDPTFTTKRPRKKIAPRKAKYQYTDQNGKVKTWTGQGRMPFSLQAELNTGKTLADFEI

SEQ ID NO: 20123 - protein, 570 aa, Oryza sativa
  misc_feature (393)..(393): Xaa can be any naturally occurring amino acid
MEASDEDRPLIHHLPPQEQCSKYTCDGTVNIDSKPALKQSTGNWRACFFILGVEFTECICFYGVSKNLVTYLTSVLHESNVNAAQSVSIWIGSCFFTPLIGAFLADTYWGRYWTVVMSILVIILGMIVLTVSASPLFLNASFYNGGISRLTVYLGLYLFALGTGGIKPNIPAFGADQFDGADPVERVTKGSFFNWYYFSINVGSLLSSTVVVWVQDNIGWSVGFAGPMLLLGFGLAMFIAGRRAYRYKKLGGSPLTRVFQVLVAAVRNHRLNLPDDSSLLHELPGVTEGDYRTQHTYQFRFLDKAAILSDKNCAPAAPSSPWRLCTVSQVEELKMLLRTFPVWASLVGFFMVTAQMTSTLIEQGVAMDGRVGRFTVPPASLATFDVHEGLALXPVYDAALVPLARRVTGRDRGVSHMQRIGVGLALSAVAMAYSALVEARRLAMAAAAAGTRMSIAWQVPSFFVLGAGEVFAVIGMLEFCYEQSPASMKSLGTALVQLAVAVANYLNSGMLRVVAAATARGGGAGWIPDKLDEGHLDYFFWMMAALSVLNLLQFLHCSIRFRGNNTLSSS

SEQ ID NO: 20124 - protein, 134 aa, Methanosarcina barkeri
MKEITAIIRMNKAQRTKDVLLECGFPSFTIRRVMGRGKQRGLCHEFNPPLPDPEKEAETCIRFIPKRMFTIVVDDENVSEVVQKIIEVNQTGNAGDGKIFVSDVTEAIRIRTGESGEATVNKSWYNGSRNRFKN

SEQ ID NO: 20125 - protein, 72 aa, Bacillus subtilis
MAKDDVIEVEGTIVETLPNAMFKVELENGHTVLAHVSGKIRMHFIRILPGDKVTVELSPYDLTRGRITYRYK

SEQ ID NO: 20126 - protein, 456 aa, Chromobacterium violaceum
MSEAHTGLQRELKNRHIQLIALGGAVGTGLFLGSASVLKSAGPSMILGYAIAGFIAFMIMRQLGEMVAEEPVAGSFSHFAYRYWGRFPGFLSGWNYWVLYVLVSMAELTAVGAYVQYWWPHVPAWLTALVCFVCINGINLANVKSYGETEFWFALIKVAAVIGMILFGGYLLLSGSGGPQASVSNLWNDGGFFPHGVKGLFMMMAVIMFSFGGLELIGMTAAEANDPQKTIPKAVNQVIYRILIFYIGSLVVLLSLYPWNKVAAGGSPFVMIFEQIGAGFTAHALNFVVLTAALSVYNSCVYATSRMLFGLARQGNAPRALGKLDTRGVPVYATLFSAAATFACVILNYLLPGEALGLLMSLVVAALVTNWAMISLTHLKFRRAKGGQKLVFPSFWFPLSNWICLAFMVMILGILLFTPGMAVSVYVLPVWLGLLWLGFRLKKPSPAEARLAGENA

SEQ ID NO: 20127 - protein, 219 aa, Glycine max
MDAASEAAAAVAAPQAEGSPAAAAAPSRYESQKRRDWNTFLQYLRNHKPPLTLARCSGAHVIEFLKYLDQFGKTKVHIAGCPYFGHPNPPAPCACPLKQAWGSLDALIGRLRAAFEENGGRPESNPFATRAVRIYLKEVREGQAKARGIPYEKKKRKRTAVTTSVTSAATVMSTLTGSSPNNTITNGAGSTTGNTTNGAGVSVPSVAATATPNVTATAV

SEQ ID NO: 20128 - protein, 320 aa, Coxiella burnetii
MNKPQHHSLIILGSGPAGYTAAIYAARANLKPIMITGMEQGGQLMTTTDVDNWPGEAPGLQGPQLMERMQKHAERLDTQFIFDHINEADLNQRPFLLKGDNATYSCDALIIATGASARYLGLPSEKAYMGKGVSACATCDGFFYRGKKVAVVGGGNTAVEEALYLSHIASHVTLIHRRDKLRAEKMLSAQLIKKVEEGKVAIVWSHVIEEVLGDDQGVTGVHLKHVKEEKTQDLTIDGLFIAIGHDPNTKIFKEQLEMDEAGYLRAKSGLQGNATATNIPGVFAAGDVTDHVYRQAITAAGMGCMAALDAERYLDSLNQA

SEQ ID NO: 20129 - protein, 448 aa, Unknown
  Psychrobacter sp. TAD1
MSISKAIEKVEARYAHQPEFIQAVKEVAITIKPLYDAHPEYDKLKVFERLVEPDRVFGFRVNWEDDNGEIQINRGWRVQFSNALGPYKGGLRFHPTVNQSVLKFLGFEQIFKNALTGLPIGGGKGGSDFDPKGKTDSEIRRFCYAFMRELHHYVNKDMDVPAGDIGVGGREVSYMFAMYKNLTRESTGVITGKGVGFGGSLMRTEATGYGAVYFLQNMLAAQNESIEGKKVLVSGAGNVSLHAAEKATLIGAIVLTVSDSKGTIYDAKGLNQEKIDWLKVQKDQHKPLADYVEVFGGEWMADQKPWSIKADIAIPSATQNEINEEDAKLLVDNGVKYIVEGANMPLTAEAIDYIRLHRVHYAPGKAANAGGVAVSALEMSQNSVRQYQTFEQVDERLQGIMKDIHDSSAQASEMYGQTDEGYIDYMSGANMVGFKRVADALVAFGILN

SEQ ID NO: 20130 - protein, 290 aa, Triticum aestivum
HEDNADITLSCAPVGESRASEYGLVKFDSSGRVVQFSEKPKGDDLEAMKVDTSFLNFAIDDPAKYPYIASMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 20131 - protein, 83 aa, Coxiella burnetii
MAKEESIEMQGTVVDSLPNTTFRVKLENGHVVTAHISGRMRKHYIRILTGDAVTVELTPYDLTRGRIVYREAGKKPPTSKAEE

SEQ ID NO: 20132 - protein, 489 aa, Salmonella typhimurium
MGSKTKTTEAPALRRELKARHLTMIAIGGSIGTGLFVASGATISQAGPGGALFSYILIGLMVYFLMTSLGELAAYMPVSGSFATYGQNYVEEGFGFALGWNYWYNWAVTIAVDLVAAQLVMGWWFPDTPGWIWSALFLCVIFLLNYISVRGFGEAEYWFSLIKVATVIIFIIVGVAMIIGIFKGVEPVGWSNWTTGDAPFAGGFAAMIGVAMIVGFSFQGTELIGIAAGESENPEKNIPRAVRQVFWRILLFYVFAILIISLIIPYTDPNLLRNDVKDISVSPFTLVFQHAGLLSAAAIMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGYDVNDLPYRSGFFPLGPIFAFVLCLIITLGQNYEAFLKDTIDWGGVAATYIGIPLFLLIWFGYKLIKGTHFVRYSEMHFPERVKK

SEQ ID NO: 20133 - protein, 411 aa, Prochlorococcus marinus
MKCDPSIAKLINNELSRQETHLELIASENFASKAVMEAQGSVLTNKYAEGLPNKRYYGGCEYVDGVEQLAIDRAKNLFGANWANVQPHSGAQANFAVFLSLLKPGDTIMGMDLSHGGHLTHGSPVNVSGKWFKTCHYEVDKKTEMLDMDAIRKKAIENQPKLIICGFSAYPRKIDFKAFRSIADEVNAYLLADIAHIAGLVASGLHPSPIPYCDVVTTTTHKTLRGPRGGLILSKDKEIGKKLDKAVFPGTQGGPLEHVIAAKAVAFKEASAPEFKIYSQKVISNAKVLSNQLQKRGISIVSKGTDNHIVLLDLRSIGMTGKVADQLVSDIKITANKNTVPFDPESPFVTSGLRLGSAALTTRGFNEQAFGDVGNVIADRLLNPNDEDIKEKSINKVSELCNKFPLYSENI

SEQ ID NO: 20134 - protein, 615 aa, Geobacillus kaustophilus
MCGITGWVHFGRNLRRERTVIDSMTETLAKRGPDDTNTWLDTHVAFGHKRLVVVDPAGGKQPMVRQKNGHRYTIVYNGELYNTEDIRKELLRQGYRFDGHSDTEVLLAAYMEWKEKCVDWLNGIFAFAVWDGERELLFMARDRLGVKPLFYREDGGGLLFGSEVKAILAHPDVKAEVNYEGLAEVFGLGPSRTPGHGVFDGIRELRPAHALTFSRSGLRIWRYWNVESDVHRDSFEETVEKLRFLLTDAVTRQLVSDVPVCTFLSGGVDSSAITGIAANAFAADGKGPLHTYSIDYEGNDQYFKANDFQPNTDAPFIEQVSNKFQTVHHRCVITQEELFRHLHEAVIVRDVPGMADVDSSLLWFCKQIRERFVVSLSGECADEIFGGYPWFHRPDDLSRKGFPWMRSVDARMGLLKDEWRQKLRLDDYVQMRYEQTLAEVPRLEGESAEEAKRRELFYLNMIWFMTTLLDRKDRMSMGASLEVRVPFADHRIVEYVWNIPWDMKMYGGREKGLLRKALEGLLPEEVLYRKKSPYPKTHHPLYTKLVKQWLEQLLHDRSSVLHEFFDREKLLALIETEGKSFQVPWFGQLMTGPQLLAYLGQVHVWFDHYGIRIKE

SEQ ID NO: 20135 - protein, 356 aa, Aspergillus oryzae
MSESTTISNTENLMKYMNLDQRGRVQAEYVWIDSVGGCRSKTKTLSKKVTSVDELPEWNFDGSSTGQAPGDNSDVYLRPVAIYPDPFRLGDNILVLCETWDSDGTPNKYNHRHDANRLMEVNAKEEFWFGLEQEYTLLGNDGWPYGWPKGGFPGAQGPYYCGVGTGKVYCRDIVEAHYRACLYAGINISGINAEVMPSQWEYQVGPCPGIEMGDQLWMSRFLLHRVAEEFGVRISFDPKPIKGEWNGAGLHSNVSTVATRAEGGMKAIEAYMKKFEARHVEHIAVYGEGNEERLTGRHETGSIDKFSYGVADRGGSIRIPRQVAKDGKGYFEDRRPASNACPYQITGIIVETLSNK

SEQ ID NO: 20136 - protein, 561 aa, Bacillus cereus
MIHLKTQYTVSTYLLDRLSELEIEHIFGVPGDYNLAFLDDVVAHEKLEWVGNCNELNAAYAADGYARIKGIAALITTFGVGELSAINGVAGSYAENVPVIKITGTPPTTVMENGALVHHTLGDGKFDHFSNMYREITVAQTNLTPEHAAEEIDRVLRACWSEKRPVHIQLPIDVYNKPINKPTESILHKPVVSNKDALDKMLLHATSKINSARKPVILADFEVARFHAEEYLHQFVEKTGFPIATLSMGKGIFPEKHPQFIGIYTGDVSPSYLRKRIDESDCIISIGVKLTDTITGGFTQGFKKEQVIEIHPYTVKIMDKKYGPVVMKDVLKQLNDLIEHRKEDTLEIKPFISESLPITEEFNPKAQMITQKRFWQQIYHFLQENDVLIAEQGTPFFGSATIPLPNNTTYVAQPLWGSIGYTLPALLGTQLANLSRRNILIIGDGSFQLTVQELSTILRKNLKPIIFLINNNGYTVERAIHGQNEPYNDIQMWDYTKLANVFGTEEKSLTWKVENETELAEVLMNITVNNNQLIFIEVVMSQGDQPELLANLGKRFGMQNS

SEQ ID NO: 20137 - protein, 349 aa, Myxococcus xanthus
MEPTPKVIRHFHPVLSARALGTRPVRVEVAGRAYALFRDGTGQPAALADACPHRFAPLSKGTVRADGRLQCPYHGWRFDAEGRGSNPSQPELRHCDARSFQVVERYGYLWLAERDTPLSAMPDMGDEGYVFGGAFSTHFAAPLHVSLDNFSEDEHTPYVHTRLGWDDPNAGRVEFEARNLEDRTEVHYRAPQRPAPIMTVLGVRDGDFFQNDWVTRFDPVRSQYTIRWVAPDGSPRPFITRANIFFVPETARTTRLHVFSFLRTEQRLLRPLLPVAARAAMALTWWEVRDDARFITTVADTPYSHKGMRLDRFDAPLVHQRRLMERIYYGAGPKMTGAVVPLSREAPGG

SEQ ID NO: 20138 - protein, 204 aa, Antirrhinum majus
GVHFGHGTRKWNPKMAPYISAKRKGIHITNLTRTARFLSEACDLVFDAASRGKQFLIVGTKNKAADSVAWAAIKARCHCVNKKWLGGMLTNWSTTETRLHKFRDLRMEQKTGRLNRLPKRDAAMLKRQLSRLQTYLGGIKYMTGLPDIVIIVDQHEEYTALRECITLGIPTICLIDTNCDPDLADISIPANDDAISSIRLILNK

SEQ ID NO: 20139 - protein, 957 aa, Klebsiella oxytoca
MTKPVLVLVGHGMVGHHFLEQCVSRDLHQQYRIVVFCEERYAAYDRVHLTEYFAGRSAESLSLVEGDFFTQHGIELRLSESVASIDREARVVRDAFGHETHWDKLVLATGSYPFVPPVPGHNLEGCFVYRTLDDLDQIAARAATARRGVVIGGGLLGLEAANALKQLGLETHVVEFAPNLMAVQLDNGGAAMLREKISELGVGVHTSKATTEIVRNEQGLQLNFRDGSSLATDMLVFSAGIRPQDALARSGGLSVGERGGICIDNQCRTSDPDVLAIGECALWENKIYGLVAPGYQMAARRAATLAGEAGSFSGADMSTKLKLLGVDVASFGDAQGRTPGCQSYQWTHGPQQVYKKIVVSADGKNLLGGVLVGDAGDYATLLQMMLNGMALPKHPESLILPALEGSRPKALGVAALPDGAQICSCHNVSKGDICQAVSGGAGDMAAIKSRTKAATGCGGCSALVKQVMEYQLAEQGVEVKKDICEHFPWSRQEIYHLVRVNHIRTFEQLIARYGQGHGCEVCKPLVASVLASCWNEYLLKPAHLPLQDTNDRYFANIQKDGTYSVVPRMAAGEVTPDGLIAIGQIAKRYQLYSKVTGGQRIDLFGARLEQLPAIWRELAEAGFETGHAYGKSLRTVKSCVGSTWCRYGVQDSTGLAVTLEHRYKGLRAPHKIKMAVSGCTRECAEAQGKDIGVIATEKGWNLYVCGNGGMKPRHADLFASDLDEATLIRSIDRLLMFYIRTADRLQRTSTWMDNLEGGVDYLREMILEDSLGIGEELEQEMARVVESYQCEWQTTLNDPQRLALFRSYVNSDEPDETVQRQTLRGQPQLAPFAAQGEPALPSRPWQAICDLDAIPQQAGIGARLGERQIALFRFGDQVYALDNLEPGSEANVLSRGLLGDAGGEPIVISPLYKQRIRLRDGRQCDGGEQAVRAWPVKVENGKVWVGNQQLLARAEAS

SEQ ID NO: 20140 - protein, 699 aa, Magnaporthe grisea
MATIALPRPIPAHRASSGLSLSSSSIAIDSINANPVPNKHLPVCPPGPVPRSAPHPHDNHPPTLETLDSDHNSVNESSQSILFPPDAFPRFSSADGGSLIVYQLTPRDIADALDHIARQPLPDPSAVFPWLHGLHPQNHIQQAFFVQRRRSLRRTPHCLRSVTLVKADGDLSTSRLKGAIAPQEFLQSDTAEFIDVDPKDGFSVRNFQIQSAKSAMTSDIVVYGDDEPLVRKVGWDIANAQQAWRQKHIDQGDLALPEYNTFVCLSRFSSFEKNHPEIVAVDSGGRLTGRVVDLFSQERREMYAMTKASEIAPNVFLGPTPDPSTGEDQDYDIFIECNDMAQLSPVCLQAIVGIPDEVIQQVFLEFPSSGSILPPTWSQAEADGILDTCKWLYHLAQGTCPDPVDIDNGEAMTGAGSQSKFPPRKILIHCQDGYTESTMLAIAYVSYATGMPVPEAWLHLHTVKKRNFFAYPTDVALLTAIAPRLLSASPVHAETASLAEMTAMLKSERNEPKWLAGLDGSLPSRILHYMYLGNLGHANNPDLLRELGIGQILSVGETAMWRDGELEQWGPENVCIVENVQDNGIDPLTCEFQRCLEFIERGRRNGTATLVHCRVGVSRSATICIAEVMKELKLSVPRAYSFVRARRLNVIIQPHLRFAYELLKWEELLQLHWNGKIQRELEWSEITREIALMNRPYAR

SEQ ID NO: 20141 - protein, 546 aa, Iris lactea
MGSGMEDLLVRLGVVSSTSDHASVVSINLFVALLCACIVIGHLLEENRWMNESITALAIGLCTGVVILLTTNGKSSHIFVFSEDLFFIYLLPPIIFNAGFQVKKKQFFRNFMTIMLFGAVGTLISFVIISLGAIGLFRKMNIGPLEIGDFLAIGAIFSATDSVCTLQILNQDETPLLYSLVFGEGVVNDATSVVLFNAIQNFDLEHIDAGIAAKFIGNFFYLFVSSTFLGAFAGLLSAYIIKKLYYGRHSTDREVALMMLMAYLSYMLAELLDLSGILTVFFCGIVMSHYTWHNVTESSRVTTKHAFATLSFISEIFLFLYVGMDALDIEKWRFVSDSPGKSIGVSAIIIGLVLIGRAAFVFPLSFLSNLAKKSPNEKITFNQQVTIWWAGLMRGAVSIALAYNQFTRAGHTQLPGNAMMITSTITVVLFSTVVFGLLTKPLIRLLLPPSTKHLTGSCSFNSEPSTPKFLSAALLENIPGFEAEGGTTNLGARPSSLRMLLMKPTHTVHYYWRKFDDAFMRPMFGGRGFVPFVPGSPTEQSVHGWE

SEQ ID NO: 20142 - protein, 534 aa, Unknown
  Synechococcus sp. CC9311
MSNAVSIKGSRAAGERVLFVRLPCNPIFPIGPIYLADHLHKCFPDLPQRILDLAALPVLDVEGVLLNVVDQFRPTLLVFSWRDIQIYAPVDGRGGNPLQNSFEVFYARNPLKRVKGALGGLRLMTSHYGELHRNQKLVRHGLKRARRHSPEARAVLGGGAVSVFYEQLGRSLPKGTIISIGEGEPLLEKLLAQQPLDGERCFVVGEAPRPGLIHEQPESRPKTACDYNYISSIWPQLDWYLEGGDFYVGVQTKRGCPHNCCYCVYTVVEGKQVRVNPVQEVVAEMRQLYDRGVRGFWFTDAQFIPARKYIEDAKELLRAIKAEGLTGIRWAAYIRADNLDPELAQLMVETGMSYFEIGITSGSQELVRKMRMGYNLRTVLDSCRMLAEAGFHDHVSVNYSFNVIDERPETIRQTVAYHRELEAIFGEDRVEPAIFFIGLQPHTHLEQYGFDQGLIKPGYNPMSMMPWTARKLLWNPEPMGSTFGRVCLEAFDRDPGRFGKTVMELLERDYGVAPLDQALRAPVQGRAALAKAVS

SEQ ID NO: 20143 - protein, 241 aa, Pseudomonas aeruginosa
MVFQHDIYAGQQVLVTGGSSGIGAAIAMQFAELGAEVVALGLDADGVHAPRHPRIRREELDITDSQRLQRLFEALPRLDVLVNNAGISRDREEYDLATFERVLRLNLSAAMLASQLARPLLAQRGGSILNIASMYSTFGSADRPAYSASKGAIVQLTRSLACEYAAERIRVNAIAPGWIDTPLGAGLKADVEATRRIMQRTPLARWGEAPEVASAAAFLCGPGASFVTGAVLAVDGGYLCA

SEQ ID NO: 20144 - protein, 360 aa, Vitis vinifera
MAAMVLLLGFLLATLQITGVKSVGVCYGMLGNNLPPASQVVALYKSRNIDRMRIYDPNQAALQALRGSNIQLMLGVPNSDLQGLATNPSQAQSWVQRNVRNYWPGVSFRYIAVGNEVSPVNGGTSRFAQFVLPAMRNIRAALASAGLQDRVKVSTAIDLTLLGNSYPPSQGAFRGDVRGYLDPIIRFLVDNKSPLLANIYPYFSYSGNPKDISLPYALFTANSVVVWDGQRGYKNLFDAMLDALYSALERAGGASLEVVLSESGWPSAGGFGTTVDNARTYNSNLIRHVKGGTPKRPGRAIETYLFAMFDENKKEPQLEKHFGLFFPNKQPKYSINFSGEKPWDVSSENDTNEESLKSDI

SEQ ID NO: 20145 - protein, 154 aa, Solanum lycopersicum
MGCPKLQSVLYFCRQMTNDALVSIARNRSNMIRFCLCIIEPQTPDYLILEPLDTGFGAIVQHCKEVQRLSLSGLLTDRVFEYIGVHAKKLEMLSLAFAGDSDIGLLYVLSGFESLRKLETRDCPFGDEALLANAAKLETMRSLWMSNCSVSFEA

SEQ ID NO: 20146 - protein, 183 aa, Lactococcus lactis
MLEKNLDKAIEKVLVSEEEIIEKSKELGEILTKEYEGKNPLVLGILRGSVPFLAELIKHIDCHLETDFMTVSSYHGGTKSSGEVKLILDVDTAVKGRDILIVEDIIDTGRTLKYLKELLEHRGANVKIVTLLDKPEGRIVEIKPDYSGFTIPNEFVVGFGLDYEENYRNLPYVGVLKPEVYNK

SEQ ID NO: 20147 - protein, 115 aa, Methanothermobacter thermautotrophicus
MKTMRKITAIIRREKLEDVKDALELMGIHGMTVSDVKGRGQQMGIRESYRGMDYCVDLLPKVQLEIVVDSEDLERTVEAISENARTGDVGDGKIFVTDVIDVVRIRTGEHGRDAI

SEQ ID NO: 20148 - protein, 150 aa, Zea mays
MAPKAEKKPAAKKPAEEEPAAEKAPAGKKPKAEKRVPAGKSAGKEGGEGKRGRKKGKKSVETYKIYIFKVLKQVHPDIGISSKAMSIMNSFINDIFEKLAAEAAKLARYNKKPTITSREIQTSVRLVLPGELAKHAVSEGTKAVTKFTSS

SEQ ID NO: 20149 - protein, 359 aa, Coxiella burnetii
MFAQVTYIWMDGAQPTQKLRSKVRIVKHPERDITLADFPEWGFDGSSTYQATGKDSDLILQPVHFVKDPILGDGNYLVLCEVMNPDGSPHASNTRARLRQIMANGAAEHEPWIGFEQEYTLFQGVQPLGWPDRGYPAPQGPFYCGIGADEVFGRPLVEEHATACIEAELMIFGTNAEVMPGQWEFQIGYRGADDETPDPLTVSDHLWLARWLLYRIGEDYGITATLQPKPVKGDWNGAGKHTNFSTKLMRDPATGREAIEQAIERLSKRHDAHIAVYGHGLEERLTGKHETAPITQFSSGVGNRGASVRIPSAVASRGCGYLEDRRPGANADPYQVAAILLETICGIQLPKNSGIETTV

SEQ ID NO: 20150 - protein, 379 aa, Oryza sativa
MASALGAQASVAAPIGAGGYGRRSSSSKGSNTVNFCNKSWIGTTLAWESKALKSRHMNKIFSMSVQQASKSKVAVKPLELDNAKEPPLNLYKPKEPYTATIVSVERLVGPKAPGETCHIVIDHGGNVPYWEGQSYGVIPPGENPKKPGSPNTVRLYSIASTRYGDSFDGKTASLCVRRAVYYDPETGKEDPTKKGICSNFLCDSKPGDKVQITGPSGKIMLLPEDDPNATHIMIATGTGVAPYRGYLRRMFMEDVPSFKFGGLAWLFLGVANTDSLLYDEEFTNYLQQYPDNFRYDKALSREQKNKNGGKMYVQDKIEEYSDEIFKLLDGGAHIYFCGLKGMMPGIQDTLKRVAEQRGESWEQKLSQLKKNKQWHVEVY

SEQ ID NO: 20151 - protein, 1239 aa, Cochliobolus heterostrophus
MAAETYSGVAAIIRNLARQHDPARDPSFSAQVSANGAKTAANAIALPGPESEEKTQLEQELSALCSRIDFLEHKCSHAAAKSGQFPLTPAQESPDDGVLYTPAGAIRNSSAPPGQARRGSNKERAIWVSNWLAAKETNGGPEEPAAALTEEQLNYLRVHLNQQADQIRNQREHIDNLSREVNKQLTTQSMVFEHGIEDIGALKRELGKHQQANLAFQKALREIGAIVTAVAMGDLSKKVLIHAKEMDPEITLFKRTINTMVDQLQEFASQVTFLAREVGTEGRLGGQANLPGVAGIWAELTDSVNMMANNLTEQVREIAVVTTAVAHGDLSRKIERPARGEILQLQQTINTMVDQLQSFATEVTKVARDVGTEGKLGGQAEIAGVKGMWNELTVNVNAMAQNLTTQVRDIAQVTTAVAQGNLTRKVEAQCKGEILELKNTINRMVDQLQQFAHEVTKIAREVGSEGRLGGQATVHGVEGTWKDLTENVNGMAMNLTTQVREIAEVTTAVARGDLSRKVKAEVQGEILSLKITINTMVDRLNTFAQEVSKVAREVGTDGILGGQAQVDNVEGKWKDLTNNVNTMAQNLTLQVRSISEVTQAIAKGDMSRRVHVDAEGEIRLLKDTVNDMVMRLDEWSLAVKRVARDVGVDGKMGGQADVRDIDGRWKEITTDVNTMAQNLTSQVRAFGDITNAAMEGKFTQITVEASGEMDELKRKINQMVSSLRESIQRNTAAREAAELANKTKSEFLANMSHEIRTPMNGIIGMTQLTLDTDLTHAQREMLTIVHNLAGQLLTIIDDILDISKIEANRMVMEEIPFSMRGTIFNALKSLASRANERKLNLAYDVSYTVPDYVVGDSFRLRQIILNLVGNAIKFTEHGEVKVAISMAQEQDCGPDHYVFQFAVSDTGIGIRGDKLNLIFDTFQQADGSTTRKFGGTGLGLSISKRLVTLMGGRMWVESDFGKGSVFYFTCRVRLGKPEITAIQPQLVAYKQHTVLFVDQGNTGFSDQIIEHLKALDLVPMVVNSVEEVPETTKRADMPYDCVIVDNDKTARELRIAERFKYIPLVMLTPHVCISLRSALENGISSYMTTPCLPIDLGNALIPALDGRAAPLVSDHSKSFQILLAEDNAVNQKLAVRILEKYHHRVTVANNGLEAFEHIQKKRYDCVLMDVQMPVMGGFEATAKIREWERENGIPSTPVIALTAHAMVGDREKCLAAQMDDYLSKPLRQNQLIQTILRCA

SEQ ID NO: 20152 - protein, 457 aa, Shigella flexneri
MDHLPIFCQLRDRDCLIVGGGDVAERKARLLLDAGARLTVNALAFIPQFTAWADAGMLTLVEGPFDESLLDTCWLAIAATDDDTLNQRVSEAAEARRIFCNVVDAPKAASFIMPSIIDRSPLMVAVSSGGTSPVLARLLREKLESLLPLHLGQVAKYAGQLRGRVKQQFATMSERRRFWEKLFVNDRLAQSLANNDQKAITETTEQLINEPLDHRGEVVLVGAGPGDAGLLTLKGLQQIQQADVVVYDRLVSDDIMNLVRRDADRVFVGKRAGYHCVPQEEINQILLREAQKGKRVVRLKGGDPFIFGRGGEELETLCNAGIPFSVVPGITAASGCSAYSGIPLTHRDYAQSVRLITGHLKTGGELDWENLAAEKQTLVFYMGLNQAATIQQKLIEHGMPGEMPVAIVENGTAVTQRVIDGTLTQLGELAQQMNSPSLIIIGRVVGLRDKLNWFSNH

SEQ ID NO: 20153 - protein, 204 aa, Alectra orobanchoides
GVHFGHGTRKWNPKMAPYISAKRKGIHITNLTRTARFLSEACDLVFDAASRGKQFLIVGTKNKAADSVAWAAIKARCHCVNKKWLGGMLTNWSTTETRLHKFRDLRMEQKAGRLNRLPKRDAAVVKRQLSRLQTYLGGIKYMTGLPDIVIVVDQHEEYTALRECITLGIPTICLIDTNCDPDLADISIPANDDAISSIRLILNK

SEQ ID NO: 20154 - protein, 589 aa, Coprinopsis cinerea
MKRFMVLALLALQTSILGALAQLELPSSPWLPPDSAQGAEATSGDDYPNPQWSTLLGNLLYFYEAQRSGELPSTNRVSWRNSSALDDGREARVDLTGGYYDAGDFSKQTFPLSFSLMSICWGATDFGKGYDLANQTVYLDDMLRWGLDWLIKAHANESTLYVLVDNKDIGNTYWGGDRSIPSPRPVYQINDTHPGTDVAAQASAAFAACSNLYAGRGLDNNTFSTPASLQDTDYANTLLDHAEQLYSFALNATGGRKVYQKSVPDAAKAYESSGFGDELAAAALFLSWANRDSAHFADAEEYYTRYKLADYNRVFNWDSKVPGLSILYAQIAKSFPSTGSNLSYWQEVAETYFDNIIDKKKPSTRTAGGLVWWDGDSNFASLNPALNLAMLMRRYAPLASNDDKKKKYLEFSQTQVDYALGKNPMSMPYIVGVNPNSPQNPHSAMASGGNDVETIDTYPNKTAYVLYGAVVGGPDIRDRFYDIRSDWPQTEVALDYNAPLLTLTAMHVVAGTEDPFYTSLKEGAYEKVKPDGLPCDAAIEEGCKGPKLSKKAQIAMGVTLTIVCLVVFGLSGYWIWLVQRRKNTTIYTY

SEQ ID NO: 20155 - protein, 493 aa, Medicago truncatula
MISSSQTHNMASKPGILTDWPWKPLGSFKFMILSPWIAHSMYSFIWGERDPVYHVIFPFMLIRMLHNQIWISISRYQTAKGKSKIVDKGLEFEQVDRETNWDDQILFTALVYYIGYMIFPMASNLPWWRIDGVILTAILHAGPVEFLYYWLHRALHHHYLYSRYHSHHHSSIVTEPITSVTHPFAEHLSYFTLFAIPMLTTLFIKKSSVAALYGYVFFIDFMNNMGHCNFEFIPKKLLSYFPILKYLSYTPSFHSLHHTKFRANYSLFMPMYDYIYGTVHKSTDATYETSLMRPKESPDVVHLTHLTTLDSIYQMRLGFASLASNPQTSKWYLHLMWPFTMFSMLITWICGRAFVLESNTFNDLKLQSWIIPRFKTQYFSKGQNITLNNLIEETIMEAELNGAKVISLGLLNQKHQLNAHCELYIGRLPQLKIKVVDGSSLAAATVLNNIPKGTNQVLLRGKFNKVAFAIANALCRKNVQCQYNEEGREKYMG

SEQ ID NO: 20156 - protein, 1114 aa, Unknown
  Azoarcus sp. EbN1
MDLLPAMAAPDKETDDGLWYKDAVVYELHVKAFFDANDDGVGDFNGLTRKLDYIRDLGVNTIWLLPFYPSPLKDDGYDVADYHGVLPAYGTRADFRQFVREAHRRGLRVITELVVNHTSDQHAWFQAARRAPAGSSKRNYYVWSDDPTRYSGTRIIFTDTETSNWAWDPVAKSYYWHRFFSHQPDLNFENPNVLKAVLRTMRFWLDMGVDGFRLDAIPYLREREGTNNENLPETHDVIREIRKCIDAHYRGRVLLAEANQWPEDVREYFGDGDECHMAYHFPLMPRLFMAVAQEDRFPVVDIMRQTPDIPENCQWAIFLRNHDELTLEMVTDRERDYMWQFFANDPRMRINVGIRRRLAPLLENSRDRVELMSFLLLTMPGSPILYYGDELGMGDNVFLGDRDGVRTPMQWTPDRNAGFSRADPQQLYLPPIMDPIYGFQAINVEAQARNPHSLLNFTRRLIAMRNSSRAFGRGMLRFLEPGNRKVLAYLREYRDQSVLCVANLARTPQAVELDLARFEGRVPVEIVGRVPFPPVGKLPYLLTLAGHGFFAFELSADAPPPNWHEERLPQTELPILVLTEGWRTFFRGHQGGSAVRRAIATRSRDQLQNEVLLPYLQARRWFAAKGETVTRIEVVEEQEWAAGGGNWLLALLEVSLASGSSHLYFLPLGIAWETAGDNPVDRFGAAALARVREKARIGILYDAFIDPVYCRALGQSMGGGGPQPLGGGSLRFTASEHYARFAEALGDEVRQPLQEQTNTGVFFGSRLYLKGYRRLQFGTNPEIEVGYFLGSAPEFSRVAAVAGSVEYIAPDGRVAALAMLQEFVDNQGNAWDYTLNHLDRLFSPDTWPAAAADEPEAEGMDRVYLLLAQTLGRRIGEMHAAFAHGTDPAFVPEPLGDAEVEAWRAQVIGDVERTLSLLEAALPRLDERARDEARQVLAAHHLLVARLAGLDLASPGLVKTRLHGDLHLGQVLIVQNDFVIVDFEGEPARSIDERRCRHSPLRDVAGMLRSFDYAVRTVGYHHLQARPEHAEALARALPEWKEGVVRSFMQAYGEVVAPLPSVPPDAAVAADFVTLFVIEKLLYELRYELDNRPEWVRIPLSALAEIAASPQGSH

SEQ ID NO: 20157 - protein, 204 aa, Unknown
  Agalinis sp. CWD 90.129
  misc_feature (73)..(73): Xaa can be any naturally occurring amino acid
GVHFGHGTRKWNPKMAPYISAKRKGIHITNLTRTARFLSEACDLVFDAASSGKQFLIVGTKNKAADLVAWAAXKARCHCVNKKWLGGMLTNWSTTETRLQKFRDLRMEQKTGRLNRLPKRDAAVVKRQLSRLQTYLGGIKYMTGLPDIVIIVDQHEEYTALRECITLGIPTICLIDTNCDPDLADISIPANDDAISSIRLILNK

SEQ ID NO: 20158 - protein, 204 aa, Alectra sessiliflora
GVHFGHGTRKWNPKMAPYISAKRKGIHITNLTRTARFLSEACDLVFDAASRGKQFLIVGTKNKAADSVAWAAIKARCHCVNKKWLGGMLTNWSTTETRLHKFRDLRMEQKAGRLNRLPKRDAAVVKRQLSRLQTYLGGIKYMTGLPDIVIIVDQHEEYTALRECITLGIPTICLIDTNCDPDLADISIPANDDAISSIRLILNK

SEQ ID NO: 20159 - protein, 631 aa, Dianthus caryophyllus
MELCDCIDTQWQDELLVKYQYISDFFIAVAYFSIPLELIYFVQRSAFFPYRWVLMQFGAFIVLCGATHLINLWTFSMHTKNVAIVMTIAKMATAAVSCVTALMLVHIIPDLLSVKTREMFLRHKAEKLDKERGLILTQEETGRHVRMLTHEIRSTLDRHTILKTTLVELGRTLNSEECALWTPSQTGMTMRLSHTLNHSMVVGSTVSMNLSVISEVFNNTGAVRIPHTCPLVRTRPVSDRYRAPDVVAVRVPLLHHSNFQINDWPDNSAKNYAVMVLISPSDGIRKFRDHELELVEVVADQVAVALSHAAILEDSMRARDQLMEQNVALDLARREAEMAIRARNDFLAVMNHEMRTPMHAIISLSSILLETELTPEQRMMLEIILKSSNLLSTLINDVLDLSRLEDGSLELDPTVFNLHAVFTEVIQLIKPIASVKKLSLTLGLAPEVPVYAVGDEKRLMQTILNVVGNAVKFTKEGFISVSASVARPESLTDWRASEFYPDLTDSQFYLRVQVRDSGCGINPQDIPLIFNKFTQFNRNSNGIGLGLAISKRFVNLMGGQIWIESDGHDKGSISTFVVKLGTCKGSSDTLTPATVRTHSEHGNTEFISNKQLFRGDDSINSIFKPYERSFR

SEQ ID NO: 20160 - protein, 296 aa, Helicobacter hepaticus
MKMPSMIRVALVQQAYKGNKEAMIESSAAMIAKAAHSNAQLVALQELHTHEYFCQSENPQFFDYAMDFDKDVAYFSALAKKHKIVLITSLFEKRAAGLYHNTAVVFDIDGSIAGKYRKMHIPDDPQFYEKFYFTPGDLGFEPISTSLGKLGVLICWDQWYPEAARIMALKGAQMLIYPTAIGWFDEDTLEEKTRQKEAWIAVQRGHSVANGLPTMAINRVGFESDSSKVGNGIRFWGSSFVFGAQGELLAQGSENKEEIILVEIDLQRSEEVRRMWPFLRDRRIESYSEILKRFCD

SEQ ID NO: 20161 - protein, 607 aa, Bixa orellana
MQSTASPASNTWISAHLSPPMESALGSDSSPTNILPFRQRSCSDFTINCSLHAPPLLHYPKQGQPSSTPKCNAVTHPAKQANPLSACSRPMKWNFMQHAAAMVIDAVETGLANHEDRHPLPKTADPKVQISGNYAPVGEKAAKRALPVTGRIPKCLQGVYIRNGANPAYDPTSGHHMFDGDGMVHALRLENGTASYACRFTETDRLCQERVIGRPVFPKAIGELHGHSGIAKLLFYTRSVFGLLNGCSGLGVANAGLVYFNGRLLAMSEDDLPYHVKIKCDGDLETAGRFDFDNQIYCPLIAHPKLDPITGELHTLSYNVLKKPYLKYLRFGTSGKKCRELDISLEQPTMIHDFAITENFVVIPDHQVVFKLSEMIRGGSPVIYDQKKMSRFGILQRDGVDESGIQWVEVSSCFCFHLWNAWEEPDTDELVVIGSCMTPGDSIFNEGEECLKSVLSEIRVDLKTGRSTRHPILCSTDEQLNLEAGMVNRNRLGRKTEWAYLAVGEPWPKVSGFAKLDLTSGEVQKYLYGDGKFGGEPSFIPNEPGNSEAEDDGYVLTFVHDERKSRSELQVLNAGDLRLEASLQLPSRVPYGFHGTFINGDELCNQA

SEQ ID NO: 20162 - protein, 204 aa, Bartsia alpina
  misc_feature (198)..(198): Xaa can be any naturally occurring amino acid
GVPFGHVTRKWNTKMAPYISAKRKGIHITNLTRTARFLSEACGLVFDAASRGKQFLIVGTKNKAADSVAWAAIKARCHCVNKKWLGGMLTNWSTTETRLHKLRDLRMEQKTGRLNRLPKRDAAVVKRQLSRLQTYLGGIKYMTGLPDIVIIVDQHEEYTALRECITLGIPTICLIDTNCDPNLADISIPANDDAISSXRLILNK

SEQ ID NO: 20163 - protein, 464 aa, Trichodesmium erythraeum
MTTTTKFNPYLMSNFAPVSKEITTNNLEIKGELPRDLSGMYLRNGPNPQFTPLGKYDWMDGDGMIHGVRISGGRAEYRNRYVRTGGFEVEKDLGYAVWSGRLEPPQMNNPYGPYKNVANNGLTFHNGKLLALWEAGLPYEIRVPSLETTGPYLCDGYLDSAFTAHPKIDPMTGELIFFGYALDVAPYLKYGIISARGELLQITPINIPVPSGPHDFAITKNYTILMDLPLRFRPEREKQGLPAWMFETGVPSRFGILPRCGNNEDIHWFEAQPCYMNHILNAYEFEDEIILYGCRMSSTYWYPGTARDPNENIPRMYGWAFNLKTGAVREGMLDKRPSEFPCINHRFVGRQMRYGYTSRMASLRPLFDGIIKYDFSTGRSLSHDFGEGRYGGATTFAPRIGSIDEDDGWLLTFVYDEKEKHSELLVIDAQDIMGEPVARVMLPQRVPYGFHGTWVSEMQLIASN

SEQ ID NO: 20164 - protein, 205 aa, Buchnera floridana
GVQFGHVPRKWNPKMAPYISAKHKGIHITNLTRTARFLSEACDLVFYAASRGKQFLIVGTQKKKAADLVAWAAIKARCHFVNKKWLGGMLTNWSITETKLHKFRDLRIEQRAGRLNRLPKRDAAVVKRQLSRLQRYLGGIKYMTGLPDIVIILDQHEEYKALRECITLGIPTICLIDTNCDPDLADFSIPANDDGRSSIRLILNK

SEQ ID NO: 20165 - protein, 473 aa, Bordetella parapertussis
MTLFPIFADLTGRRVLVVGGGAVAVRKTQALLQAGAEVVVGAPRLDPALAALAEQGGIARLDGGFEPAWLAGAWLVVAATDDRAVNAAVSEAARARRVFCNVVDDAELSSFQVPSVVDRSPLIVAISSSGVAPVLARRLRERIESLFDHSLGQLAALAARYRPRIRAARPDLGQRRRFYDWLLDGPVAARLRQQQPGLAEQELEQALRAPQAAPRGSVVLVGAGPGDPGLLTLKALRALNEADIILYDRLVSEGVLALARRDAERVPVGKLPGEDHDATQARIHALMLAQARAGRRVVRLKGGDAFIFGRGGEELEYLRAHDVPYEVVPGITAALACAAYAGIPLTHRDHAQSVRMVTAHCRADQDTLDWAGLARDQQTLAFYMGVGQLDYVTARLLEHGRAPATPFALIENGSRPEQRVVTGTLAELPEIARRRSVRPPALLVIGEVAALADTLQWFGQHQHGLPGPQALAA

SEQ ID NO: 20166 - protein, 385 aa, Trichodesmium erythraeum
MYKQKIPILNSVIVGLILATIPSIAYGAPCEQIRKTNETSITFPSCGDKLWARVDQTAGSELDELLRQGRELADEKKYQEAIRIYQQAVRLDPKNATIYSGIAYLEAVQENFQAAALFYQQAIAIDPHNAKFQYGLGYAMAKLENYQAAVEAYRRASLLDRNNVNTHLGLGAALFRLEKYGEARVAYEVAIKSNPKNPEAYAAMGLVLLKERLFPEALVHLREAEKLSPRNAEIQIKLATALLAAADTKGALVALELASRLEPRNADIQFQVGEIYQAQNNTEGALRAYKRAFYVDRSLLKAKFAAAGILLEQQNYLEAIIIYRRVIQADPENADAHYKMGLALQGRERKGEALRAFETALKLFEEQDNFEGKEMVESMMVELED

SEQ ID NO: 20167 - protein, 541 aa, Caulobacter crescentus
MHFTLRVASARAQMPPAKRDEKFCEPAGSTGGRSGGGSMARQRLSFLQIWNMCFGFFGIQIGFGLQNANTSRIFQSLGVDVNHLAILWIAAPATGLLVQPIIGHFSDKTWGRFGRRRPYFFWGAILTTLALLVMPNSPTLWVAAAALWIMDASINITMEPFRAFVGDNLPDEQRATGYAMQSFFIGLGAVFASALPWMLTNWFDVANTAPAGQVPDSVRIAFYTGGAGLLLAVLWTVFTTREYSPEQLTAFEKAEREIAGLGLHEEPEPSVNAYIALGVGGVLLGAALALIVWGAGLEKELYVLAGLLFAFGLAGVAGARFKRIGRTDNGFSEVLADVFRMPKTMRQLAVVQFFSWFGLFAMWIYTTPAVATVHFGAVDASSKAYNEGADWVGVLFAVYNGVAALAALVIPLMVKVTSRRVSHAVCLGLGALGLLSFLVIRDPGLLWIGMVGVGFAWSSILSTPYSILAGALPARKMGVYMGIFNVFIVVPQLLAATLLGLMLKTFFGNQSIFALVLGALSFALAAAATFLVRDRVAGAPA

SEQ ID NO: 20168 - protein, 219 aa, Magnaporthe grisea
MARRPARCYRYCKNKPYPKSRFNRGVPDPKIRIFDLGRKRATVDDFPLCIHLVSNEYEQLSSEALEAARICANKYLVKNAGKEGFHLRVRAHPYHVVRINKMLSCAGADRLQTGMRGAWGKPNGTVARVNIGQIILSVRTRDSNRALALEALRRSQYKFPGRQKIIISKNWGFTPLRREEYLEKKAAGRVKVDGAYVQFLANHGSLENNMKRFPEAFAA

SEQ ID NO: 20169 - protein, 204 aa, Viburnum suspensum
CDKPVKGRKINWMKAGILESDQILTVSPYYAEELVSGANKGVELDNILRKTGILGIVNGMDVQEWNPLTDKYTGIKYDVTTVMNAKPLIKEALQAEVGLPVDKDIPVIGFIGRLEEQKGSDILVEAISQFIGENVQIIILGTGKKAMEKQLEQLEIEYPDKARGVAKFNVPLAHMIIAGADFILVPSRFEPCGLIQLHAMRYGT

SEQ ID NO: 20170 - protein, 139 aa, Cicer arietinum
MAPAKAEKKPAEKKPAAEKAPAEKKPKAEKKISKEGTSDKKKKRVKKSVETYKIYIFKVLKQVHPDIGISSKAMGIMNSFINDIFEKLAQEASRLARYNKKPTITSREIQTAVRLVLPGELAKHAVSEGTKAVTKFTSS

SEQ ID NO: 20171 - protein, 289 aa, Mycobacterium avium
MTGWTAADLPSFAQRTVVITGANSGLGAVTARELARRGATVIMAVRDTRKGEAAARTMAGQVEVRELDLQDLSSVRRFADGVSGADVLINNAGIMAVPYALTVDGFESQIGTNHLGHFALTNLLLPRLTDRVVTVSSMAHWPGRINLEDLNWRSRRYSPWLAYSQSKLANLLFTSELQRRLTAAGSPLRALAAHPGYSHTNLQGASGRKLGDALMSAATRVVATDADFGARQTLYAASQDLPGDSFVGPRFGYLGRTQPVGRSRRAKDAGMAAALWALSEQLTKTEFPL

SEQ ID NO: 20172 - protein, 1023 aa, Hordeum vulgare
METRPWLLRLIAILTTTTALLLHPSTSSSVSTAHDLPALLSFKSLITKDPLGALSSWTTNGSTHGFCSWTGVECSSAHPGHVKALRLQGLGLSGTISPFLGNLSRLRALDLSGNKLQGQIPSSIGNCFALRTLNLSVNSLSGAIPPAMGNLSKLLVLSVSKNDISGTIPTSFAGLATVAVFSVARNHVHGQVPPWLGNLTALEDLNMADNIMSGHVPPALSKLINLRSLTVAINNLQGLIPPVLFNMSSLECLNFGSNQLSGSLPQDIGSMLPNLKKFSVFYNRFEGQIPASLSNISSLEHLSLHGNRFRGRIPSNIGQSGRLTVFEVGNNELQATESRDWDFLTSLANCSSLLLVNLQLNNLSGILPNSIGNLSQKLEGLRVGGNQIAGLIPTGIGRYLKLAILEFADNRFTGTIPSDIGKLSNLKELSLFQNRYYGEIPSSIGNLSQLNLLALSTNNLEGSIPATFGNLTELISLDLASNLLSGKIPEEVMRISSLALFLNLSNNLLDGPISPHIGQLANLAIIDFSSNKLSGPIPNALGSCIALQFLHLQGNLLQGQIPKELMALRGLEELDLSNNNLSGPVPEFLESFQLLKNLNLSFNHLSGPVPDKGIFSNASVISLTSNGMLCGGPVFFHFPTCPYPSPDKLASHKLLQILVFTAVGAFILLGVCIAARCYVNKSRGDAHQDQENIPEMFQRISYTELHSATDSFSEENLVGRGSFGSVYKGTSGSGANLITAAVKVLDVQRQGATRSFISECNALKMIRHRKLVKVITVCDSLDHSGNQFKALVLEFIPNGSLDKWLHPSTEDEFGTPNLMQRLNIALDVAEALEYLHDHIDPPIVHCDVKPSNILLDDDMVAHLGDFGLAKIIRAEKSKQSLADQSCSVGIKGTIGYVAPEYGTGTEISVEGDVYSYGVLLLEMLTGRRPTDPFFSDTTNLPKYVEMACPGNLLETMDVNIRCNQEPQAVLELFAAPVSRLGLACCRGSARQRIKMGDVVKELGAIKQIIMASQNYASWSTKLY

SEQ ID NO: 20173 - protein, 204 aa, Viburnum opulus
YDKPVKGRKINWMKAGILESDQILTVSPYYAEELVSGEDKGVELDNILRKTGILGIVNGMDVQEWNPLTDKYTGIKYDATTVMNAKPLIKEALQAEVGLPVNKDIPVIGFIGRLEEQKGSDILVEALSQFISKNVQIIVLGTGKKAMEKQLEQLEIEYPDKARGVAKFNVPLAHMIISGADFILVPSRFEPCGLIQLHAMRYGT

SEQ ID NO: 20174 - protein, 265 aa, Nicotiana sylvestris
MAAATMALSSPSFAGQAVKLSPSASEITGNGRVSMRKTAAKPVSSSSPWYGPDRVKYLGPFSGESPSYLTSEFPGDYGWDTAGLSADPETFAKNRELEVIHCRWAMLGALGCVFPELLARNGVKFGEAVWFKAGSQIFSEGGLDYLGNPSLVHAQSILAIWACQVILMGAVEGYRVAGGPLGEVVDPLYPGGSFDPLGLAEDPEAFAELKVKEIKNGRLAMFSMFGFFVQAIVTGKGPLENLADHLADPVNNNAWAYATNFVPGK

SEQ ID NO: 20175 - protein, 257 aa, Acidobacteria bacterium
MADLFNLSGKVAVVVGGTTGIGRAISFGLADAGADVVSTARREEQVNAAADEIERRGRQTLRVCSDVTSRASIQSLCNAVLAKFQKVDILVNCAGTTKRTPTLTVSEDEWNKILDTNLTGALRACQVFGKHMIERGYGRIINIASLSSFVALHEVAAYSASKAALLSLTRSLAVEWSKKGVTVNAIAPGVFRTALNTELLDNTPRGQEFLMRTPMQRFGNTEELVGAAVYLASDAASFVTGQAITVDGGFLASGVNQ

SEQ ID NO: 20176 - protein, 499 aa, Hordeum vulgare
MIGTRVLAHSRVDPAIRWGVAARGRVVFAAIRWGAAARGRVVFAAVRWGAAARGTKREAGQETSTSETKKTKRKWGRGFCGMASHEVEEPLTSETKKTKRKWGRGFCGMASHEAEEPLTSETKKKRKNVAASSEPDKKRWFKNKIWKKKKAKNEQLATLVKEISLATKLNSAMHVNINLSMNICPTQTYEEHSGTYLRNLAVIAVKQLDKDGLQGNREFLVEVLMLSLLHHPNLVTLLGYCTECDQKILVYEYMPLGSLQDHLLDLTPKSQPLSWHTRMKIAVDAARGLEYLHEVANPPVVYRDLKASNILLDGNFSAKLADFGLAKLGPVGDKTHVTTRVMGTYGYCAPEYAMSGKLTKMSDIYCFGVVLLELITGRRAIDTTKPTREQILVHWAAPLFKDKKKFTKMADPLLDSKYPLKGLYQALAISSMCLQEEAISRPLISDVVTALTFLADPNYDPPDDIEPLPISVPNYDKGISLREAEISLSGFEEKQVEDS

SEQ ID NO: 20177 - protein, 265 aa, Nicotiana sylvestris
MAAATMALSSPSFAGQAVKLSPSASEITGNGRVSMRKTVAKPVASSSPWYGPDRVKYLGPFSGESPSYLTGEFPGDYGWDTAGLSADPETFAKNRELEVIHCRWAMLGALGCVFPELLARNGVKFGEAVWFKAGSQIFSEGGLDYLGNPSLIHAQSILAIWACQVILMGAVEGYRVAGGPLGEVVDPLYPGGSFDPLGLAEDPEAFAELKVKEIKNGRLAMFSMFGFFVQAIVTGKGPLENLADHLADPVNNNAWSYATNFVPGK

SEQ ID NO: 20178 - protein, 453 aa, Pseudomonas putida
MQDQSTPERLQRGLKNRHIQLIALGGAIGTGLFLGIAQTIQLAGPSVLLGYAIAGLMAFLIMRQLGEMVVEEPVAGSFSHFAHQYWSEFAGFVSGWNYWVVYVLVGMAELTAVGIYVQYWWPDFPTWATAAIFFVVINLINLTQVKVYGEMEFWFALVKVVAIVSMIGFGAWLLGSGHGGPDASVANLWQYGGFFPNGVTGLVMALAVIMFSFGGLELVGITAAEADNPRESIPKATNQVVYRILIFYIGALAVLLSLYPWQKVVQGGSPFVMIFHELDSDLVATILNIVVLTAALSVYNSCVYANSRMLFGLASQGDAPRQLLKVSRSGVPLTALAVSAFATGLCVLINYLMPGGAFGLLMALAVSALVINWASISITHLKFRKAKLAAGITPFYKSLGHPLTNYLCLAFIVLILVVMYLTPPIRISVMLIPAWIAVLWVAFKLKKARQAKG

SEQ ID NO: 20179 - protein, 265 aa, Nicotiana sylvestris
MAASTMALSSPSFAGQAVKLSPSAPEITGNGRVSMRKTVAKPVASSSPWYGPDRVKYLGPFSGESPSYLTGEFPGDYGWDTAGLSADPETFAKNRELEVIHCRWAMLGALGCVFPELLARNGVKFGEAVWFKAGSQIFSDGGLDYLGNPSLIHAQSILAIWACQVILMGAVEGYRVAGGPLGEVVDPLYPGGSFDPLGLADDPEAFAELKVKEIKNGRLAMFSMFGFFVQAIVTGKGPLENLADHLADPVNNNAWSYATNFVPGK

SEQ ID NO: 20180 - protein, 498 aa, Schizosaccharomyces pombe
MEIEKYTPEQIEELGKGARDFAFAHGVVFTELSVSKEGRNIATQIPITLFPSVIPHGAFVEAVSVQKAYNKLYAKIANDYEFLRLHLQSITKYDEFMNKLWNLYQKHREAVAHLKENQFQPLSLGVFRSDYTVHQDDSFIGCKQVEFNTISVSFGGVSKAVSNLHAYCSQSGLYRKPLTTNYLTVNTSVSGICTGISNAVDAYRDYVKNITSKMNIASDNTKPIVLFVVKGGERNITDQRTLEYELLNRFHVISKRIDIAELNSLIHDKSSNKLYMKTSFTTYEVAVVYYRVGYALDDYPSQEAWDMRLTIENTLAIKCPSISTHLAGSKKIQQVLAESNALERFLEGDELQAVRSTFADMYPLDDTPRGKEGIKLAFEKPEDFVLKPQREGGGNNTYGKDIPGLLSKMPQEEWDSYILMRYINAVPSQNYILKGERPEKFDVVDEIGILGTIVWNIKTDEVVQNGQSGFICRTKPKKTNEGGVATGYASLSSIELSE

SEQ ID NO: 20181 - protein, 115 aa, Methanothermobacter thermautotrophicus
MIFMKEIVAIIRPEKLEEVKNALEAAGCHGMTVTEVRGRGRQLGITESYRGRDYRIDLLPKTKIEIVVNDEDVDTVVETIVKSAQTGDIGDGKIFISGVDEVVRIRTGESGKKAV

SEQ ID NO: 20182 - protein, 265 aa, Nicotiana sylvestris
MAASTMALSSPSFAGQAVKLSPSASEITGNGRVSMRKTVAKPVASSSPWYGPDRVKYLGPFSGEAPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVILMGAVEGYRVAGGPLGEVVDPLYPGGSFDPLGLAEDPEAFAELKVKEIKNGRLAMFSMFGFFVQAIVTGKGPLENLADHLADPVNNNAWAYATNFVPGK

SEQ ID NO: 20183 - protein, 204 aa, Viburnum dentatum
YDKPVKGRKINWMKAGILESDQILTVSPYYAKELVSGEDKGVELDNILRKTGILGIVNGMDVQEWNPLTDKYTGIKYDATTVMNAKPLIKEALQAEVGLEVDKDIPVMGFIGRLEEQKGSDILVEAISQFIGENVQIIILGTGKKVMEKQLEQLEIEYPDKARGVAKFNVPLAHMIIAGADFILVPSRFEPCGLIQLHAMRYGT

SEQ ID NO: 20184 - protein, 367 aa, Kluyveromyces lactis
MVEETNAFEGPEKLLEIWFYPKKTEVPHAERSLRSIDHSKWKELLELVKCEILSTFSTDDMDCFLLSESSMFVFDHKLMLKTCGTTTTLLCLPKLFELINMELEWNFQFRDDLTGEIKNHPYKVFYSRRAFMFPENQRSIHRSWNDEVNYLNQFFITGKSYVVGRIDQNDHWNLYVTKTNDALCSGPDNAQEDDFTLEILMTDLSRSHAQRFVTDEPDHMDGHIIGTKMTNKTAINKIYDFDANKISFKQDSYGFQPCGYSCNMVLNQSYYYTIHVTPEQDWSYASFESNVLLNKIDTTSTQLDVINNVLNIFQPLDFCLTMFIKTESAECVDAKFPYNKVANYEKQDRIVHDLDDYQLIYIRYSKI

SEQ ID NO: 20185 - protein, 393 aa, Erwinia carotovora
MITMIRRFIRLDAAAGMMLMMATVLAIALANWSVTAAGYQQFLMIPVEMRFGALEINKNLLLWINDALMAIFFLLIGLEVKRELVEGTLASRQQAMLPLAAAVGGMVFPALLFLLFNANDDVTRAGWAIPAATDIAFAIGVLTLLGKRVPAGLKVFLLALAIIDDLGAILIIALFYTQQVFWPALAGAVLAIAVLAYMNKLQVGKTSAYLLVGGVLWVCILKCGVHATLAGVIVGFFIPLRTSDGEPSPATSLEHGLQTWVAFLIVPLFAFANAGIVLQGIVLEKLFSPLSLGIAAGLLLGKPLGITLFSWLTIRLGYARLPVGVHFNQIVAVSVLCGIGFTMSIFITLLAFSGGDAELITYAKLGILLASGLAALLGYLALRGVLPALDKAV

SEQ ID NO: 20186 - protein, 267 aa, Nicotiana sylvestris
MAASTMALSSSSFAGKAVKLSPSSSEITGNGKVTMRKTASKAKPVSSGSPWYGPDRVKYLGPFSGESPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGGPLGEVVDPLYPGGSFDPLGLAEDPEAFAELKVKEIKNGRLAMFSMFGFFVQAIVTGKGPLENLADHLADPVNNNAWAYATNFVPGK

SEQ ID NO: 20187 - protein, 379 aa, Erwinia carotovora
MAKQDYYESLGVAKSADDREIKKAYKRLAMKYHPDRNPGDSEAEAKFKEIKEAYEILIDSQKRAAYDQYGHAAFEQGGMGGGGGGGFGGGGADFGDIFGDVFGDIFGGGRRQRASRGSDLRYNMELSLEEAVRGVTKEIRIPALEECDVCHGNGAKPGSSPITCPTCHGNGQVQMRQGFFTVQQACPHCHGRGKIIKDPCIKCHGHGRVEKSKTLSVKIPAGVDTGDRIRLSGEGEAGDHGAPSGDLYVQVQVKAHPIFQREENNLYCEVPINFAMAALGGEIEVPTLDGRVKLKVPAETQTGKLFRMRGKGVKSVRGGAQGDLLCRVVVETPVNLNERQRQLLQELDESFGGPSGERNSPRSKNFFDGVKKFFDDLTR

SEQ ID NO: 20188 - protein, 266 aa, Nicotiana sylvestris
MASSTMALSSSFAGKAVKLSPSSSEITGNGKVTMRKTASKAKPVSSGSLWYGPDRVKYLGPFSGESPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVILMGAVEGYRVAGGPLGEVVDPLYPGGSFDPLGLAEDPEAFAELKVKEIKNGRLAMFSMFGFFVQAIVTGKGPLENLADHLADPVNNNAWAYATNFVPGK

SEQ ID NO: 20189 - protein, 196 aa, Triticum aestivum
  misc_feature (148)..(148): Xaa can be any naturally occurring amino acid
  misc_feature (182)..(182): Xaa can be any naturally occurring amino acid
  misc_feature (185)..(185): Xaa can be any naturally occurring amino acid
MSVPEAGQSAGRDEQEMDDYEQHQTRVLMALMQGLCAARYRKADNTPCLVDQGLYLGSVGAALNNEALKSLNITHILVVARSLNPAFPAEFTYKKIEVLDSPDTDLGKHFGECFTFIDEGICTGGNVLVHCFAGRSRSVTVVLAYLMXKHQMSLQSAMSLVRSKRPQIAPNAGFISQLVNFXKSXQVEQGQRTLQN

SEQ ID NO: 20190 - protein, 420 aa, Glomerella cingulata
MASLGADKKHKVTVVGSGNWGSTICKIVAENTKANPDLFEEAVHMWVFEEDVVIDKSSPYYDPAVGDAPQKLTGVINKYHENTKYLPGIKLPDNIIANPSLQDAVKDSTILVFNLPHQFIGNVCKQLRGHIMPFARGISCIKGVNVSDDGISLFSEWIGDGLGIYCGALSGANIASEIAAEKWSETTIAYDPPPMDNSRAPTPRSNSPANGNGIAPLTPVEMQHKDARGRTSKTKLTPVPAEYPPLDHQIFKQLFHRPYFHVRMVSDVAGVSLGGALKNIVALAAGFVDGRGWGDNAKAAIMRVGLLEMVNFGKEFFGQTVHTGTFTEESAGVADLITSCSGGRNFRCAKMAVAEGLSVEEIEKRELNGQLLQGTSTAKEVNSFLKARGLEKDYPLFTAVHGILEGRHSVDDIPSLVSDS

SEQ ID NO: 20191 - protein, 635 aa, Cochliobolus heterostrophus
MLENPSDESVVRWGNDGDSFVVLENEKFTKHILPKHFKHSNFASFVRQLNKYDFHKVRHNNEENGQSPYGPGVRFAHALCGYCPLGAWEFKHPDFKMNNKDALDNIRRKAPAPRKPNQAAAEDFAPSQQMDMVSGQLMATQAQLHQLEGRYNELNIHHSMLLQEVIGLQKTVVNHEHVMQQIMTFLHGVDATQRRNSKLVFNGGEAQNGNMDPPSNNDDDNPASPLQHASKLLSETNADAMLNPRNLEHMNEITMRMNGTLTTPPPDFARAQMRPTSRGPPSATSTNSMRLDNLDNLVYPVGSSNGIDPMYSEHINNIPYAAPPKAVDQNEPKVPEGKKKSAFPDPGWIRPPQILLVEDDPTCRRIGSKFLYAFHCSIDSALDGLEAVNKMNAGSKYDLVLMDIIMPNLDGVSACHLIRQFDTTPIVAMTSNIRSDDISMYFQHGMNDVLPKPFTKEGLLHMLEKHLVHLKKPSAQGDGSMVAPQPVPIARQLVLKEEESPGKSPQAVSNWNSPNQIPGVSPVGTSVPEDFAQAMRGQPVQHPNSYGVNPMQGNMGYNASSHMQIQSQQQQQQQQQQQQQQQQQQQQQQQAQLQGHRRQVSEISGGDDMNNPAKRQQMYPPQMQQQMGGMQPRPH

SEQ ID NO: 20192 - protein, 183 aa, Fusobacterium nucleatum
MKIYDFSVKNRKDEDISLKSYKGKVLLIVNTATRCGFTPQYDELENLYEKYNKEGFEVLDFPCNQFGNQAPESDEEIHTFCQLNYKVKFDQFAKVEVNGENALPLFQYLKEQKGFSGFDPKHKLTSVLTEMLSKNDPDFAKKSDIKWNFTKFLVDKSGNVVARFEPTTSVKVIEQEIKKLLEK

SEQ ID NO: 20193 - protein, 204 aa, Boschniakia hookeri
GVHFGHGTRKWNPKMAPYISAKRKGIHITNLTRTARFLSEACDLVFDAASRGKQFLIVGTKNKAADSVAWAAIKARCHCVNKKWLGGMLTNWSTTETRLHKLRDLRMEQKTGRLNRLPKRDAAMVKRQLSRLQTYLGGIKYMTGLPDIVIIVDQHEEYTALRECITLGIPTICLIDTNCDPDLADISIPANDDAISSIRLILNK

SEQ ID NO: 20194 - protein, 353 aa, Aspergillus oryzae
MVHSKVVIIGSGPAAHTAAIYLSRAELKPVLYEGMLANGTAAGGQLTTTTDIENFPGFPDGIGGTELMENMRKQSVRFGTEVITETISRVDFSQRPFKLWTEWNDGPDNEPARTADAIIIATGANARRLDLPGETKYWQNGISACAVCDGAVPIFRNKPLYVIGGGDSAAEEAMFLAKYGSSVTVLVRRDKLRASKAMANRLLSHPKVTVRFNTVATQVLGDEKPMGLMTHLRVKNTVTGEEETVDANGLFYAVGHDPATALVKGKIDLDDEGYIITKPGTSYTSLEGVFACGDVQDKRYRQAITSAGSGCIAALEAEKFIAESESSGEEAPVNEVKQDPQGNTAEYKSNPLL

SEQ ID NO: 20195 - protein, 222 aa, Pseudomonas wisconsinensis
MSIRRLACSLLLSSLALPVLAAECPAMLQGELPKLRAKGENIELCQYAGKPLVVVNTASFCGFTPQFKGLEALYQRYKDQELEVLGVPSDDFRQESADSKETATVCYVNYGVTFAMTEPQPVSGANAIPLFKGLAEQSRQPRWNFFKYVVDRQGKVVASFSSLTKPDDPELIAARREGDRLATLIPSRFTALHPSGRWALSVCLPRLARRRTQFTRRALQEQ

SEQ ID NO: 20196 - protein, 204 aa, Boschniakia strobilacea
GVPFGHVTRKWNTKMAPYISAKRKGIHITNLTRTARFLSEACGLVFDAASRGKQFLIVGTKNKAADSVAWAAIKARCHCVNKKWLGGMLTNWSTTETRLHKLRELRMEQKTGRLNRLPKRDAAMVKRQLSRLQTYLGGIKYMTGLPDIVIIVDQHEEYTALRECITLGIPTICLIDTNCDPDLADISIPANDDAISSIRLILNK

SEQ ID NO: 20197 - protein, 497 aa, Prochlorococcus marinus
MAVSYLKRETSPKQTIFNKEDWSSAYCNVEKELDNVQLKLVKGSIPEQISGTFYRNGPGRLERGGRWVHHPFDGDGMIAAFKFDNGKINLTNRFVRTKEWTEEEKSQKFLYRGVFGTQKEGGVLANAFDVRLKNIANTHVIKLGDDLLALWEASSPYSLNPNTLETKGLSNLKGVLKKGEAFSAHPRFDPGHHQSQRMVTFGVSTGPKSTIRLMEFSTEGENIGSLLSDRKDSFNGFAFLHDFAITPNWAIFLQNAISFNPLPFLLGQKGAAQCLASKSDGTPKFLLIPRDSGKFAGQPPKSVNAPKGFVFHHLNAWEDNEKINIESIFYDDFPSIGPEDNFREIDFDLLPEGILKRSEINPIENTFTCSTISNQCCEFAMVNPHFEGLKARFSWMATAEEKEGNGPLQAIKKIDLSNNKEISWSAAPRGFVSEPIFIPSQESKSEEDNGWVVALVWNSIRSGTDLIILDSKDLTEKAILEVPISIPHGLHGSWVEN

SEQ ID NO: 20198 - protein, 200 aa, Conopholis americana
GVPFGHGTRKWNPKMAPYILAKRKGIHFSNLTRTARFLSEACDLVFDAASMGKQFLIVDTKKKAADSVEWAAIKARCHCVNKKWLCGMLTNWSTTETLLNKFRDLRMEQKTGRLNRLKKKDGAVVKRQLARLQAYLYGIKYMTRLPDIVIIVDQHEDYKALRECITLGIPTICLIDTNCDPDLADISIPANDDAISSIRL

SEQ ID NO: 20199 - protein, 203 aa, Prochlorococcus marinus
MEKTREGEIRRETKETDVFVKIDLDGSGKCSANTGIGFLDHMIQQLSSHGLFDIEVRANGDTHIDDHHTNEDVGIAIGQALSKALGDRVGIKRFGHFLAPLDEALIQVVVDCSGRPHLSFSLDIPSQKVGTYDTELVKEFFGAVVSNGGLTLHIRQLAGNNTHHIIEATFKSFARALRMATEIDPRRSSQIPSSKGVLEQAGQ

SEQ ID NO: 20200 - protein, 301 aa, Cryptococcus neoformans
MAKIQATPFRLALLQLGGLTASKASNISIAAKAVTSAAASSPKPQLIVLPEIWNSPYAVSSFREYSEKVPEVGSKWKSLKEGEEGETIKALREMARSSGCWLIGGSIPERDEKTDNIYNTCTVYDPEGTLVAVHQKVHLFDIDIPGKQTFKESDTLTGGSHLTTFTTPFGKIGLGICYDIRFPEMAMIAARQGCIAMIYPAAFNTTTGPMHWTLLQRARAVDNEIYVAMCSPARHPEAAYQAYGHSSVVNPVGDVVVEADHEPTTIYADIDPELLATTRRSIPVTVQRRFDVYPDVSSSFQ

SEQ ID NO: 20201 - protein, 137 aa, Methylobacillus flagellatus
MLDKIGEPGSSKATLFELLGGAEQVRAIVERFYDIMDTDPRAAGIRAMHAPDLTSAREKLFMFLTGWTGGPQLYMERYGHPRLRMRHMSFPIDDSARDQWMYCMVKAMHDTGVDEAIIEKMGAALYGVADFMRNREG

SEQ ID NO: 20202 - protein, 204 aa, Castilleja linariifolia
  misc_feature (1)..(4): Xaa can be any naturally occurring amino acid
XXXXGHGTRKWNPKMAPYISAKRKGIHITNLTRTARFLSEACDLVFDAASSGKQFLIVGTKNKAADLVAWAAIKARCHCVNKKWLGGILTNWSTTETRLQKFRDLRMEQKTGRLNRLPKRDAAVVKRQLSRLQTYLGGIKYMTGLPDIVIIVDQHEEYTALRECITLGIPTICLIDTNCDPDLADISIPANDDAISSIRLILNK

SEQ ID NO: 20203 - protein, 748 aa, Rickettsia sibirica
MFNEITKSVTWNGQVLELSTGKIARQADGAVTVKMGNSVLLCTAVVANKAKEGIGFLPLTINYREMAYAAGKIPGGFFKHEGKASDREVVVSRLIDRPIRPLFHPAFVNETHVTCSVLSYDPETPVDILAIIGASAALSLSPAPYLEIVAASKVGLINGEFVLNPTLALLKTSQLDLVVAGTSDSVMMVESEAHLLSEEQMLEAVKFGFESFQPVIKIIKELAEEAKKPKLEMQALYPASLKKEIEKLFVKEIEQAFAIKSKQERSTNLDLIHEKVLTHFVSDIENKKYSNYQIESALKAIESDILRNEILEKNRRIDGRSTTDIRQIACEIGLLPSAHGSALFTRGETQSLVSTTFGTSLDEQIVDSLEGEYKERFMLNYIFPPYSVNEAMPMKAPSRREVGHGKLAWRAINPILPNKAQFPYSIRVVAETTESNGSSSMATVCGSSLALMYAGVPIKAPVAGIAMGLVKEGKNFAVLSDILGDEDYFGDMDFKVAGTSEGMTALQMDIKISGVDFKIMKVALEQARLGRLHILEQMNKVISKPNNELSKNAPSTTTIKIDKDKIRDIIGPGGKVIKEICETSGAKIDISDDGTVSVYASDRDKLKVALDKIKAIVVEPEIGEIFNGTVVKVLDSGAFINYVGNKDGFVHISEVSGERIETVSSVLKQGDIVKVKLIGFDNKGKAKLTIKNADKDKSSNNTKPKTNVNNTKDNSEPEQRRDSSKKRAWNEDNNAETAGVITERKYFN

SEQ ID NO: 20204 - protein, 553 aa, Azospirillum brasilense
MAWLGHRRLSINDLSPAGNQPLLHAGGGTGDVLALVCNGEIYNAPTLRTELEALGHAFASRSDNEVILHGYRAWGDAVVDRLTGMFAFVLWDDRRRRLLAARDRVGIKPLYWAEPGDGGIAFASEARPLATLPGIGPAVELRALGHALTLGYVPAPLSAWRGIHKLEPGRLLVWEPGQGAALRRYWEAPRSLAAAGDGDAGWAGLFDRAVADHLLSDVPAGLFLSGGLDSAAVATAAVGAGLRPAAYTLCYPGRPDAEAEVAAAVARHLGLEHRLVPAPTDGLADRLAGVAALFDEPQGYSALVTMAGIARAAAAEHKVVLSGDGGDEVLGGYAWYAGLDPDGPPPGAEAGDAHAAFAARSVLHRHAMRLFPRFLPDEVEALFAPAGLRFGEEEMLAPLEAAFEPGLPLRRALQRVDLATFCADSILAKVDRASMAYGLEVRVPFLDHRLVEWGLSRPPAAEEAVHGKPVLRRYLAGRVPERVFGHPKTGFSLKDTGPFDWNAALDRVAAGPLVRHGLLDPGFRRIVEARSPYRQARIWALLALSLWAGSWME

SEQ ID NO: 20205 - protein, 430 aa, Methylobacillus flagellatus
MLKSRLFISYPRYRTMFSTAKNLSVVDPDLWKYVEAERHRQDEHIELIASENYTSPAVMQAQGSQLTNKYAEGYPGKRFYGGCEFVDGVEQLAIDRLKKLFGAEYANVQPHSGSQANQAVYFSVLKPGDTVMGMNLGHGGHLTHGSPANLSGKLFNIVPYGLNDKEEIDYDEMERIALECKPKLLIGGASAYALRFDWARMADIAKKVGAYFMVDMAHYAGLIAAGVYPNPVPHADFVTSTTHKTLRGPRGGLIMAKAEFEKSLNSSVFPSLQGGPLMHVIAAKAVAFLEAAQPEFKAYQEQVLKNADTMAKTLASRGLRIISGGTQSHVFLVDLRPKGLTGKAADAYLGQAHITVNKNAIPNDPESPFVTSGIRIGSPAITTRGFKEAEAAEVANLIADILDNPTDESVIAATKAKVHALTSRFPVYGA

SEQ ID NO: 20206 - protein, 536 aa, Ipomoea nil
MGVDVGTLLSKMNMLTTSDHGSVVSINIFVALICACIIIGHLLEESRWMNESITALMIGICTGVVILLTSGGTSSHILVFSEDLFFIYLLPPIIFNAGFQVKKKQFFRNISTIMLFGALGTLISFIIISLGAIGIFKKMNIGSLELGDYLAIGAIFSATDSVCTLQVLNQDETPLLYSLVFGEGVVNDATSIVLFNAVQNFDLSNINSLVVLQLFGNFLYLFILSTLLGVVAGLLSAYVIKKLYFGRHSTDREVAIMICMAYLSYMLSELFSLSAILTVFFSGIVMSHYTWHNVTESSRVTTKHAFATLSFIAEIFIFLYVGMDALDIEKWKFVSDSPGTSVEVSSILLGLVLVGRAAFVFPLSFLSNLIKKSRGEKIGFRQQFIIWWAGLMRGAVSMALAYNQFTRSGYTQLRENAIMITSTITVVLFSTVVFGLITKPLIRVLLPTPKHLNRMVSSEPVTPKSFTVPLLDSEADLDGHVPRPNSLRMLLTTPSHTAHYYWRKFDDAFMRPVFGGRGFVPYVPGSPTEQNEPQWQ

SEQ ID NO: 20207 - protein, 493 aa, Prochlorococcus marinus
MTKFQSIFWHRRDLRFGDNIGLFEASKNSKSLIGVYVLDPKLLDLNRTTSEAKNWFLGESLIELQKNWEIRGSRLLILNGDPIELISKLAELVHAECIYWNENIEPYEINRDKQIAEKLSKEKRKVYTFLDQLIVNPSNIKTNNDEPYKVYGPFYRKWIDLINITKSSENNLIQTSETAKQLTGLNERELSSIKNSDLNYCITNKSKSIYELLSLNRFNKTNLCPCKPGESESIKQLNSFIHSGVINSYNKARDIPSLENTSHLSAALSLGTISCRVVWNGAQVSKNATDDEYKINSIDTWIKELAWREFYQNALINFPELEKGPYREKWLDFPWQNRPDWFEAWGDGLTGIPIIDAAMRQLKCSGWMHNRCRMIVASFLVKDLLIDWRLGELFFMKSLVDGDLAANNGGWQWSASSGMDPKPMRIFNPFRQASKFDEDGEYIRKWIPELSHISTPNLLSGEISSAERNSYPKPIISHKNQTSIFKELYSNIK

SEQ ID NO: 20208 - protein, 204 aa, Chelone obliqua
GVHFGHGHRKWNPKMASYISAKRKGIHITNLTRTARFLSEACDLVFDAASRGKQFLIVGTKNKAADSVARAAIKARCHCVNKKWLGGMLTNWSTTETRLHKFRDLRMEQKTGRLNRLPKRDAAMLKRQLSRLQTYLGGIKYMTGLPDIVIIIDQHEEYTALRECITLGIPTICLIDTNCDPDLADISIPANDDAISSIRLILNK

SEQ ID NO: 20209 - protein, 381 aa, Oryza sativa
MQIFVKTLTGKTITLEVEFSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGL

SEQ ID NO: 20210 - protein, 223 aa, Populus euphratica
MLRCVEGFITSLLRCCDLDLYKQSRGLQDPELLARETVFSVSEIEALYELFKKISSAVIDDGLINKEEFQLALFKTNKKESLFADRVFDLFDTKHNGILGFEEFARALSVFHPNAPIDDKIEFSFQLYDLKQQGFIERQEVKQMVVATLAESGMNLSDDVIESIIDKTFEEADTKHDGKIGKEEWRSLVLRHPSLLKNMTLQYLKDITTTFPSFVFHSQVDDT

SEQ ID NO: 20211 - protein, 481 aa, Desulfovibrio vulgaris
MKTVFAKSVPGRSAALPSAPSRKAADMLPAGLLRSKAPRLPEVSELDVVRHFTGLSRLNYSVDGNFYPLGSCTMKYNPKFTEHVAALPGFTRLHPLMAQLKGAGQYTQGALEVMWETERLLCEINGMAAFTLHPMAGAHGELTGVMLIAAYHKDKGNRKTKIICPDSAHGTNPASAALAGYEVVNIESKDGLVDPDALEAVLDDEVAALMMTCPNTLGLFEKHLPRIVEKLRAVDALLYYDGANLNAIMGKMRVGDVGFDVVHLNLHKTFGTPHGGGGPGSGPVGVSARLEPYLPISRVEKERDGHFFLNYDYPKSIGYVAPFYGNFGVLLKAYAYILRLGAEGLTRASEFAVLNANYMRCKLRGVLDIPHDRTCMHEFVASACNTAECGVRALDIAKALLDKGYHAPTIYFPLIVKECLMFEPTETESRETLDAFMDDLASIVEQGRQTPDALHDAPLHTPVRRLDETAAARNMVLTDDL

SEQ ID NO: 20212 - protein, 443 aa, Desulfovibrio vulgaris
MPFVPHSPEDVSVMLDAIGVNTIEDLFADIPAEMRPKSFALPKGLSEMDVCSRLEALSARNRTDVVSFLGAGFYDHHIPKAVDALSSRGEFYTAYTPYQPEAAQGTLQAIFEFQTAVCRLLDMDCANASVYDGGSALFEAMMMAVRATRRRKLVIDEALSPIYRTMLASYTSNLQLELVTVPHRDGLSDMDALKASVDDTCAAVVVQNPNFFGAITDFTDLFTHARAHKALGVISVYPVMQSVLKTPGEMGADIAVADGQSIGQPLSFGGPYLGIMTCTKPLVRQIPGRIVGRTQDVDGRTGYVLTLQAREQHIRRAKATSNICSNQALCALRSLIHLTLLGPEGLVRTAELSMERARYAAERLTALPGVELLHDAPFGNEFAVRLPVSAFEVVDRLTARGYVPGFPVGRYYPGMDNVLLVACTEKHSFEQVGILAEMLGGIL

SEQ ID NO: 20213 - protein, 80 aa, Glycine max
  misc_feature (3)..(3): Xaa can be any naturally occurring amino acid
  misc_feature (10)..(12): Xaa can be any naturally occurring amino acid
  misc_feature (25)..(25): Xaa can be any naturally occurring amino acid
  misc_feature (46)..(47): Xaa can be any naturally occurring amino acid
  misc_feature (51)..(51): Xaa can be any naturally occurring amino acid
  misc_feature (53)..(53): Xaa can be any naturally occurring amino acid
  misc_feature (56)..(56): Xaa can be any naturally occurring amino acid
  misc_feature (64)..(64): Xaa can be any naturally occurring amino acid
  misc_feature (69)..(69): Xaa can be any naturally occurring amino acid
SSXQPNAGAXXXYAGLMVIRAYHLXRGDHHRNVCIIPVSAHGTNPXXAAMXGXKIXSVGTDAKXNINIXNFLNTFLINTV

SEQ ID NO: 20214 - protein, 401 aa, Zea mays
  misc_feature (116)..(116): Xaa can be any naturally occurring amino acid
MAVLSAADASPVSAIGFEGYEKRLEITFSEAPVFVDPHGRGLRALSRAQIDSVLDLARCTIVSELSNKDFDSYVLSESSLFIYPLKIVIKTCGTTKLLLTIPRILELAEELSMPLXAAVKYSRGTFIFPGAQPAPHRSFSEEVAALNRYFGGLKSGGNAYVIGDPARPGQKWHVFYATEYPEQPMINLEMCMTGLDKKKASVFFKTNADGNTTCAKEMTKLSGISEIIPEMEICDFDFEPCGYSMNAIHGSAFSTIHVTPEDGFSYASYEVMGLDATALSYGDLVKRVLRCFGPSEFSVAVTIFGGRGHAGTWGKALGAEVYDCNNMVEQELPGGGLLVYQSFCAAEDAVATSPKSVFHCFDGENVESAPPPMKKDYKLANLLCWEEEADAMEEKAGVLDE

SEQ ID NO: 20215 - protein, 502 aa, Pyrococcus horikoshii
MYRQARWDEPLIFELSRPGRVGYTLPKPIEDVKVEIPEKLKRKTPLELPEVSEPEVVKHYTRLSEMNYGVDSGIYPLGSCTMKYNPKINEEIANHPKVAFIHPYQDERTVQGALKIMWELEQWLKEITGMDRFTLQPAAGANGEFTGVMIIKAYHLDRGDTQRTEILVPDSAHGTNPASASMAGFKVVEIPSNENGTVDLEALENAVSERTAGLMLTNPNTLGIFEDEIEEIAKIVHKVGGLLYYDGANLNGILGKVRPGDMGFDIVHLNLHKTFSTPHGGGGPGAGPVGVKEFLKDYLPVPLVSYDEENDRYYLDYNVPKSIGKVKELFGNFAVLVKALTYLKIMGKEGLREVSEVAVLNANYLARKLKGTRGYELPHKELRKHEVVFSAEPMKKETGVRTLDVAKRLLDFGLHAPTIYFPLIVHEALMIEPTESVSKEELDAYVEALKKISEEAYTNPEIVKSAPHNTAVRRVDDVLAAKKPVITWKMYKELKEKGEIDY

SEQ ID NO: 20216 - protein, 267 aa, Nicotiana sylvestris
MAAATMSLSSPSFAGKAVKLSPSSYEIIGNGKVTMRKTVIKAKPVSSGSPWYGPDRVKYLGPFSGNSPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGGPLGEVVDPLYPGGSFDPLGLADDPEAFAELKVKEIKNGRLAMFSMFGFFVQAIVTGKGPLENLADHLADPVNNNAWAYATNFVPGK

SEQ ID NO: 20217 - protein, 449 aa, Pyrococcus horikoshii
MGNHYIPNSAHKEEMLKEIGLSSIEELFADIPEKFIKEELNLPEGKSEYEVFLEMNEILEKNKTVLEMPTFLGAGTYFHYIPAHVKHLIERSEFLTSYTPYQPEISQGMLQALFEYQSLIAELVGLPVVNSSMYDWGTAMAEAALMTVRLHKGKRKKFVVPKHTHPERLQVLRTYTRGPEVEIVTVNWNERGQVDVEDLKEKVKDAAGVYIEIPNFFGLLEEEIREVGEIAHEAGAYFVVGVDPTILGIVEAPGELGADIVVGEASYFGNPMNFGGPRAGIFAVKNDMKLIRQMPGRIIGMTKDAEGKRAFVMTLQTREQHIRRAKATSNICSNEALVAVAAAIHIASLGPKGIRELGEVILKNTAYLKKRLSEVAEIPFDGVNFKDVLVRFDKPYREIHEELLKRNIHGGYYVGSHFPELGEAALFAATETTRKEWVDALISALKEVI

SEQ ID NO: 20218 - protein, 267 aa, Nicotiana sylvestris
MTASTMALSSPSFAGNAVKLSPSSSEITGNGKAIMRKTVTKAKPVSSGSPWYGPDRVKYLGPFSGEAPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAIEGYRVAGGPLGEVTDPLYPGGSFDPLGLADDPEAFAELKVKEIKNGRLAMFSMFGFFVQAIVTGKGPLENLVDHLADPVNNNAWAYATNFVPGK

SEQ ID NO: 20219 - protein, 485 aa, Pseudomonas putida
MSEEILINITPMESRVAVVENGVLQEVHVERTQRRGIVGNIYKGKVVRVLPGMQAAFVDIGLERAAFIHASEISQREGSAVENITALVHEGQALVVQVTKDPIGTKGARLTTQLSIPSRYLVYMPRSSHVGISLKIEDEAERERLKQVVSDCMDGENIKDAGGFILRTAAEGARAEEILQDIRYLRRLWEQIGTQIKTCGAPTVIYEDLGLALRTLRDLVNPKIEKIRIDSRETFQKTTQFVGELMPEIADRLEHYPGERPIFDLYGVEDEIQRALERKVPLKSGGYLVVDPAEAMTTIDVNTGAFVGHRNLEETIFKTNLEAATAIARQLRLRNIGGIIIIDFIDMEDEDHQRQVLRTLEKQLERDHAKTNIIGITELGLVQMTRKRTRESLEQVLCEPCLACQGRGKLKTPETICYEIFREILREARAYQAEGYRVLANQKVVDRLLDEESGNVAELEAFIGRTIRFQVESMYSQEQYDVVLL

SEQ ID NO: 20220 - protein, 204 aa, Viburnum jucundum
YDKPVKGRKVNWMKAGILESDQILTVSPYYAKELVSGEDKGVELDNILRKTGILGIVNGMDVQEWNPLTDKYTGIKYDATTVMNAKPLIKEALQAEVGLPVDKDIPVIGFIGRLEEHKGSDILVEAISQFIGENVQIIVLGTGKKAMEKQLEQLEIEYPDKARGVAKFNVPLAHMIIVGADFILVPSRFEPCGLIQLHAMRYET

SEQ ID NO: 20221 - protein, 589 aa, Pseudomonas aeruginosa
MCGISGEFRFDNQAADLAAVERITHHLAPRGPDAWGFHAQGPIALGHRRLKIMDLAEASGQPMIDPDLGLAMVFNGAIYNYPELRGELESLGYRFFSGGDTEVLLKGYHAWGADLLPRLNGMFAFAVWERDRQRLFLARDRLGIKPLYYSLDRSRLRFASSLPALLKGGDIASDLDPQALNFYLNFHAVVPAPHTLLEGVKKLPPATWMSVDLDGSCEQRTWWTLDYGPRPDERELTLDDWQERVLDGLREAVAIRQRAAREVGVLLSGGVDSSLLVGLLHEAGVDNLLTFSIGFEDAGGERGDEFQYSDLIAERYHTRHHRLRIGEHEVIEQLPAAFRAMSEPMVSHDCIAFYLLAREVSKHCKVVQSGQGADELFAGYHWYPKVDGADDAFAAYRAAFFDRDHEEYLATVGERFRVEDVAGRFVRDHFASPGAEAAVDKALRLDSTIMLVDDPVKRVDNMTMAWGLEARVPFLDYRLAELSARIPARFKLGDGGKQVLKGAARKVIPSEVIDRPKGYFPVPGLKHLQGRTREWVRELLLDPSQDRGLFQPAIFDRLLSDPDGDLTPLRGSKLWQLAALNLWLSEQGL

SEQ ID NO: 20222 - protein, 267 aa, Nicotiana sylvestris
MAASTMALSSSSFVGKAVKLSPSSSEITGNGKVTMRKTATKAKPVSSGSPWYGPDRVKYLGPFSGESPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGGPLGEVVDPLYPGGSFDPLGLAEDPEAFAELKVKEIKNGRLAMFSMFGFFVQAIVTGKGPLENLADHLADPVNNNAWAYATNFVPGK

SEQ ID NO: 20223 - protein, 204 aa, Viburnum stenocalyx
YDKPVKGRKVNWMKAGILESDQILTVSPYYAKELVSGEDKGVELDNILRKTGILGIVNGMDVQEWNPLTDKYTGIKYDATTVMNAKPLIKVALQAEVGLPVDKDIPVMSFIGRLEEQKGSDILVEAISQFIGENVQIIILGTGKKAMEKQLEQLEIEYPDKARGVTKFNVPLAHMIIAGADFILVPSRFEPCGLIQLHVMRYGT

SEQ ID NO: 20224 - protein, 568 aa, Crocosphaera watsonii
MSSLIKIPKSSSGANEMSSNPMTNPALWQALEAELVYIQDRSGKYLSFYGDLGEELAIEPEDIIGFFPEQSLKPASPDAYDERIKRVLERKIPEQCYCQFEYKGQTFALELVISPILPKQKQATTVLVMGHPLQDNDLSLINNSALPTHPDPYQKLLTKIARKIRRTLNLETIWQQTVDSLGEALQVSRCLMIAIGPEQGYLDVKAEYCLPYCPSELGSRLIPQEEPLWQQALNQREPLIFEQLLENSSQVQSNLIVSTFYQNQRNGLICLQQCDRSRYWSPAEIELIQELADQVGTAIAHATLYQELEQATLAAEEASRLKSDFLASTTHELRTPLNGIIGFLKLILDGMADDAEEQQEFLEEAHKSALHLLNLINDILDIAKIEAGKMDLELGAVELAELFQAVDNFTLPQAQRKHLEFRSKLPSTLTPIVVYGNYQRLLQVMLNLVSNAIKFTHEGSIVVNAEIVKKKIHHQNQEFPGHVKVSVTDTGIGVSLDKQAKLFEKFVQVDGSHTKAYGGTGLGLAISQKLVEAMGGQVEFYSMGEGLGSTVTFTVPLEQMPVIKTAKA

SEQ ID NO: 20225 - protein, 317 aa, Prochlorococcus marinus
METIEADVVIVGGGPAGCSCALYTSRADLKTVILDKNPDVGALAITHQIANYPGVSSEMSGEALLALMREQAVSFGSDYRRAQVFGVDVNGEWKTVYTPEGTFKARALVVATGALGRPASFKGEAEYLGRGVSYCATCDGAFYKGREVAVVGANKEAVEEGQVLTKFASTVHWLTTSDPKEDDVHAQALMTQPNVQHWSRTRLMLIEGDDAGVTGIKLKNRAQETEQDLAVEGVFVYMSGSKPITDFLGDQVAFKEDGGVVVDDFMATTVDGVWAIGDIRNTPFKQAVVAASDGCIAAMAIDRFLNSRKGIRVDWVH

SEQ ID NO: 20226 - protein, 360 aa, Paspalidium geminatum
TTYDLKADEKTKSWKKLVNIAVSGAAGMISNHLLFKLASGEVFGQDQPIALKLLGSERSLQALEGVAMELEDSLYPLLREVSIGIDPYEVFEDVDWALLIGAKPRGPGMERAALLDINGQIFADQGKALNAVASRNVKVIVVGNPCNTNALICLKNAPNIPAKNFHALTRLDENRAKCQLALKAGVFYDKVSNVTIWGNHSTTQVPDFLNAKIDGRPVKEAIKDTKWLEEEFTMTVQKRGGVLIQKWGRSSAASTAVSIVDAIRSLVTPTPEGDWFSSGVYTTGNPYGIAEDIVFSMPCRSKGDGDYELVSDVLMDDFLWERIKKSEAELLAEKKCVAHLTGEGNAFCDLPEDTMLPGEM

SEQ ID NO: 20227 - protein, 1113 aa, Pseudomonas fluorescens
MAKKPKAATFIKDPLWYKDAVIYQVHVKSFFDSNNDGIGDFPGLIAKLDYIADLGVNTIWLLPFYPSPRRDDGYDIAEYRGVHSDYGTMADAKRFIAEAHKRGLRVITELVINHTSDQHPWFQRARKAKPGSAARDFYVWSDDDQKYDGTRIIFLDTEKSNWTWDPVAGQYFWHRFYSHQPDLNFDNPQVMKAVLSVMRYWLDMGIDGLRLDAIPYLIERDGTNNENLPETHDVLKQIRAEIDANYPDRMLLAEANQWPEDTQLYFGDTDAEGVNGDECHMAFHFPLMPRMYMALAQEDRFPITDILRQTPEIPANCQWAIFLRNHDELTLEMVTDKERDYLWNYYAADRRARINLGIRRRLAPLMERDRRRIELLNSLLLSMPGTPTLYYGDEIGMGDNIYLGDRDGVRTPMQWSIDRNGGFSRADPASLVLPPIMDPQYGYQSVNVETQAGDPHSLLNWTRRLLAVRKQSKAFGRGTLKMLSPANRRVLAYTREYTGPDGKHEIILCVANVSRSAQAVELDLSAYVGMVPVEMLGGNAFPPIGQLSFLLTLPPYGFYWFGLAAENQMPSWHVEPAQSLPDFTTLVLKKRMEELLEAPSRATLEQAILPSWLQNRRWFAGKDADIEQVKLAYGVRFGDAQHPVLFSEIEVQSGGQTSRYQLPFGFISEDQVGPALPQQLALARVRRVRQVGLITDAFSLEAFIRAVLQGMQGGTVLESIEGEIRFEATPQLEKLGLGAESEVRYLSAEQSNSSVVIGNSLVLKLIRKVASGVHPELEMSAYLTAAGFANISPLLGSVIRRDGKGEDNLLMIAQGYLSNQGDAWEWTQNNLERALRDELADAVSEQAQHYNALGELKDFAGMLGQRLGEMHQVLAAPSDNQDFAPQVSSAKDAQATGKDVAAQVEHALKLLKQHQGELDAADQKLVGRLLDHKKAILAHVQELAKQSAGGLRIRVHGDLHLGQVLVIKGDAYLIDFEGEPARPLAERRGKHSPYKDVSGVLRSFDYAAAMALNVHNVDNSPEAEAARRRVTERYLREAREAFLQAYRQAAASLDHAWQDPEGADAALALFGLEKAAYEVAYEAENRPTWLPVPLHGLYGLLTGLKPFSDLGGE

SEQ ID NO: 20228 - protein, 204 aa, Viburnum triphyllum
YDKPVKGRKVNWMKTGILESDQILTVSPYYAKELVSGEDKGVELDNILRKTCILGIVNGMDVQEWNPLTDKYTGIKYDATTVMNAKPLIKEALQAEVGLPVDKDIPVIGFIGRLEEQKGSDILVEAISHFTGENVQIIVLGTGKKAMEKQLEQLEIEYPDKARGVAKFNVPLAHMIIVGADFILVPSRFEPCGLIQLHAMRYET

SEQ ID NO: 20229 - protein, 352 aa, Unknown
  Saccharum hybrid cultivar R570
TTYDLKADDKTKSWKKLVSVAVSGAAGMISNHLLFKLASGEVFGQDQPIVLKLLGSERSFQALEGVAMELEDSLYPLLREVSIGIDPYEVFEDVDWALLIGAKPRGPGMERAALLDINGQIFADQGKALNAVASRNVKVLVVGNPCNTNALICLKNAPNVPAKNFHALTRLDENRAKCQLALKAGVFYDKVSNVTIWGNHSTTQVPDFLNAKIDGRPVKEVIKDTKWLEEEFTMTVQKRGGVLIQKWGRSSAASTAVSIADAIKSLVTPTPEGDWFSTGVYTTGNPYGIAEDIVFSMPCRSKGDGDYELATDVSMDDFLWERIKKSEAELLAEKKCVAHLTGEGNAFCDLPE

SEQ ID NO: 20230 - protein, 452 aa, Rubrobacter xylanophilus
MRLVVVGGVAAGTKAAARARRVNPRLEITVYQEEPEPSISECGLPYLLSGTVSGRRRLVARTPEEFARDGIRVLVRHRVEEVRPEEGRLLVRDLAAGSVFEDRYDRLVLATGARAVPLGVPGSGLEGVFNLRFLTDADRILDHIRRHRPRRALVVGGGYVGLEVAENLRLLGMEVVLAQRPRRVATAYDPEISRRIEEHLRERGVELRTGAEVEELRGDGRVREARISGEAVEAGLVVAGVGIEPEVDLARRAGARIGTTGAVWTDRHQRTSLPEVWAAGDCAQTRNRITGGPAWVPLGDTANQTGRVAGTNAALGEDAEEFPGVLGTGIFKVFDLAAGKTGLSEAEAAGAGLEAVAATIESRSRAGYYPGAGRVLLKLVAERGSGRLLGAQALGPGADKLTDVCATALWGGLSCSDLINVDLAYAPPYGPVLSPVIQAATVLQRRLSQPPK

SEQ ID NO: 20231 - protein, 585 aa, Coccidioides immitis
MGLEEHAVRPSNDDSRIDSSAEDLSASHDEDVEKGNGSLVRALRERHLQMIGIGGSIGAGLFIGSGQALSNGGPASTFLGFAITGAMVLCNLQALAELAVIYPVNGAFYTYAFRFIDPAWGFAMGWQYAVSWLIMLPIELTSAGLMITFWTSDINVGVWSAIFLVMVTVVQFFGIKGYGETEYILALVKVITCVGLIIVGLIINVGGVPTDNRGYIGGRYWHDPGAFRDGAKGFISVLVTAAFAYTGTEMIGLAAAETVNPRKSIPKATKQMLWCIVFFYVINILFVSLNIPSDSPALLGAKGGNIKASPFVIAAELAGIKVLPSIINAVIMLSIIGAANLCSYGSTRTLQALAATGNAPKFFAYIDSKGRPVWCILLQIAFGMLTFISEAASSEVVFTWMMALSGLSGLFLTTSICFTHIRFRRAWKLQGKNEEDIPYRSPFGVVGSIIGMGLSTIAIVATLYLGIFPIHATSRVEFFFQTCMAAPLALVAMLGWKIYKRNWKFGVDLRRVDLDEGRRMDYYSSGEDDHELREKGSSLTKKVAPWIHKEPYPGKMSAKPWAFLMDDSLKEHVRRGSTTPNSLTA

SEQ ID NO: 20232 - protein, 426 aa, Ralstonia eutropha
MTELDLNQYMDRVGRQARAASRAMARASTADKNRALLTIAAAIRRDADKLKAVNARDVERARANGQDAAFVDRLTLSDKAIKTMAEGLEQIAALADPIGEISNMKFRPTGIQVGQMRVPLGVIGIIYESRPNVTIDAAALCLKSGNATILRGGSEAIESNTALAALVAEGLASAGLPPEAVQVVETTDRAAVGRLITMTEYVDVIVPRGGKSLIARLMEEARVPMIKHLDGICHVFIDADADLDKAVRVCDNAKTQRYAPCNTMETLLVSQDIAARALPPLCRIYQEKGVELRVCPATRAMLEAAGFSGLVDAHEEDWRLEYLAPILAIKTVAGLDEAIAHINEYGSHHTDSIITENYSTGMRFIREVDSASVMINASTRFADGFEYGLGAEIGISNDKLHARGPVGLEGLTSLKYVVFGHGEIRT

SEQ ID NO: 20233 - protein, 980 aa, Salinibacter ruber
MPSHPTSCLQMAIDLSSANTFDERHLGPTDADVDAMLDALGAESLDALVDAAIPDSIRTDAPLDLPSALTEQQVLDAAQDAGAKNDTWRSFIGMGYRHTHTPPVIQRNILENPAWYTQYTPYQAEIAQGRLEALLNFQDMTIDLTGLEIANASLLDEATAAAEAMMMLNRVDRRSDAATFYVSEDCHPQTIEVVKGRAEPIGIDVIVESPENFVFGEDTFGCLLQYPTTDGAVHDYRDVADRAHEADAYVAVAADLLSLTLLEAPGEWGADAVVGSTQRFGVPMGYGGPHAAYFATRERFQRQVPGRMIGVTKDADGEMALRMALQTREQHIRRGRATSNICTSQVLLAVMASMYAVYHGPEGLREIATRVHDLTKTLAEGLNRTGHTVRHDAYFDTLRVDLTDATQAQVRERAEAHEINLRYYDDGSVGVALDQTVDAEDLDALFTVFGATNGQKLYADDLAADLDSGYDGPMPRQTSYLEHPVFNSYHSEGELTRYMKSLADKDLSLVHSMIPLGSCTMKLNPTAALQPISNPQFAGLHPFAPQEQAAGYEQVIDELSGYLTEITGFDDISFQPNSGASGEYTGLLIIQAYHEARGEEQRDVCLVPESAHGTNPASANMAGMEVITIDCDENGDVDLEDLREQAEVNSERLAAAMITYPSTHGVFEEHVEEICDVIHEHGGQVYLDGANVNAQVGLCRPREYGVDVCHLNLHKTFSIPHGGGGPGVGPVCTAEHLSPFLPGHPVVETGGDQHIPAIAAAPHGSALILLISWAYIKLLGPEGLTKSSKTALLNANYLADQLSNHYDIVFRGPNDRVAHEFILDLRPFRSELDINEQDVAKRLMDYGFHAPTMSWPVVGTLMVEPTESESKAELDRLVDAFAAIRSEIEAVETGTLEAEASTLKQAPHTAEMVTADEWDRAYSRETAAYPVEAVRERKFWPTVRRVNDAYGDRNLYCACPPTDAYEADEEEELTSALKTA

SEQ ID NO: 20234 - protein, 308 aa, Geobacillus kaustophilus
MARTVNSITELIGDTPAVKLNRIVDEDSADVYLKLEFMNPGSSVKDRIALAMIEAAEKAGKLKPGDTIVEPTSGNTGIGLAMVAAAKGYKAVLVMPDTMSLERRNLLRAYGAELVLTPGAQGMRGAIAKAEELVREHGYFMPQQFKNEANPEIHRLTTGKEIVEQMGDQLDAFVAGVGTGGTITGAGKVLREAYPNIKIYAVEPADSPVLSGGKPGPHKIQGIGAGFVPDILDTSIYDGVITVTTEEAFAAARRAAREEGILGGISSGAAIHAALKVAKELGKGKKVLAIIPSNGERYLSTPLYQFED

SEQ ID NO: 20235 - protein, 551 aa, Coxiella burnetii
MSETFAELFEKSLTETDLRPGALVKATVVEVRPDRVIVNAGLKSEGIIPASEFRNEEPHVGDEFFVVIEASDNGFGETRLSREKARRAKAWSELEKAYKAGEMVKGVIIERVKGGFTVDLNSVRAFLPGSLVDVKPVRDPGYLEDKEIDFKIIKMDQRRNNVVVSRRAVMEAETSAERQARLEELQEGQEIKGVIKNITDYGAFVDLGGVDGLLHITDMAWGRVKHPSDLLNVGDEVHVKVLKFDRDKKRVSLGMKQLADDPWAKIERRYPVNSRVFGKVTNITDYGCFVKLEEGVEGLVHTSELDWTNKNIHPSKVVQSGEEVEVMVLEIDEERRRISLGIKQCKRNPWQEFAEKHEKDEKITGKVRSITDFGMFIGLEGDIDGLVHLSDISWTESGEEAIRNYKKGDEVQAVILGIDPERERISLGIKQLEGDPFMEFVESYDKDAVIQAKVKEVESKQAVLELADQVLGQMRLADYTYDRVKDLTQELNVGDEVAVKIVNVDRKNRLINVSHKAVEGRSEKGTRTVSDVPTKTTLGDLLKEKIQSKDE

SEQ ID NO: 20236 - protein, 719 aa, Pseudomonas fluorescens
MTRPKKAEPAAHAEPSRIREGLPFPLGATWDGLGVNFALFSANATRVELCIFDDAGEVELERIELPEYTDEIFHGYLPDAHPGLIYGYRVYGPYDPANGHRFNHNKLLIDPYAKQLVGELKWSEALFGYTIGHPDADLSFDERDSAPFVPKCKVIDPAHTWGHDHRVSVPWDKTIIYETHVRGISMRHPSVPENVRGTFAGLMVDDVLEHIRKLGVSTVELLPIHAFVNDQHLLHKGMTNYWGYNSIAFFAPDPRYLASGKIAEFKEMVAHLHDANLEVILDVVYNHTAEGNEQGPTLSMRGIDNASYYRLMPDDKRFYINDSGTGNTLDLSHPCVLQMVTDSLRYWASEMHVDGFRFDLATILGRYHDGFDERHSFLVACRQDPVLRQVKMIAEPWDCGPGGYQVGNFPPGWVEWNDKFRDTVRAFWKGDDGQLADFASRMTASGEMFNQRGRRPYSSVNFVTAHDGFTLNDLVSYNDKHNEANDENNQDGSNNNLSWNHGVEGPTDDPEINALRHRQMRNFFATLLLSQGTPMIVAGDEFARTQDGNNNAYCQDSEIGWVNWDLSEDGKTLLKFVKRLIKLRLAYPILRRGRFLVGEYNEDIGVKDVTWLAPDATEMTTEHWHDAQNRCMGMLLDGRAQETGIRRKGGDATLLLVVNAHHDIVNFTLPEVPEGSFWTCMIDTNQPSIRGQERFEFGHEYSVTGRSLLLFELQREEED

SEQ ID NO: 20237 - protein, 112 aa, Prochlorococcus marinus
MKKIEAIIRPFKLEDVKIALVNAGIVGMTVSEVRGFGRQKGQVERYRGSEFTVEFLQKLKVEVVVPDEKSEIVLKAIADAAKTGEIGDGKIFVSPIDSVVRIRTGDRNEIAL

SEQ ID NO: 20238 - protein, 317 aa, Unknown
  Azoarcus sp. EbN1
MTTKHARLLILGSGPAGYTAAVYAARANLDPVLITGLAQGGQLMTTTDVDNWPADADGVMGPDLMARFQKHAERFNTEMVFDHIHTVKLGEKPFRLVGDAGEYTCDALIISTGATAKYLGLPSEEKFSGRGVSACATCDGFFYKNQDVAVIGGGNTAVEEALYLANIAKKVTVVHRREKFRAEKILIDKMMEKVAAGKIELALNSTLDEVLGDNTGVTGMRVRDANTGATRDVALQGVFIAIGHKPNTDIFEGQLEMENGYIITKGGREGDATATSVAGVFAAGDVQDHIYRQAVTSAGTGCMAALDAERYLDTLAG

SEQ ID NO: 20239 - protein, 691 aa, Salmonella typhimurium
MTTNRAFEIRSGYSHTLGANYDGEGVNFAIFSAHAERVELCLYDPSGEHEIARLELPEYTDEIWHGYVPKLQPGALYGYRVYGPYDPENGHRFNPNKLLIDPYARELVGDIQWNDAHFAYQLLHDDKDLTFDDQDSAPFTPKCRVIDPDEANWEDRQRPSIPWSNAIIYETHVKGFTQLNSAIPEPLRGTFEGMGHKASVDYIKSLGITSVELLPVHWFPDDQHLLDKGLKNFWGYNSLGFFAPATRYYGPKGIQGFRDMVRAFHDAGIEVILDVVYNHTAEGNELGPTLSFKGIDNFSYYRTMPDQHRYYINDTGTGNTVNTSHPRVLQMVMDSLRYWAESMHVDGFRFDLGTILGREPEGFDQRGGFFDAVTQDPVLAKLKLIGEPWDIGPGGYQVGGFPPGWGEWNDKYRDTVREYWKGDNVTNDFAARLLGSGDLYDLRGRRPWSSVNFITAHDGFTLNDLVSYNDKHNEANGEDNNDGHNDNRSCNYGAEGPTDDEGINAIRERQKRNFLTTLLFSHGTPMLLAGDEFGRSQMGNNNGYCQDSEISWVHWDNLPETANALREFTRHLIQLRATQPLLRRESWRDGLEIRWFNAGGGAQQSEQWDEGSTIGVCISRPDLQPEAGIWHDALLLFNPFEGSVPFRIPMWGEGGWVLELTTADNAQQGMRITEEMDFDLAGRSIVLFRRP

SEQ ID NO: 20240 - protein, 205 aa, Cycnium racemosum
GVHLGHGPRKWNPKMAPYISGKRKGIHITNLTRTARFLSEACDLVFYAASRGKQFLIVGTQKKKAADSVAWAAIKARSHFVNKKWLGGMLTNWSTTETRLHKFRDLRMEQRAGRLNRLPKRDAAVVKRQLSRLQRYLGGIKYMTGLPDIVIILDQHEEYTALRECITLGIPTICLIDTNCDPDLADLSIPANDDARSSIRLILNK

SEQ ID NO: 20241 - protein, 112 aa, Unknown
  Azoarcus sp. EbN1
MKKIEAVIKPFKLDEVREALSEVGIAGLTVSEVKGFGRQKGHTELYRGAEYVVDFLPKIKVEIVLGDDLVDQAVEAIIKAARTGKIGDGKIFVTAVEQVVRIRTGETDEAAI

SEQ ID NO: 20242 - protein, 567 aa, Ehrlichia chaffeensis
MEDLQTKTNLGSENYLHNIKKIKSNKFISHNLEVEDSDNDSSSEFQHALKEFIDDSVKEGQIIEGTIICIDKGYVTIDSGLKSESIVSLKEFELGDDYQNISIGSKVKLYLEKIEGRNGSVVLSREKAIRDELWQKLEEAAEKKEDVEGVIFSSIKCGYTVDIKGVVAFLPASHVALRQVKDITPLLGKKQKFRILKMDKKQGNIVVSRKAILEESLADAKSLYLSQLNEGDIIEGKVKSITKYGVFIEIHESPSVGVVDGLLHITDISWSRVSHPSAVFSCGQTVKTKIIKIDRENKKISLGVKQLEESPWSNIEKKYPVDSIHKGIVTSIEEYGVFVELETGIEGLVHVSEVSWTKNSLPINQLFMRGEEIQVKVLSIDTAKSRMSLSMKRCQDNPWQAFTLKYPLGSIVSTKIKNITNLGIFVSFQDNTLNDGIEGLIRTTELSWSLSPEAAIKKYNVGDSVEAKILMINPNKSKIDLGVKQLEYDPFLDLLKKINLGDKIPVTVTKVVEDTGILVDVFNGSNSFNLLIEQEYLPDNKKFFPGDRLEAEVLLIETYNMILSLKH

SEQ ID NO: 20243 - protein, 52 aa, Pisum sativum
IPTICLIDTNCDPDLADMSIPANDDAIASIRLILNKLVFAICEGRSSSIRNY

SEQ ID NO: 20244 - protein, 226 aa, Populus euphratica
MAQCLDRIKHFCAAVSSCCDADLYKQNKGLEDPEALARETVFSVSEIEALYELFKKISSAVIDDGLINKEEFQLALFKTNKKDSLFADRVFDLFDTKHNGILDFKEFARSLSVFHPNAPIDDKIEFSFQLYDLKQQGLIERQEVKQMVVATLAESGMNLSDDVIESIIDKTFEEADTKHDGKIDKEEWRSLVLRHPSLLKNMTLQYLKDITTTFPSFVFHSQVDDT

SEQ ID NO: 20245 - protein, 538 aa, Unknown
  Azoarcus sp. EbN1
MDKTLAIAVAQLNFTVGDLTANADRIIRALDQARAAGADLLLTPELALSGYPPEDLLLRPDFYRACSREVARIALHTDGITLVLGHPEERRDWRYNAASVIRDGEVLATYHKHLLPNYEVFDEERYFDRGLDACVFELNGVKLGVNICADLWESGPAELVRAEGAELLLGLNASPYHMNKLARRYEVLRGRVADTGLPVVYCNMVGGQDELVFDGASFALDADGQVRYQAASFEERLDVLHFRGGRWEPGEIVPARPIEEEVYEALKTGVRDYLGKNGFPGAIIGLSGGIDSALTLCIAVDALGPERVRAVMMPSPYTAQMSLDDSRALVANLGVRYDEIPIEPAMNTFADLLARQFEGLPADTTEENLQSRIRGMILMALSNKTGAIVLTTGNKSEMATGYATLYGDMAGGFAVLKDLYKTFVFRLSRWRNTVSPVMPENIITRPPSAELKPDQTDQDSLPPYDVLDAIIEAYMERDESPREIIARGFPEADVRRTVAMLKRNEYKRRQSPVGIRVTRRGFGRDWRYPITSRYQDEY

SEQ ID NO: 20246 - protein, 204 aa, Digitalis purpurea
GVHFGHGTRKWNPKMAPYISAKRKGIHITNLTRTARFLSEACDLVFDAASKGKQFLIVGTKNKAADSVAWAAIKARCHCVNKKWLGGMLTNWSTTETRLHKFRDLRMEQKTGRLDRLPKRDAAMLKRQLSRLQTYLGGIKYMTALPDIVIIVDQHEEYTALRECITLGIPTICLIDTNCDPDLADISIPANDDAISSIRLILNK

SEQ ID NO: 20247 - protein, 427 aa, Arabidopsis thaliana
MDLWPRIVANLAPIIFSHKEGVNFLSWINNKRIITPDCNQYSSTSLVPQILSSFVCPHNNNNNAEMAMSAIGFEGYEKRLEVTFFEPGLFLDTQGKGLRALAKSQIDEILQPAECTIVSSLSNDQLDSYVLSESSLFIFPYKIVIKTCGTTKLLLSIEPLLRLAGELSLDVKAVRYTRGSFLCPGGQPFPHRNFSEEVSVLDGHFAKLGLSSVAYLMGNDDETKKWHVYSASSANSNNKNNVYTLEMCMTGLDKDKASVFYKNESSSAGSMTDNSGIRKILPQSQICDFEFEPCGYSMNSIEGDAISTIHVTPEDGFSYASFEAVGYDFTTMDLSHLVSKVLTCFKPKQFSVAVHSTVAQKSYDSGLSVDLDDYGCKESTMESLGEERGTVMYQRFEKLGRYCGSPRSTLKCEWSSNSSCNSEDEKE

SEQ ID NO: 20248 - protein, 525 aa, Arabidopsis thaliana
MSPLNDLKINLNGQYTFFLNQNVISKYSGSLRKMIKQSKKKRNKKKRIITIEINDFPGGPDGFELVSRFCYHNGEILIDVSNVSTLYCCSVFLGMSEKFCFSNLFLQTEKFLEEVFYGSWSDIVSCLKNCEQVFFQADSYGLVDKLIFAALNKISQNSDDFSSSSLSSFASSLSPEMAKNTSESDGRYISRSVACGRSNEWWFEDMTNLSPKIILKLVMIIGAYKTNIKSLVLTRFLLHYLKTKLQTKSRTTTELMRNKLEYSDLADTAVRGVISAGTRTFSCRKLFWILRVLSSFSLSRESRIGLETLIGEMLEQATLDDLLISARGSRESGFYNVDLVIRLLKVFVKNREEEEEESRERNMKEIGKLIDKYLREISPDQNLKVPKFLGVAESLPDSARDCFDGVYRAIDIYLQSHPNLTPQDRTEICRCLNYKKLTMETCKQLARNPKIPPEIAIEALKSRCGNQEHTTSDVKVANKSFSCRYSEEKKKPVVLHLEITEKLAERLKTKGGYNLKVMDSFREGL

SEQ ID NO: 20249 - protein, 202 aa, Sinorhizobium meliloti
MADVMPSRTGQVSRKTNETAISVSVNVDGTGVSKIATGVGFFDHMLDQLSRHSLIDMEIKAEGDLHVDDHHTVEDTGIAIGQALAKALGDRRGITRYASIDLAMDETMTRAAVDVSGRPFLVWNVTFTSPKIGTFDTELVREFFQALAQHAGITLHVQNIYGANNHHVAETCFKSVARVLRTATEIDPRQAGRVPSTKGTLA

SEQ ID NO: 20250 - protein, 1020 aa, Unknown
  Synechococcus sp. WH 7805
MTPSNTLQVTVNGELWWGGFTAELTVSNPSDQALDNWSISFISSHDLDPEAWGVEISRELLDDGQSRYILSGSSWGQSIPAGGDVRIGFNGRQGFDLGREGALTEAMLMTELASNSVIPQEAADMSVPHDHSGVTGLHTDITTWGSFHGSNHNSEHNELVGGRTAITTEAMVAYNGLRAFAGLEAVELEVVGAWAFAQGLTNNTQPWGDDLRGVGLWYAMQGAKVGWIADEAYNPQILADIQHSARQGDADAVMTMVETFGHEGFASYLRSHALEGTFINTLKMEPHYGGWMHGRAHGFLNIEGVAINHDINHLTVLDWEQTKPFMNDTFNYPQWPALEVSDDTVINYFQSMVTLGNPLEGNLNQLQTTLTSDTDEDQWNEFNRIEPKTTKTGRSRFIGTAQPDALISTAQKDIMTGRGGADLFAFIRTGGPIDVVTDFNRLDEDKIGIDAESFPGIDTIDLATANNKTEYQQLKQSDANIIYQAYTGKLVYNENGSRKGLGSNDAAIAKFKGNPLINSDDIVLIKASSTPSSPQDETETDPQTPPITTTDTPNTNTYAEALKLSLLFYEANRSGDLDEATNRVPWRGDSGLNDGNDGIYFGDATAENLQPDINLDLTGGYHDAGDHVKFGLPLASTLSTLTWGGLAFADGYEITGQADELLSTVKWGTDYLLKAHQVDANGSTDLFIVQVGDGQADHALWSSPESQSIARPALAITAEKPGSDVAAASAAALASASILFRDHGEVDYANELLNNAEALFDFAVTYQGKYSDSIASVQPFYNSWSGFQDELAYGGLWLARGLEAAGQDGSTYRLEAQDRYHTMIGGLNHAWAPNWDDASYGTAVLLSQDLEDQQAMDDVSAWLDSWVTGDQGPQITDGGLRFVDQWGSLRYAANTAMLAGIVADSITNPGGAYSELAVDSIDYILGDNPRGFSYLVGFGDNFPQQPHHRAASGVGWEGFNAPNANEYVLAGALVGGPSSADDFAYNDLRSDYISNEVAIDYNAGLTGALAFAAQTTSGFG

SEQ ID NO: 20251 - protein, 248 aa, Glycine max
  misc_feature (178)..(178): Xaa can be any naturally occurring amino acid
MVSQTVELLKNEIPLEQESVVLAEDAVNGLVLVDIINGFCTVGAGNLAPRESNTQISGMISESARLARVFCEKNLPVMAFLDSHHPNKPEDPYPPHCIVGSDESNLVPALRWLENEPNVTIRRKDCFDGYLGSIQEDGSNVFVDWVKKNKITTLLVVGVCTDICVLDFVCSTMSAKNXRGFLEPLENVVVVFPVPVLTFNVPLEVARNTKGAFGNIPQEFMHHVGLYMAKERGAKIANEVLFGAAGKV

SEQ ID NO: 20252 - protein, 517 aa, Coprinopsis cinerea
MSPISAHHADDAQHVLDLIDRQFTVTSDQLVAITRGFLDEMEQGLGAYGKPMAMIPSFVTGVPNGKETGTFLALDLGGTNLRVCEVVLNGDQTFSLVQQKYKVSDTLKTGDASALFDYIADSVDAFLTTHATTNYSSPKGVPADAAPDSVYLGFTFSFPVEQTALGSGKILTWTKGFSAKNAVGNDVVQLLQNAFDRKHMHVKCIALVNDTVGTLLTHAYISGGSLVGAIFGTGTNGAYVEELSKIKKLDGKKADSPDGHMVINCEWGAFNNSKSHLPITPYDNTVDRLSINPGFQIFEKFISGMYLGEIVRHIIVSLVDATPKPILFGGKSTSVLNEHYGLDTSFMSKVEEAWIGDDKSSDAFTLPPLASVSDKSVSPQVLSKLQKIKDVIVETLKYPADEVSVRDAAIVRQLCYLVARRAALLSGLAVSAILIQTERARFPGDTNSPLKYPNDTLGVGVDGSLVEHYPGFQDSMRDSLKLLVGEDVTSRVEIGLAKDGSGVGAALCALQALKQRS

SEQ ID NO: 20253 - protein, 855 aa, Oryza sativa
MAAAVAMRSGSGSDGGGGGYDKAGMDSGKYVRYTPEQVEALERVYAECPKPSSSRRQQLLRDCPILANIEPKQIKVWFQNRRCRDKQRKEASRLQAVNRKLTAMNKLLMEENERLQKQVSQLVHENAYMKQQLQNPSLGNDTSCESNVTTPQNPLRDASNPSGLLTIAEETLTEFLSKATGTAVDWVPMPGMKVDCQLLRFTLPASNDPGPDSFGIVAVSHGCRGVAARACGLVNLEPTKIVEILKDRPSWFRDCRSLEVFTMFPAGNGGTIELVYMQMYAPTTLVPARDFWTLRYTTTMEDGSLVVCERSLSGSGGGPSTASAQQFVRAEMLPSGYLVRPCEGGGSIVHIVDHLDLEAWSVPEVLRPLYESSRVVAQKMTTAALRHIRQIAQETSGEVVYALGRQPAVLRTFSQRLSRGFNDAISGFNDDGWSVMGGDGIEDVIIACNAKKVRNTSTSANAFVTPGGVICAKASMLLQSVPPAVLVRFLREHRSEWADYNFDAYSASSLKTSSCSLPGLRPMRFSGSQIIMPLAHTVENEEILEVVRLEGQALTHDDGLMSRDIHLLQLCTGIDEKSMGSCFQLVSAPIDELFPDDAPLISSGFRVIPLDMKTDGTPAGRTLDLASSLEVGSTAQPTGDASMDDCNLRSVLTIAFQFPYEMHLQDSVATMARQYVRSIVSSVQRVSMAISPSRSGLNAGQKIISGFPEAPTLARWICQSYQFHLGVELLRQADDAGEALLKMLWDYEDAILCCSFKEKPVFTFANEMGLNMLETSLVALQDLSLDKIFDEAGRKALYNEIPKLMEQGYVYLPGGVCLSGMGRHVSFEQAVAWKVLGEDNNVHCLAFCFVNWSFV

SEQ ID NO: 20254 - protein, 519 aa, Ipomoea purpurea
MATLTLIFCTLVFAIFLYFLILRVKQRYPLPLPPGPKPWPVLGNLPHLGEKPHQSIAAMAERHGPLMHLRMGFVDVVVAASAAVAAQFLKVHDANFSNRPPNSGAEHIAYNYQDLVFAPYGPRWRMLRKITSVHLFSAKALDDFCHVRQEEVATLTRSLASAGKTPVKLGQLLNVCTTNALARVMLGRKVFNDGGSKSDPKAEEFKSMVEEMMVLAGSFNIGDFIPILGWFDLQGIVGKMKKLHARFDAFLNSILEEHKFVNNQHTTLSKDVDFLTTLIRLKDNGADTDSEEGKLTDTEIKALLLNLFTAGTDTSSSTVEWAFAELLRNPKILNQAQQELDSVVGQNRLVTESDLTHLPFLQAIVKETFRLHPSTPLSLPRMGAQGCEINGYFIPKGATLLVNVWAIARDPNVWTNPLEFKPHRFLPGGEKPNVDIKGNDFEVIPFGAGRRICSGMSLGIRMVHLLVATLVHAFDWDLMNGQSVETLNMEEAYGLTLQRAVPLMLHPKPRLQPHLYTLN

SEQ ID NO: 20255 - protein, 204 aa, Euphrasia sp.
GVHFGHGTRKWNPKMAPYISAKRKGIHITNLTRTARFLSEACDLVFDAASRGKQFLIVGTKNKAADSVVWAAIKARCHCVNKKWLGGMLTNWSTTETRLHKFRDLRMEQKTGRLNRLPKRDAAVVKRQLSHLQTYLGGIKYMTGLPDIVIIVDQHEEYTALRECITLGIPTICLIDTNCDPNLADISIPANDDAISSIRLILNK

SEQ ID NO: 20256 - protein, 553 aa, Coccidioides immitis
MSAFDQATSLGAWKALEEHHSSAGKDISLKEEFQKDPQRFSKFSRTFNNPADGSEILFDFSKNLITDETLKLLVNLAKEAGVEKLRDEMFNGDPINFTENRAVYHVALRNVSNGPMQVNGKSVVEEVNSVLQHMKEFSEQVRSGEWKGYTGKKIKTIINVGIGGSDLGPVMVAEALKPYADRSLTVHFVSNIDGTHIAEALKESDPETTLFLIASKTFTTAETITNAQTAKAWFLATARDEAHIARHFVALSTNEAEVTKFGIDKRNMFGFESWVGGRYSVWSAIGLSVALYIGFDNFHQFLAGAHAMDKHFRETPLEQNIPVLGGLLSVWYSDFFGAQTHLVSPFDQYLHRFPAYLQQLSMESNGKAITRSGDFVKYTTGAILFGEPATNAQHSFFQLLHQGTKLIPADFIMAAESHNPVENGKHQRMLASNFLAQAEALMVGKSPDQVRAEGAPENLVPHKTFTGNRPTTSILAQKITPAALGALIAYYEHVTFTEGAVWNINSFDQWGVELGKVLAKKIQSELETKGAGSGHDASTSGLIAAYKKKAGLL

SEQ ID NO: 20257 - protein, 201 aa, Harveya purpurea
  misc_feature (9)..(9): Xaa can be any naturally occurring amino acid
  misc_feature (158)..(158): Xaa can be any naturally occurring amino acid
  misc_feature (184)..(184): Xaa can be any naturally occurring amino acid
GVHFGHGTXKWNPKMAPYISAKRKGIHITNLTRTARFLSEACDLVFDAASGGKQFLIVGTKNKAADSVAWAAIKARCHCVNKKWLGGMLTNWSTTETRLHKFRDLRMEQKSGRLNRLTKRDAAVVKRQLSRLKTYLGGIKYMTGLPDIVIIVDQHEEXTALRECITLGIPTICLIDTNCDPDLXDISIPANDDAISSIRLI

SEQ ID NO: 20258 - protein, 618 aa, Unknown
  Rhodococcus sp. RHA1
MALEDSSSAFADPSREGAASPEHDLEGHLIEARSEDFFHARELQVDNEWFKTAVFYEVLVRAFFDSSGDGTGDLQGLTSKLDYLSWLGVDCLWLPPFYDSPLRDGGYDIRDFRAVLPEFGTVEDFVQLFDQAHRRGIRVITDLVMNHTSDTHAWFQESRTDPDGPYGDFYVWSDRDEGYPDARIIFVDTETSNWTWDPVRKQYYWHRFFSHQPDLNYDNPDVQDAMIDVLRFWLDLGIDGFRLDAVPYLFEREGTNCENLPETHAFLKKCRAVMDAEYPGRALLAEANQWPSDVVEYFGEPDVGDECHMAFHFPLMPRIFMAVRRQNRFPISEILAQTPPIPSSCQWGIFLRNHDELTLEMVSDEERDYMYSEYAQDPRMKANIGIRRRLAPLLENDRNQLELFTALLLSLPGSPVLYYGDEIGMGDNIWLGDRDSVRTPMQWTPDRNAGFSRADPARMYLPVIMDPTYGYQSVNVEAQMNSTNSLLHWTRRLIQVRKQHPAFGTASFTELGSANPAVLSYVRETPPSQDRPYSDVILCVNNLSRFPQAVILDLTQFAGRIPVELTGSVPFPSIGDGGYMITLPGHGFFWFALQPDPKSDGAVSGHPVSSEAEQAVQQ

SEQ ID NO: 20259 - protein, 167 aa, Verticillium dahliae
IYDNRVLPTMISPDASADLPDTWKDERYAIYDLNANSATCYPAHDERVSLVDGPESYKVRGYAYGGGGRRITRVEVTLDKGKSWTLANISYPEDEYRLAPDGDMLYGGRMDMAWRESSFCWCFWDLDIPMSQIAAADDVMVRCMDEGMMVQPRDMYWSVLGMMNNPW

SEQ ID NO: 20260 - protein, 204 aa, Hyobanche sanguinea
GVHFGHGTRKWNPKMAPYISAKRKGIHITNLTRTARFLSEACDLVFDAASRGKQFLIVGTKNKAADSVAWAAIKARCHCVNKKWLGGMLTNWSTTETRLHKFRDLRMEQKAGRLNHLPKRDVAVVKRQLSRLQTYLGGIKYMTGLPDIVIIVDQHEEYTALRECITLGIPTICLIDTNCDPDLADISIPANDDAISSIRLILNK

SEQ ID NO: 20261 - protein, 518 aa, Lilium longiflorum
ASHQAMEVQSMPVTPRSGTPRVTPPISAPPSQLHSPSLTRSPLLGPATPRASRLTPLASPIRKAIVSMRGYLEEVGHVTRLDPQDEWLPITQSRNGNSYYSAFHTLSSGIGFQALVVPVAFTFLGWLWGIVLLSVGFCWQLYTLWLLVELHESVPGTRYSRYLHLAKDTFGEKLGKFMALVPIIYLSAGTCSALIIVGGSTMKGFFQIVCGPTCRYMPLTTVEWYLVFVCLAVVLAQLPHLNSIAGVSLIGAVTAVTYCTMIWVISVRKGKIPNISYEAVDTSWDVARVLSILNAIGIIAFAFRGHNLVLEIQGTMPSTQKHPARVPMWRGVKVAYVLIAFCLFPVALIGFWSYGNQIPPNGVLTALNQFHSHDTSRTILGLTTLLVVINCLSSFQIYAMPIFDNMEAGYTSKKNKPCPQWLRSGFRAFFGAVAFLISSAFPFLPQLAGLIGAVALPVTFAYPCFMWIVIKKPERFGVMWWLNWCLGCLGMGLSVVLVVAGVWRLVETGVNISFFDPQ

SEQ ID NO: 20262 - protein, 111 aa, Zea mays
HASGGHNSIIFLINNGGYTIEVEIHDGPYNVIKNWNYTGLVEAFHNGEGACYTAKVRTEEELTEALEAALGPKKDCLCFIEVIVHKDDTSKELLEWGSRVSAANSRPPNPQ

SEQ ID NO: 20263 - protein, 204 aa, Viburnum erubescens
YDKPVKGRKINWMKAGILESDQILTVSPYYAEELVSGEDKGVELDNILRKTGIIGIVNGMDVQEWNPLTDKYTGIKYDATTVMNAKPLIKEALQAEVGLPVDKDIPVIGFIGRLEEQKGSDILVEAISQFIGENVQIIVLGTGKKAMEKQLEQLEIEYPDKARGVAKFNVPLAHMIIAGADFILVPSRFEPCGLIQLHAMRYGT

SEQ ID NO: 20264 - protein, 363 aa, Oryza sativa
MGVSGGEEGARNGPSLMPGGHVDAYNNIRDILEKAAAQTEDGACVTFVGPGGAGNFVKMVHNGIEYGDMQLIAEAYDVLRRVGGLSNSEIADVFAEWNRGELESFLVEITADIFTVADPLDGSGGGGLVDKILDKTGMKGTGKWTVQQAAELAIAAPTIAASLDGRYLSGLKEERVAAAGVLEAEGMPSGLLETINVDKKMLVDRVRQALYASKICSYAQGMNLLRAKSVEKGWNLNLAELARIWKGGCIIRAKFLDRIKNAYDRNPELANLIVDREFAREMVQRQNAWRWVVARAVEAGISTPGMSASLSYFDTYRCSRLPANLIQAQRDLFGAHTYERIDRPGSFHTEWTKLARKSNGAAI

SEQ ID NO: 20265 - protein, 204 aa, Viburnum odoratissimum
YDKPVKGRKINWMKAGILESNQILTVSPYYAEELVSGEDKGVELDNILRKTGIIGIVNGMDVQEWNPLTDKYTGIKYDATTVMNAKPLIKEALQAEVGLPVDKDIPVIGFIGRLEEQKGSDILVEAISQFIGENVQIIVLGTGKKAMEKQLEQLEIQYPDKARGVAKFNVPLAHMIIAGADFILVPSRFEPCGLIQLHAMRYGT

SEQ ID NO: 20266 - protein, 468 aa, Glycine max
  misc_feature (61)..(61): Xaa can be any naturally occurring amino acid
CLILCIGVLLQTYPNPLQDNPAYSVVKQYFVHVDDSVPQKVVVHKDGARGVHFRRAGPRQXDEVQAAIVTCGGLCPGLNTVIRELVCGLHHMYGVKKVLGINGGYRGFYARNTITLTPKSVNDIHKRGGTVLGTSRGGHDTKKIVDSIQDRGINQVYIIGGDGTQKGASAIFEEVRKRGLKVSVVGIPKTIDNDIPVIDKSFGFDTAVEEAQRAINAAHVEAESVENGIGVVKLMGRNSGFIAMYATLASRDVDCCLIPESPFYLEGPGGLYEYIEKRLKENGHMVIVIAEGAGQELVSESVQSMSKQDASGNKLFQDVGLWISQKIRDHFAAQKTLPITLKYIDPTYMIRAIPSNASDNVYCTLLAQSAVHGAMAGYTGYTSGLVNGRQTYIPFYRITERQNHVVITDRMWARLLSSTNQPSFLDAKGDNEEKEEEEALNQLPDGHCAKDTSLASKEINSSIYPTAC

SEQ ID NO: 20267 - protein, 279 aa, Leptospira interrogans
MLNADTNKDSRPGKVYLVGAGPGNPEDLTLRAYRILTKAEIILYDALLDPSFLEIFPKSAIVHYVGKRSGAHSATQEEINQLLLSYALSGKNVVRLKGGDPFVFGRGGEELITLVNHNIKYEIVPGVSSLNAGSSFAGFPLTHRGLSRQVLIMDGHTVLNEETDWEWFAKFKGTIALFMGTSSLPKIANLLLQHGSSADLPVALVENASLENFNIQICSLKEAANSYLEKKTQGPGIIYIGKVVRFLENKKLTSTFSQFSKESFLGQISSEIQGGKNES

SEQ ID NO: 20268 - protein, 204 aa, Viburnum sieboldii
YDKPVKGRKINWMKAGILESDQILTVSPYYAEELVSGEDKGVELDNILRKTGIIGIVNGMDVQEWNPLTDKYTGIKYDATTVMNAKPLIKESLQAEVGLPVDKDIPVIGFIGRLEEQKGSDILVEAISQFIGENVQIIVLGTGKKAMEKQLEQLEIEYPDKARGVAKFNVPLAHMIIAGADFILVPSRFEPCGLIQLHAMRYGT

SEQ ID NO: 20269 - protein, 279 aa, Medicago truncatula
MAEHLASIFGTEKDRVNCPFYFKIGACRHGDRCSRLHNRPTISPTLLLSNMYQRPDIITPGVDPNGQPIDPRQIQQHFEDFYEDIFTELSKFGYVETLNVCDNLADHMIGNVYVLFKEEDHAAAALASLRGRFYEGRPILADFSPVTDFREATCRQYEENSCNRGGYCNFMHVKKIGRELRRKLFSSQRSRSRSRSNSPRRRRRSRSRERERPRDRDYDSRGRRSSDRDRVRDGDRDRERKRDSRDRDGGRRNGREAREGSEERRARIEQWNREKEEKP

SEQ ID NO: 20270 - protein, 482 aa, Helicobacter pylori
MIKQILTILTPFFVATLLYFLGAPDGLNPNAWLYFCIFMGMIIGLILEPVPSGLIALSALVPCIALKIGASSEVASANKAISWGLSGYANKTVWLVFVAFILGLGYEKSLLGKRIALLLIRFLGQTPLGLGYAIGLSELCLAPFIPSNSARSGGILYPIVSSIPPLMGSTPSNNPDKIGAYLMWVALASTCITSSMFLTALAPNPLAMEIATKMGVNEISWFSWFLAFLPCGVVLILLVPLLAYKTCKPTLKGSKEVSLWAKKELESMGRFSLKEILMLSLTLLALLGWIFGKSLGLHASATALIVMVLMAFCKIVSYEDIIKNKSAFNIFLLLGSLLTMAGGLKNVGFLNFIGNAAQNFLEHAHLDPLIAVLFIVALFYLSHYFFASITAHVSALFALFVGIGSHIQGVNLQELSLFLMLSLGIMGILTPYGTGPSTIYYGSGYIQSKDFWKWGFIFGFLYLIVFLSVCAPWVKFIAYRWL

SEQ ID NO: 20271 - protein, 116 aa, Arabidopsis thaliana
  misc_feature (36)..(36): Xaa can be any naturally occurring amino acid
  misc_feature (75)..(75): Xaa can be any naturally occurring amino acid
  misc_feature (101)..(101): Xaa can be any naturally occurring amino acid
  misc_feature (107)..(107): Xaa can be any naturally occurring amino acid
MVATPATRGRLILLLSSLTTRSCSGATNPSILIYDXRCRGMLLDALPTCAHLVSWQTVNVYREASEAARIACQQXLGTAAGRDAFLLGGRGRPFRDREIHXMLSRAXADKLQTGMR

SEQ ID NO: 20272 - protein, 298 aa, Pseudomonas putida
MSEHSTPVSPVRIAVIQYDPQVGVEHSDGNLSKGLALARRAAREGANLIVLPELANTGYTFHSRAEAYAHAETLQEGRSLKAWAAFAREHRVYLAAGFTERDGLKLYDSAALFGPNGLLGHYRKAHLWNQEKLWFTPGNLGFPVFETAIGRIGLLICWDIWFPEVPRLMAAQGADIICSLNNWVWTPPPLFDEAGRCMASYLTMTAAHVNNVYIAAANRIGNERGGRFLGCSLIAGTNGWPIGEVASAQEEAILYADVDLSSARSAPIWNSLNDLQRDRRTDLYDASLGYRLHTPMPR

SEQ ID NO: 20273 - protein, 563 aa, Unknown
  Oceanospirillum sp. MED92
MSESFADLFEESLQELEMAPGAIVSGTVVAIEDDYVIVNAGLKSEGIIPKSQFLDENGDLTIDVGSEVKVALEAVEDGFGTTQLSRDKAKRAEAWIELEKAYEADEIVTGNITGKVRGGFTVNVNTIHAFLPGSLVDVRPLRDTSHLENQELEFKLVKLDAKRNNIVVSRRAVLEAAYSEEREKLLANLKEGLKVKGIVKNITDYGAFIDLGGVDGLLHITDIAWKRVKHPSEALKVGEEIDVQVLRFDKERNRVSLGMKQLSEDPWTQLISNYTVGAKAKAKVTNLTDYGCFAEIENGIEGLIHVSEMDWTNKNVHPSKVVQVGDMVDVMLLDIDMERRRISLGMKQCKPNPWNEFSSKFDKGDKITGSIRSITDFGVFIGLDGGIDGLVHLSDLSWEQPGEEVVKSYKKGDEVEAVVLSVDAERERIALGIKQLDSDPFVNFTSVNAKGSIVKGQVSNVTDKALSVTLAEGVEASLKIADVSRDRIDNLSERFTVGDEVEAVISNIDRRNRVITLSIKQLEIEQEKKAMDKISQQSDAVISGPTTIGDLIKAQMNKDDDSK

SEQ ID NO: 20274 - protein, 144 aa, Triticum aestivum
MAASTAAVLSPPTVAGLRLAPSPRAAVSFRTASSSAARRSVAARAALEPSVVISLSTGLSLVMGRFVFFNFQRENVAKQVPEQNGKTHFEAGDERAKEFAGILKSNDPVGFNLVDVLAWGSIGHIVAYYILATTSNGYDPPFFG

SEQ ID NO: 20275 - protein, 365 aa, Unknown
  Frankia sp. CcI3
MDKTTDMVPAERRQPALAYTGQGRFERERELVLRSPQLVGYRSELPAPGSYCTKTVMGVPVLLTRGEDGTVRAFQNVCAHRQAPVAEGCGAAERFVCPYHAWVYDAQGDFVGGPGREGFPSTMAGKPRLTQLPAAEHSGFLWVGLQPDSGPLDIDAHLGELGPELASWDIGSWASVGEKVLDFPINWKFALDTFAENYHFATVHRDTFALITKSNCALFDSFGPHHRLVFPMRHITDLADKPEEEWEPLHNLVVIYALFPNIVLSVTVANGEVFRVYPGSGPGHSITYHQNASPMDLTDEATRTAADEIFEYAHATVRDEDYRMAIDIQKNMASGVRPELVFGRNEPGLHHRHAVIDEALAAFGG

SEQ ID NO: 20276 - protein, 338 aa, Pseudomonas putida
MNLNRFERYPLTFGPSPITPLKRLSEHLGGKVELYAKREDCNSGLAFGGNKTRKLEYLIPEAIEQGCDTLVSIGGIQSNQTRQVAAVAAHLGMKCVLVQENWVNYSDAVYDRVGNIEMSRIMGADVRLDAAGFDIGIRPSWEKAMSDVVERGGKPFPIPAGCSEHPYGGLGFVGFAEEVRQQEKELGFKFDYIVVCSVTGSTQAGMVVGFAADGRSKNVIGVDASAKPEQTKAQILRIARHTAELVELGREITEEDVVLDTRFAYPEYGLPNEGTLEAIRLCGSLEGVLTDPVYEGKSMHGMIEMVRRGEFPDGSKVLYAHLGGAPALNAYSFLFRNG

SEQ ID NO: 20277 - protein, 382 aa, Arabidopsis thaliana
  misc_feature (214)..(214): Xaa can be any naturally occurring amino acid
  misc_feature (244)..(244): Xaa can be any naturally occurring amino acid
  misc_feature (290)..(290): Xaa can be any naturally occurring amino acid
  misc_feature (362)..(362): Xaa can be any naturally occurring amino acid
  misc_feature (369)..(369): Xaa can be any naturally occurring amino acid
MAVVDVHRFAESITCHAGSPDLSMVALCPNNTEVHIYKSWSQDHGERLHVLQKHDQIVSGIDWSSKSNKIVTVSHDRNSYVWSLEGAEWVPTLVILRLNRAALCVQWSPKENKFAVGSGAKTVCICYYEQENNWWVSKLIRKRHESSVTSVAWHPNNVLLATTSTDGKCRVFSTFIKGVDTKEKKAGSPAETKFGEQILQLDLSNPWAFGVKWXSPSGNTLAYVGHSSMIYFVDDVCPSRLAQXSVAFPRIPLFVMWVMLNTEKMVIGVGYDSNPMVFATDNSGFLSFIXYIGEKKAATSGSSYRSQFSEAFGKFYGSKSKYTTANDASDSRGGVHDNSITSIMPLSKGGKPKVMRFSTSGXDGKIAIXDLENMQQELSNQF

SEQ ID NO: 20278 - protein, 256 aa, Brassica napus
  misc_feature (245)..(245): Xaa can be any naturally occurring amino acid
MRRRLLTHSRVALLELELTKRRMSAATPMADFLTKSPYSPPSWASHLRPLPSHTFSLAHRPTPIHRWNLPGLPNGTELWIKRDDFTGMELSGNKVRKLEFLMADAVEQQADTVITIGGIQSNHCRATTVASNYLNLDTHLILRTSKLLADGDPGLVGNLLVERLVGANVHLISKEEYSSIGSEALTSALKEKLEKEGKKPYVIPVGGSNSLGTWGYIEAAREIEEQLKCRTDGLKFDDMVVACGXGGTIAGIHWDL

SEQ ID NO: 20279 - protein, 245 aa, Zea mays
MAMLREHLDLIRAHLLDDNHDAVSSDDSAPSHSPSPSPSPPGRRPLPALSVSLPPRPAVVLQQQHMRAAAPPLQIPQQEQHCCPEPEEDDFRRYRGVRQRPWGKYAAEIRDPSRKGARVWLGTYDTAVEAARAYDRAAFRLRGSKAILNFPNEVALSTAAWWATPAPPPQPSATVAGNKRARSPQEQDARCMVREVKKERIQEPASGGADYFWEDESLKGAICSLPPLSPLSPHPHLAVPQLYVS

SEQ ID NO: 20280 - protein, 338 aa, Fusobacterium nucleatum
MERIYDMIVIGGGPAGLSAGIYGGRAKLDVLIIEKENKGGQISLTSEVVNYPGILEISGSEFMTQTKKQAQNFGVNFVQEEVVDMDFSQKIKTIKTNKAEYKTLSVVIATGAAPRKLGFPGEQEFTGRGVAYCATCDGEFFTGMDIFVIGAGFAAAEEAMFLTKYGKSVTIIAREPDFTCAKSIGDKVKAHPKITVKFNTELIELTGDVKPTAAKFKNNVTGEITEYKAKVGETFGLFVFVGYAPSSEIFKGHIEIDRAGFIPTNEDLMTNIDGVFAVGDIRPKRLRQVVTAVADGAIAATSIEKYVHDLREELGIKKEEKEEEKTTSVTTEKETFLR

SEQ ID NO: 20281 - protein, 556 aa, Unknown
  Frankia sp. CcI3
MAGSRMISELRSRDPNLIITVFGEEPHPAYNRILLSNVLAGKADLADITLVDHAASGDSGDGTPPRALVDVRAGVVAHHIDRTRRTVTADDGSVVAYDVLILATGSRAWLPPIEGLTRPDGTLLPGVAAFRTLDDCRHILTQSERATRAVVLGGGLLGLEAARGLVRRGLDTTVLHAAGHLMNRQLDRRAGQVLVRTLAGLGVRSRLEARVVRIHGDERLAGVELAGDEVLDADLLVVSTGVVAVTDLAAAAGLPVEAGIVVDDQMRSPADPAVFAVGDCAQHDGTVQGLVAPAWDQVRVVADVVTAADPAARYSGARPVTRLKASGVDLATMGEVDVDEFDEDAEVLQFVDVTRGTFKKLVIRGDRLVGAIMLGDNPTVGTVTQLFDRQAPVPADRRSLLFPTRTEVTVTDSPATLPDRVTICRCNNVTKGGITRCWLDGARDLPAIVTGTRATTGCGTCRDAVAGIVEWLAAADPDPSAAAGDNCAAGLEESPQTDRRSSGGCSATAEPRRYSSAGRPPPRGEVRWPSGTTNPGVDSTLRRKFGGSNATPHAAS

SEQ ID NO: 20282 - protein, 326 aa, Ehrlichia chaffeensis
MKTTILGAGSFGTAIAFALSSNSTSVNLWGRNHTDMQSIAINRKNLKYLPTCKLPENIIVSSNIDEVLSDYSTCIILAVPTQQLRTLCLSIQDKQHIFEKTPLLICSKGIENISLKFPSEIVKEILPNNPAFILSGPSFAKEIAEDLPCTIVLAGENESLGTSIAQKISNKTFKIIYSQDILGVQIGAALKNIIAIACGIVTGKNLGNNAIATVITKGMEEIKTLYAAKNQNINLSTLIGPSCLGDLILTCTTAHSRNMSFGITIGQGADINKMLNNNSKIIEGVSTVKPLISLAKELNIELPICTSIYNLLYKNIPLEKTISDIL

SEQ ID NO: 20283 - protein, 761 aa, Unknown
  Frankia sp. CcI3
MPVPAAPLAEAATHCPYCALQCGMMLRATPESAAKEGTGKDDGPEPAGGRSPGPVTVLAREFPTNRGRMCQKGWTSAELLTAADRLTTPLMRPRRDAPLEPVSWERALDRITEGIIRLQREHGPDAVGVFGGGGLTNEKAYALGKFARVALRSSAIDYNGRFCMSSAAAAGIRSFGLDRGLPFPLEDIAHAGAVIMVGSNAAETMPPFMQYLTRQRENGGALVVVDPRLTATARAAALHLQITPGTDLALANGLAYIALTEGYANRDFLAARTTGLAELRAVLASYWPERVERITGVPVADQYAAVDLLAQAERAMVLSARGAEQHSKGTDTVTALINLALVLGLPGTPGSGYGCLTGQGNGQGGREHGQKADQLPGYRKIIDPVAREHIGRIWGVDPTTIPGPGRSAYEMLDALGTPQGPRALLILGSNIAVSAPRAGRITSRLAALDLLVVADFVLSETAAMADIVLPTAQWAEEEGTMTNLEGRVLRRERLRPPPAGVRTDLEIIAALAARLGHAERFPGEPRAVFDELRRASAGGIADYAGISYERITASDGVFWPCPDETHPGTPRMFLDRFATPDGRARLVPVEHRPVAEDIDPEYPYYLTTGRVLAHYQSGAQTRRIGPLVDAAPEPFVEIHPDLAERLGIAEGAPVRVTSRRGTCEVPARLTDTLRFDTVFLPFHWAGAGRANSLTNDALDPTSRMPEFKVCAVAVEPIDDPDDNPDDDRHATGSVPTATVGAAEPVRAMLTGRSQPSGRHQG

SEQ ID NO: 20284 - protein, 204 aa, Hemimeris sabulosa
GVHFGHGTRKWNPKMAPYISAKRKGIHITNLTRTARFLSEACDLVFDAASRGKQFLIVGTKNKAADSVAWAAIKARCHCVNKKWLGGMLTNWSTTETRLHKFRDLRMEQKTGRLNRLPKRDAAMVKRQLFRLQTYLGGIKYMTGLPDIVIIVDQHEEYTALRECITLGIPTICLIDTNCDPDLADISIPANDDAISSIRLILNK

SEQ ID NO: 20285 - protein, 104 aa, Streptococcus pneumoniae
MAKAITDATFEQETKDGLVLVDFWATWCGPCRMQGPILDKLSEELSEDVLKIVKMDVDENPNTARAFGIMSIPTLLFKKDGQVVKQVAGVHTVEQIKAIIAELS

SEQ ID NO: 20286 - protein, 548 aa, Oryza sativa
MATSTSAATAPLTCHHLGLRLRPRLPSLPLRPLSPSPSLSLSRPTPLTPSPPPRHRALHASASAAPAAPPSQPPKPVLQGAAIKPLVATIGTGVLIWLVPPPAGVARNAWQLLSIFLATIVGIITQPLPLGAVALLGLGAAVLTRTLTFAAAFSAFGDPIPWLIALAFFFARGFIKTGLGSRVAYAFVSAFGGSSLGLGYALVFAEALLAPAIPSVSARAGGIFLPLVKSLCEACGSRAGDGTERRLGSWLMLTCFQTSVISSAMFLTAMAANPLAANLTAGTIGQGIGWTLWAKAAIVPGLLSLVFVPLILYLIYPPEVKTSPDAPRLAKERLEKMGPMSKEEKIMAGTLFLTVGLWIFGGMLNVDAVSAAILGLSVLLISGVVTWKECLGEAVAWDTLTWFAALIAMAGYLNKYGLISWFSETVVKFVGGLGLSWQLSFGVLVLLYFYSHYFFASGAAHIGAMFTAFLSVSSALGTPPLIAAMVLSFLSNIMGGLTHYGIGSAPVFYGAGYVPLAQWWGYGFVISIVNIIIWLGAGGFWWKMLGLW

SEQ ID NO: 20287 - protein, 204 aa, Kigelia africana
GVYFGHDTRKWNPKMAPYISAKRKGIHITNLIKTARFLSEACDLVFDAASRGKQFLIVGTKNKAADSVARAAIKARCHCVNKKWLGGMLTNWSTTERRLQKFRDLRMEQKRGRLNRLQKRDAAAMKRQLSRLQTYLGGIKYMTGLPDIVIIVDQHEEYKALRECITLGIPTICLIDTNCDPDLANISIPANDDAISSIRLILNK

SEQ ID NO: 20288 - protein, 204 aa, Lathraea clandestina
GVHLGHGTRKWNPKMVPYISAKRKGIHITNLTRTARFLSEACDLVFDAASRGKQFLIVGTKNKAADSVVWAAIKARCHCVNKKWLGGMLTNWSTTETRLHKFRDLRMEQKTGRLNRLPKRDVAVVKRQLSRLQTYLGGIKYMTGLPDIVIIVDQHEEYTALRECITLGIPTICLIDTNCNPNLADISIPANDDAISSIRLILNK

SEQ ID NO: 20289 - protein, 393 aa, Unknown
  Rhodococcus sp. RHA1
MQRIVIVGAGLAGLRTAEELRRAGYEGDLVLLGGEPHLPYDRPPLSKEVMRGEKSDTTLKPREFFDEKNIQLRLGVEAVAVGSGSRILRLADGTELGYDELVIATGLVPRRIPGLPDLAGVHVLRSIDESLALRADLAEGKRALIVGAGFIGCELAASMRAGGLDVVLVEPQPTPLASVLGEKIGGLVARLHTGEGVDLRAGVGLTSLVGTDRVTGAVLGDGTEVDVDVVAIGVGSVPVTAWLDGSGVELDNGVVCDGVGRTAVPHVWAVGDVAAWQLRVGGRKRVEHWSNAGEQAKILAGALTGAGDENAAAQVPYFWSDQYDIKIQALGTVAATDEVHVIKDDGRKFLAYYERDGILAGVVGGGMAGGVMKMRGKIAAGTPIGEVLEAASA

SEQ ID NO: 20290 - protein, 204 aa, Ligustrum japonicum
GVHFGHGTRKWNPKMAPYISAKRKGIHITNLTRTARFLSEACDLVFYAASRGKQFLIVGTKKKAADSVAWAAIKARCHYVNKKWLGGMLTNWSTTETRVHKFRDLRIEQKTGRLNRLPKRDAAMLKRQLSRLQTYVGGIKYMTGLPDIVIIVDQHEEYTALRECITLGIPTICLIDTNCDPDLADISIPANDDATSSIRLILNK

SEQ ID NO: 20291 - protein, 638 aa, Trichodesmium erythraeum
MIETKRAIVVGAGSSGLIAAKELLDTGLDLTILEKEASLGGVWHKYCWKTSTLTSSKWMTEYGCYPAPKEYADFMKPEEMMEYLSSFTKHYGLEDKVHFGVQVKAIARSTDGKYDVITDGETYSGYDYVVISTGLHGEPVIRDVPGIEKFTGTIMHGFKYKDPEAFRDKKVVCMGLGESGIGISSEISSVAAKTVVAAGNFNFAPRVYPYSNKPFDQIQFWPMGQYIKDYQELLSAQMSWITRLPEPLRTAYANMHPWLRDLPKEWLPTAYVPHYWAGKYWPKPNNNFGDMSGNLTRPSTAPDDIIYLVHSGKITAKGKVERFDETGVYFPDGTREEVDMVVANTGFKPGAALIEFPDNWQYRHQELYKGCLHPDMPNLAFVGFVRPTIGSIPAMAEMQSRFVAQVFSGGYKLPEKEKLKKLIKKEADAHARKNPKMTERWPHIYFFDQWMEEMAELLGTQPKIWQHLSSWKQLQGFLFGAPMPIRFRQYGSGVVAGAKERYADRINQLYGTRPQSYIIPYLTISLFFPYILSLIISAVCYWGANLSPLISIGSGLLFYTLYMTVDLFRFVVGFLPITLPSLMALEQSLPWRNCDNDSMMFLMSFPEKDRMNYANPRVFENDGLPKSELLDREIAVKN

SEQ ID NO: 20292 - protein, 202 aa, Melasma scabrum
GVHFGHGTRKWNPKMAPYISAKRKGIHITNLTRTARFLSEACDLVFDAASRGKQFLIVGTKNKAADSVAWAAIKARCHCVNKKWLGGMLTNWSTTETRLHKFRDLRMEQKAGRLNRLPKRDAAVVKRQLSRLQTYLGGIKYMTGLPDIVIIVDQHEEYTALRECITLGIPTICLIDTNCDPDLADISIPANDDAISSIRLIL

SEQ ID NO: 20293 - protein, 141 aa, Unknown
  Malus x domestica
GVINRAYVGKKNKFVYGSISEESMHPDDSIPKCAGLVKPDLDVSSNGDEPTLACRMYGPNCYGGEPFFVAREPENPNVEEDDGYVVSFVHDEKTGESKLLVMDAKSPQLDIVAALKLPRRVPYGFHGLFVKESDLQKLNEN

SEQ ID NO: 20294 - protein, 327 aa, Arabidopsis thaliana
MGGSREFRAEEHSNQFHSIIAMAIWLGAIHFNVALVLCSLIFLPPSLSLMVLGLLSLFIFIPIDHRSKYGRKLARYICKHACNYFPVSLYVEDYEAFQPNRAYVFGYEPHSVLPIGVVALCDLTGFMPIPNIKVLASSAIFYTPFLRHIWTWLGLTAASRKNFTSLLDSGYSCVLVPGGVQETFHMQHDAESDDFLIELYLTLQNVFLSRRRGFVRIAMEQGSPLVPVFCFGQARVYKWWKPDCDLYLKLSRAIRFTPICFWGVFGSPLPCRQPMHVVVGKPIEVTKTLKPTDEEIAKFHGQYVEALRDLFERHKSRVGYDLELKIL

SEQ ID NO: 20295 - protein, 455 aa, Oryza sativa
MELTAEQLLLQRSEQLRELYSSLLSGECADQQRRRRPVTALSPEDLGNMEWFYMVCMTYAFRPGQWYTSLIYSIISKSFASNGCAWLCNAQSADSKAFPRKLLAKNASIQTIVCVPFMNGVLELGTTDPVPEEPNVVNRITTAFWEFQLLACSDEPISSGTPSSPSSPLTKETGDANTVLIDDLFLAHSAAGGDQEDHQLGNDLGQQQAATAMEIDDDMIYSLIRNWDNDSSSSWIELLDHVVVSPASCFVPWKRTELDKQAVAGGGEAAQRLLKKAVGGGGAWMNRAAGSSIKNHVMSERRRREKLNEMFLTLKSLVPSIDKVDKASILAETIAYLKELERRVQELESGKKVSRPPKRKPCSERIIGGGDAGAVKEHHHWVLSESQEGTPSNVRVIVMDKDELHLEVHCRWKELMMTRLFDAIKSLRLDVLSVQASAPNGLLGLKIRAKVVSLT

SEQ ID NO: 20296 - protein, 184 aa, Pseudomonas syringae
MMKLRFFSIPLLLLAMSGAAMAADCPPLLQGELPKLRAKENIDLCKRFAGKPLVVVNTASFCGFAPQFKGLEALSQRYKGQGLEVLGVPSNDFKQEAKDGEETAKVCYVNYGVTFTMTEPQAVRGDDATHLFKVLAEQSSAPRWNFYKYVVDRQGKVIANFSSMTKPDDPELIAAIEKAIASKP

SEQ ID NO: 20297 - protein, 307 aa, Unknown
  Nocardioides sp. JS614
MSAPESRRAFTFLVNPSSGGGAAPEAVVPVARLLREGGATVDVTYSPGPHAMVELVDQAVGRGDVVVSVGGDGMLSSLAGLVSERGGVLGVLPAGRGNDFARMLGLPEDAEGQARLLLEGAVRHVDLIAVTGLGRARRVVAGSVYAGVDARATEIVDRATWLPRRLQYPYAALRSLATYQAGRYVVAVDGIEHTYTAATVVVANSGYYGSGMKIAPAASVEDGRLDVVVIEAASRVALMRSLPKVYDGSHVALPEVTVLTGTRVELRGTSRSAIPVGGDGEPLGPLPTLDAAPAAVEILPGALAVLA

SEQ ID NO: 20298 - protein, 524 aa, Oryza sativa
MALKSPVDFAGSITSGQKDPCCFGVPGCNPRCVRYNKKSRTCRLVTRAISVDRPQLDFSNSDWKKQFQEDFDRRFSLPHLKDVIDVEPRPTTFSLKSRTPLENVNGSMQGSWNGYVNDDDRALLKVIKFASPTSAGADCIDPDCSWVEQWVHRAGPRKQIYFEPQYVKAGIVTCGGLCPGLNDVIRQIVLTLEKYGVKNIVGIQHGFRGFFEDHLAEVPLNRQVVQNINLAGGSFLGVSRGGANISDIVDSIQARRLDMLFVLGGNGTHAGANLIHEECRKRKLKVSIVGVPKTIDNDILLMDKTFGFDTAVEAAQRAINSAYIEAHSAFHGIGLVKLMGRSSGFITMHASLSSGQVDICLIPEVPFTLDGPNGVLQHLEHLIETKGFALICVAEGAGQEHLQQSNATDASGNMILGDIGVHLHQKIKAHFKEIGVHSDVKYIDPTYMVRAVRANASDAILCTVLGQNAVHGAFAGFSGITTGICNTHNVYLPISEVIKSTRFVDPNSRMWHRCLTSTGQPDFH

SEQ ID NO: 20299 - protein, 104 aa, Campylobacter upsaliensis
MGKYIELTSENFATAKEGVALVDFWAPWCGPCKMLSPVIDELASDFEGKAKICKVNTDEQGDLAAEYGVRSIPTLIFFKNGEVVGQLVGAQSKQTIADKINSLL

SEQ ID NO: 20300 - protein, 332 aa, Desulfovibrio vulgaris
MNLAVFPRRGYVKDPTPIESCPAFSKALGGKVNIFIKRDDLLPGCAGGNKTRKLDFCMADALAKGADTIITCGAVQSNHCRLTLSWAVKEGLDCHLVLEERVKGSYKPEASGNNFLFKLMGVKSITVVPGGSNMMGEMEALAARLKEAGRTPYIIPGGASNPIGATGYVSCAQETLQQLFDMGLKVDHMVVPSGSAGTHAGIVVGMVGNNANIPVSGINVSRTKADQEALVRKLARETAQRVGMSGEFPDEAVTCFDGYVGPGYSLPTESMVEAVRLLAQTEGILLDPVYSGKAMAGLVDLVRSGYFAEGSNVLFLHTGGSPALYAYLDTFK

SEQ ID NO: 20301 - protein, 639 aa, Hevea brasiliensis
MDSLSIRVPYRNLKKEVEVEMVGVEEQNHHSIQLDNSSPSSASSPNSASQIPNGDSGFSVRSKTAKHYSLITLILSCTVAAGVQFGWALQLSLLTPYIQTLGIEHAFSSFIWLCGPITGLVVQPCVGIWSDKSTSKFGRRRPFILAGSVMISVAVIIIGFSADIGYILGDTKEHCSTFKGTRTRAAFVFVIGFWLLDLANNTVQGPARALLADLSGPDQRNSANAVFCSWMAVGNILGFSAGASGSWNRWFPFLMSRACCEACGNLKAAFLVAVVFLTLCTLVTLYFAKEVPLITNQSHRLSDSAPLLDDPQQNGLELSKSKSEVSILSNSNGNINKGIEQNVNPKPGIANSIEDQNESLGDGPGAVLVNLLTSLRHLPPGMHSVLVVMALTWLSWFPFFLFDTDWMGREVYHGDPKGNSDEVKLYDQGVREGAFGLLLNSVVLGISSFLIEPMCQRMGPRLVWAMSNFIVFASMAVTAIISLISIGEYSGGIEHVIGASLSIRIAALIVFAFLGLSSCCTYMFYQNNSNVLQLLPLKACANCYVLQITYSVPFSVTAELTADSGGGQGLAIGVLNLAIVIPQMVISLGAGPWDALFGGGNIPAFALASVCALAAGVIATLKLPNLSSSSFKSSGFHFG

SEQ ID NO: 20302 - protein, 1432 aa, Saccharophagus degradans
MNAIRNMLKVSTLILLAVGLYACGGGSTVESGKELLTCSVPQVPNSAGTECVDPEPIQCAIPTVPDEKNETCIVGANPDAPDPIVFPGPNQAILFFNKADGDYEGYRLHNWNSETCNAYAEGSLAASWSNGLVHSGVDPVYGAYWLLDLVEGHDDCGHFIIHVGTDDAGKEMGGGDWIMPLAQDDPKFTRMNFTFSGVGSVFEFPVPSLGPQKVAIAGAAAHWLDIDTLVWNLDTTDVADVKLHYSATAGITVDDDSNVSGSTADLTFATLSEELQQLVPHMASWPAFGNMLTASDVKPIVKGQLIAVAYNADGKAIAATKVQRARVLDALYTAGENDADEATLGVVYDGANINVSVWAPTATSVTLRVFDAAKTEVSSHTMNEDTSTGIWSFAGDSNLDRVFYQFELSVFHPLTQAIETVTTSDPYSVSLSTNGEYSQFVNLADDDLLPENWNGHTVPTIANFEDAVILEAHIRDFSIRDETVSEANRGKYLAFTETESNAVKYLQRMAESGVTHFHMLPANDIATVNEDESEQINLTSTVAELCAVKADAPVCGEESDSATLISVLESYQYEPLAAQALVESMRSLDGFNWGYDPHHFNAPEGSYASDPDGVARIKEMREMNKALHDLGLRVVLDVVYNHTSASGLWDNSVFDKVVPGYYHRYDENSGGIITSTCCDNTAPENRMMHKFVVDSLVLWAEAYKFDGFRFDIMGHIPKSTILEAREAVLAVDPNTYFYGEGWNWGEVENNRLFVQATQANMAGTEVGTFNDRPRDDIRSAALFNEDGSLDAQDHIRLGLAGTQADFILESNRGNMGTGSTYARASYGLDPADIINYVSKHDNETLWDQLQYGLPESMSLEDRVRAHNIAATIPVMSQGIPFFQLGVDMLRSKSMDRNGYDAGDWFNFVDYTMASNNWDVGLPLAQDNEVRWEEIDAISGRISAPGMFELDYSSQVFSEFLQIRKSSPLFRLTTSADIIDRVGFHNIGNRQQQGLIVMSIDDGTGLADLDPANDAIVVVINGTNESQSHTVATAAGFQLHSIQQSSVDSVVAGSTFTAGEGEGTFTVPALTTAVFVKPQGEAQGAGLSADVTQGAPDVVPFGDTVVYIRGDMNTWSTDNPLTYAGNGVYSTTIALTGGTTYGFKFADAEWGALGVNFGGAEGGDGVVTEGVDKNLFATNTNLSFTPAVDATYVITFDASDSAAPVANIVNEEPYPGSTILLRGDMNSWGETDAFTYEGGRIYTFETTLDAGTYGFKVATGDWNTVNFGAAAEDENVVSLGENVYLGSTNFNLSLTLAESTELVFIFDMTNLDEPKLRVMNKAFFGDTAVYIRGDMNSWGATDEVAYVGDGAYATTLTLAVGSYSFKVADADWADVNFGPTSAEAAPIVLGATNATLFNSPNNFSLTVETAGDFTFTVTGPDATNPSLTVTAAN

SEQ ID NO: 20303 - protein, 130 aa, Unknown
  Oceanospirillum sp. MED92
MSDFLKILTRKNSLRKQCHDLSVAELEKVISDLTVITEDKRAEEEAVLAAEQEKAAKIESIRQSMQDAGVDINDLMSLIGETAAPKKKVQPKYRIVDDEGNEHEWSGRGRTPLAFQAYFDKGFTKDDCLI

SEQ ID NO: 20304 - protein, 302 aa, Triticum aestivum
  misc_feature (191)..(191): Xaa can be any naturally occurring amino acid
  misc_feature (203)..(203): Xaa can be any naturally occurring amino acid
  misc_feature (250)..(251): Xaa can be any naturally occurring amino acid
  misc_feature (279)..(279): Xaa can be any naturally occurring amino acid
MDPCPFVRVLVGNLALKMPVAPRPAGAGAGVHPTTSPCYCTIRLNKLPLQTAAAPLLPSDDMTQGPAATGALAAAFHLSKADLDRVTAKPSLFVARSARLKVAVYAGRRGTTCGVNSGRLLGKVVIPLDLKTAVGKPIVFHSGWLSINKRGRKASAVSGSAQLNLTVRAEPDPRFVFQFDGEPECSPQVLXVQGGMMQPMFTXCKFSCRSNSDLRSRSMHSDPGSGSRHWLMSFGSDRERPGKERKGCSXXVHDLSGSAVALASMVTPFVRPRLDRVSXVNPGAGLYPPRGGIGPGGPLECG

SEQ ID NO: 20305 - protein, 298 aa, Magnetospirillum magnetotacticum
MTEPAPPSSLPVVRVPARPGPPLRFQLRPVAPSLRSFLATEAGGAVLLLAATVVALVWANSAWSGAYDALWSTEAGWRVGPWAFEMDLHHWVNDAAMAVFFLVIGLEINREVTSGELRNRRTVAVPALGALGGLAVPALIYVAFNAGSPAEHGWGIVMSTDTAFLVGILALFGPRCPDQLRLFLLTLAVVDDIGAITVMALFYTDDLWLPGLLVAAVLVVVILVLRWLGVWRLAPYALAGIALWGAVYASGVHATLAGVLVGLLVPSRSSRPVDVAVVPKYAKRLAQETTAEREHGIL

SEQ ID NO: 20306 - protein, 520 aa, Streptomyces avermitilis
MRLGGVGMTEGDQVRRERVPHVRVAVIGSGFGGLGAAVRLRREGVTDFVVLERADSVGGTWRDNSYPGCACDVPSHLYSFSFAPHPDWPRTFSGQEHIRAYLEHVTDTFRLRPHLRFNSEVKRMTWDADQLHWTVETATGTLTADLVVSATGPLSDPRIPDVPGIETFPGKVFHSARWDHDYDLRGKRVAMIGTGASAIQIVPEIQPRVAKLTLFQRTPPWVMPRVDRAIGRAERGLHRMLPFTTQVRRGLLWGIRELQVQAFTKHPDELGLVERLARRNIARAIEDPGLRARLTPDYRIGCKRILLSNTYYPALARPNVDVVASGLAKIDGSTLVAADGSSAEVDAIVFGTGFHVTDMPIAERVVGADGTSLAQSWSGGMKALRGASAPGFPNWMSIIGPNTGLGNSSMILMIESQLNYLADFIRQLDVLGGKVALDARPGAVHAWNSKVQERMRRTVWNTGGCTSWYLDANGVNTTVWPGTTTEFRNATRRVDLAEYEVVRAPRPAAAGVRAKAEADA

SEQ ID NO: 20307 - protein, 423 aa, Alkalilimnicola ehrlichei
MFLECNPRFVSRLTRDTLALIMAGGRGGRLSNLTDWRTKPAVPFGGKFRLIDFPLSNCINSGIRRIEVLTQYKAHSLIQHIQRGWGFLRGEFGEFVELVPAQQRMDKPLWYAGTADAVYQNIDIIKAHNPSYVLVLAGDHVYKMDYGGMIARHAESGAAMTVGCVEVPRKRASAFGVMSVNEERQVLAFNEKPKDPTPMPGNPDRALVSMGIYVFDRDYLFQLLREDAENFDSSRDFGKDVIPNAIANHKVQAYPFSDPVSGQQAYWRDVGTVDAFFQANMELIGEDPELNLYDEEWPIWTYQAQLPPAKFIQGRDGRHGTAINSMVSGGDIIHGAEVRDSLLFSQVVVQPGATVHEAVILPDVRVGEGCRIRKAVIDEGCRIPAGTVIGEDPAEDRRRFFVTPKDVVLVTAEMLGQEVAHVR

SEQ ID NO: 20308 - protein, 236 aa, Zea mays
MDSRGAGRGSCDQIGRLTSLTRESGPPRLSSSTNKATTIPTQTHRPTTGAAMSTADAASPALAPDWDAPAGEGLALAQFAAGCFWSVELVYQRLPGVARTEVGYSQGHRHAPTYRDVCGNGTGHAEVVRVHYDPNACPYDVLLDVFWAKHNPTTLNRQGNDVGTQYRSGIYYYTAEQETLARESLAAKQKEWQDAIVTEVLPARRFYPAEEYHQQYLEKGGQSAKKGCSDPIRCYG

SEQ ID NO: 20309 - protein, 561 aa, Coxiella burnetii
MTNKLLERAIQQHQQGSLKNALENYHKVLEDDPKQTAALHGAGIALSQLGRNDEALHYIDRALLLEPQNATFQNSRGNILSQHGKLVEATIAYDQAIQLQPDHATAYNNIANCFFRQKKFDNAKKAYQKAIALKPHFANAHFNYARLLIELENYHQAIAELKRTVAMSSHHSAAFSQLAHVYMYLGDFSKAITYYEKRLALEPENADAQYDCGLAHLKDNQFQKAIDYFTNALLLNPEHPDCHYSLATAYLQRGDHKEALLHYLRQLEKKPQIECYYNVGVLHMYQERHREAIDYFKQALTLDPNYREAHLNIAAVYLKINQIKQAIEHYESTLVLKPNDSEIEHILTALQKKEAPPRAPDSYVRHLFDEYATYYDQHLTLHLQYQVPQKLYQAVETEWNGGKAEWRILDLGCGTGLCGELFKPMAKELIGIDVSEKMLITAGNKNIYDKLENQTLQEALNNHQGFNLILAGDVFTYIGELDDIFEKVKKALAAKGLFALTVEKTHQFPYELLQTIRYAHSKKYIIALIKRNNFKLLRFDNIVLRNQKGKAIEGYLVLLGL

SEQ ID NO: 20310 - protein, 921 aa, Oryza sativa
MASKGTEGGHGGVERKEQQQQRGYQLPRDSRGSLEVFNPSSASSFRTAAAAPKSASPFLAIPDREEDNVVAQQRAAEWGLVLQTDHHTGLPQGVSARPSSGSARTSSEDNPQQQQSAAAIPRVSEELRAALSVFQQTFVVSDATHPNHPIMYASAGFFNMTGYTSKEVVGRNCRFLQGSGTDPHEIDKIRQSLANGSNYCGRILNYKKDGTPFWNLLTIAPIKDEDGRLLKFIGMQVEVSKYTEGKKDTVVRPNGLSESLIKYDARQKDHARSSVSELLLALKNPRSLSESSNNTLKRKSQESLSMSMTEVPSKRSSESGSRRNSRSGTRSSLQKINEVPDQGNRTRKSGLRAFMGFLGMGHGSVEKNMLKPRDEDPLIDSDDERPESFEDEFRRKEMRRGIDLATTLERIEKNFVITDPRLPDNPIIFASDSFLQLTEYNREEILGRNCRFLQGPETDRATVRKIRDAIDNQAEVTVQLINYTKSGKKFWNLFHLQPMRDQKGDVQYFIGVQLDGTEHVQDDAAKEGVVLVKKTADNIDEAAKELPDANLRPEDLWANHSKVVLPNPHMKDTASWRAIQKVLESGESIGLKHFRPVKPLGSGDTGSVHLVELLNTGEYFAMKAMDKSIMLNRNKVHRATAERQILDLLDHPFLPTLYASFQTKTHICLITDYCPGGELFVLLDNQPLKVLHEDAVRFYAAEVVVALEYLHCQGIIYRDLKPENILLHRDGHISLTDFDLSCLTSCRPQVFLPEDADEKKGRKNGSYPIFFAEPMRASNSFVGTEEYIAPEIITGAGHTSAVDWWALGILLYEMLYGYTPFRGKTRQRTFANILHKDIRFPASISVSLAARQLMYRLLHRDPANRLGSYEGANEIKGHPFFRGINWPLIRATAPPKLEIPLFSKDDMEKKGLVTNTRTDMF

SEQ ID NO: 20311 - protein, 523 aa, Oryza sativa
MASSAPSAPGLAPVAKPPPPPSKVKVATATVPTNGKIKQGARPMRVSAPPVEPRRRMNPLQRLAAAAIDAVEEGLVAGLLERGHALPRTADPAVQIAGNYAPVGERPPVRGLPVSGRLPACLDGVYVRNGANPLHAPRAGHHLFDGDGMLHAVRLAGGRAESYACRFTETARLRQEREMGRPVFPKAIGELHGHSGVARLLLFGSRALCGVLDASRGIGVANAGLVYHDGRLLAMSEDDLPYHVRVTHDGDLETVGRYDFHGQLDADGTMIAHPKLDPVTGELFALSYNVVSKPYLKEKASRFGVLPKRAADASELRWVEVPGCFCFHLWNAWEDDATGEIVVIGSCMTPPDAVFNEPSQSPEEESFRSVLSEIRLDPRTGVSRRRDVLRDAAEQVNLEAGMVNRQLLGRKTRYAYLAIAEPWPRVSGFAKVDLESGTAEKFIYGEGRYGGEPCFVPRAGAAAEDDGHVLCFVHDEERGTSELVVVDAGGEAMEEVAAVKLPGRVPYGLHGTFIGANELQRQA

SEQ ID NO: 20312 - protein, 187 aa, Oryza sativa
ASSSSLDQLMYLLSPRNGDEEDEQEEIQELISDDEPPNLKLASCATAASSSSSSGSDMEKGRGKACGGGSTAPPPPPPSSSGKSGGGGGSNIREAAASGGGGGVWGKYFSVESLLLLVCVTASLVILPLVLPPLPPPPSMLMLVPVAMLVLLLALAFMPTTTSSSSSAGGGGGGGRNGATTGHAPYL

SEQ ID NO: 20313 - protein, 206 aa, Zea mays
  misc_feature (22)..(22): Xaa can be any naturally occurring amino acid
MEVKLWNDKRERELLESYADLXKLERAYVRDLVSAADYEAECLKLISQFNSLSSSLAGAVTVPRFVQAYRLDCPAALNRLLQSGVPATVELRAASASSAPAATAASASAIAHCVQTFITAMDAVKLNMLANDQVRPLLQDVATSMARLGSLLPPDFEGKVKVNEWLGKLHKMGAADELTEQQARQLNFDLDSAYSAFLAALPAAGL

SEQ ID NO: 20314 - protein, 185 aa, Methylobacillus flagellatus
MVVLEGNPDLILQRSTLVSSEEEVKQAVTRVAQEITATLRQDQPLVLCVMGGGVVFTGQLLPQLVFPLEFGYVQATRYHNRTHGDAQLVWKMKPGEEVRGRTVLLLDDILDEGVTLAEIKAQCLALGASKVVVAVLVEKMLGRVKPIRADFVGLEVPDQYVFGCGMDAYGWWRNLPAIYAMQGEA

SEQ ID NO: 20315 - protein, 209 aa, Alteromonadales bacterium
MTNKKQSASSQRWLKEHFDDKYVQEAQKKGWRSRAVFKLDEVQNRDKLLRPGMTVVDLGAAPGSWSQYLAEKVGDKGQVVACDILPMDSLAGVDFLQGDFREEAVLDALLKRIDGKNVDVVLSDMAPNMSGNNSVDQAGSMYLVELALDMCNQVLKKNGAFIVKVFQGEGFDQYLQEVRNSFKAVKIRKPDASRARSREVYIVATGYKL

SEQ ID NO: 20316 - protein, 323 aa, Aspergillus nidulans
MAAYKSIRVASVALVVDIMQIFVKTLTGKTITLEVESSDTIDNVKTKIQDKEGIPPDQQRLIFAGKQLEDGRTLSDYNIQKESTLHLVLRLRGGMQIFVKTLTGKTITLEVESSDTIDNVKTKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKTKIQDKEGIPPDQQRLIFAGKQLEDGRTLSDYNIQKESTLHLVLRLRGGN

SEQ ID NO: 20317 - protein, 204 aa, Orobanche corymbosa
GVHFGHGTRKWNPKMAPYISAKRKGIHITNLTRTARFLFEACNLVFGAASRGKQFLIVGTKNKAANSVAEAAIKARCHCVNKKWLGGMLTNWSTTETRLYKFRDLRMEQKAGRLNLLPKRDAAVVKRQLSRLQTYLGGIKYMTGLPDIVIIVDQHEEYMALRECITLGIPTICLIDTNCDPDLADISIPANDDAISSIRLILNK

SEQ ID NO: 20318 - protein, 544 aa, Mesembryanthemum crystallinum
MVQFGDMENDEGGPSNARGSDPFIDRSKVRILLCDNDSKSCEEVFGLLSNCSYQVTAVRSARQVIDALNAEGPDIDIILSEVDLPTKKGLKMLKYIMRDRDLQRIPVIMMSTQDEVSLVVKCLRLGAADYLVKPLRTNEMLNLWTHMWRRRQMLGLAEKNIVNYDFDLAASDHSDANTNSTTLFSDDTDDRSRRGVNLEMSMTIQEEDESNKATSDPMPADLFDCRPDVPGICDRRTGQFVPFAKKSELKIGECSAFFTYVKSSAVKNNCQAADVEVNHAQPSRLEDKSERLNEVVNNGNMRCENGETWENNSNEDFRSSTSVPDSTSMERSCTPVSLDFMPNKSMDEGLSQVHMNSRNGAHFDVSGLAHSAYPYYMSGMMNQVMMSSSAHMYRKDLQEHGTSAVMPHYNHLSHCPPHVPGMAPPYTYYPLNLCIQQGQLPSNHQMPSFGNSSSSEVKLREVDRREAALIKFRQKRKERCFDKKIRYVNRKKLAERRPRVRGQFVRKVNGVTVDLNGDPSPADLDDEDEDDDDPRDSYAEDDAT

SEQ ID NO: 20319 - protein, 498 aa, Nostoc punctiforme
MHLKSQESPVTEKSYTRADWQGGYQSLTQEFDYWIDDIEGQIPRELEGTLFRNGPGLLDVNGQFLHHPFDGDGMISKITFTNGRAHFRNRFVRTTGYLAEQKAGKILYRGTFGTQKPGGWRVNIFDFKLKNIANTNVIYWGGKLLALWEASEAYCLDPYTLETLGNEYFNGALSAGEAFAAHPRLQRNCEQDGGEPRLVNFSIKPGLSTTITIFELNLAGEIVRQQAHKVPDFCFIHDFVITPNYCIFFQNPVTFNPIPFALGIRAAGECIKFQPNQPTKIIIIPRFPKEGQEEIKFLETQSGFVFHHVNAFEVGEEVLIDSICYQDLPEVEPKSDFRQVDFEASSPGQLWRFYLNLKNGTVQRELIDSRCCEFPSIDPANVGHPYRYLYIGAAHAESGNAPLQALLKIDLHSGEKQFWSAAPRGFVGEPIFVPRPDSEKEDDGWVLALVYNAAHHRSDLVILDASDFSKGTIARLHLKHHIPYGLHGSFTSEVFGEI

SEQ ID NO: 20320 - protein, 204 aa, Orobanche ramosa
GVHLGHDIRKWNPKMAPYISANRKGIHITNLIKTARFLSEACNLVFDAASRGKQFLIVGTKKKTANSVACAAKKARCHCVNKKWLGGTLTNWSTTESRLHQFRDLRIEQKMGRFKRLPKRDAAVSKRQLSRLQTYMGGIKYMTGLPDIVIIVDQHEEYTALRECITLGIPTICLIDTNCDPDLADLPIPANNNSIFSIRLILNK

SEQ ID NO: 20321 - protein, 420 aa, Oryza sativa
MCSFCPDGWQSVPGKSFASNGCAWLCNAQSADSKAFPRKLLAKNASIQTIVCVPFMTGVLELGTTDPVSEEPNVVNRITTAFWELQLPACSDEPISSGTPSSPSSPPTKETGDANTVVIDDLFLAHSDAILPAGGDQKEEHQLGDDLGQQQAATAMEIDDDVIYSLIRNWDNDSSSSWIELLDHAIVSPASCFVPWKRTELDKEAVAGGEAAQRLLKKVVGGGGAWMNRAAGSCSIKNHVMSERRRREKLNEMFLILKSLVPSIDKVDKASILSETIAYLKELERRVQELESGKKVSRPAKRKPRSETIIGGGGGGGGAGAVKEHHHWVLSESQEGTPSDVRVIVMDKDELHLEVQCRWKELMMTRVFDAIKSLRLDVLSVQASAPDGLLGLKIRAKYASSAAVVPAMISETLRTAVAGY

SEQ ID NO: 20322 - protein, 248 aa, Alkalilimnicola ehrlichei
MANVSMRDMLEAGVHFGHQTRYWNPKMAPYIFGQRNKIHIINLEKTLPLYQEAMNYVGRLAAEGGKVLFVGTKRSARKAVREEASRCGMPYVDHRWLGGMLTNFRTVKGSIRRLKDLEAQAEDGTFDKLTKREALSLSREMEKLNRTLSGIKDMNGLPDAMFVIDVGFEHIAVQEARKLGIPVVAVVDTNNSPREVDYVIPGNDDAIRAIQLYLSGAADAVLEAKTATARPGGDDDFVEVDEATEQQG

SEQ ID NO: 20323 - protein, 199 aa, Pedicularis foliosa
GVHFGHGTRKWNPKMAPYISAKRKGIHITNLTRTARFLSEACDLVFDAASRGKQFLIVGTKNKAADSVAWAAIKARCHCVNKKWLGGMLTNWSTTETRLQKFRDLRMEQKMGRLNRLPKRDAAVVKRQLSRLQTYLGGIKYMTGLPDIVIIVDQHEEYTALRECITLGIPTICLIDTNCDPDLADISIPSNDDAISSIR

SEQ ID NO: 20324 - protein, 376 aa, Listeria monocytogenes
MAKRDYYEVLGVSKSASADEIKKAYRKLSKQYHPDINKEAGADEKFKEISEAYEALSDPQKRAQYDQYGHVDPNQGFGGGAGGGFSGGGFSGFEDIFDTFFGGGGRQQDPNAPRQGSDLQYTMRLKFKEAIFGKDAEIEIPREENCDTCHGSGAKPGTTPEKCSHCGGKGSINVEQNTPFGRVVNKRTCQYCNGTGKEIKEKCPTCHGKGRVTKTKKIKVKVPAGVNDGQQMRVSGEGEAGINGGPNGDLYVVFVVIPDEFFEREADDIYVEVPITFVQATLGDEIDVPTVHGKVRLKIPSGTQTGTTFRLRGKGVPHLRGNGTGDQHVIVKVIVPKKLDDKQKEILREFASTTGDKVDEQTSGFFDKMKRAFKGD

SEQ ID NO: 20325 - protein, 447 aa, Methylobacillus flagellatus
MKYQSAHDFLAVVAQKNPGQPEFLQAVTEVVESLWPFISANPRYAEHGILDRLVEPERAILFRVSWVDDKGEVQVNRGYRIQHNGAIGPYKGGLRFHPSVNLSILKFLAFEQTFKNALTTLPMGGGKGGADFDPKGKSNGEVMRFCQAFISELFRHVGSDTDVPAGDIGVGAREIGFMTGMIKKLTNRADCVLTGKGLSYGGSLIRPEATGYGTVYFAEEMLRHSGRTIAGMRVAVSGSGNVAQYAIEKALALGAKVITASDSSGTVIDEAGFTAEKLQILMQVKNVEYGRIKDYAERVGALYVPGGSPWSVKAEVALPCATQNELTKADAATLIANGVLCVAEGANMPCTAEAMKLFDEHHILYAPGKATNAGGVATSGLEMTQNAMRLSWTREEVDARLFDIMKGIHDACVQYGTREDGSVNYVDGANIAGFVKVAEAMLAQGVV

SEQ ID NO: 20326 - protein, 204 aa, Parentucellia viscosa
GVHFGHGTRKWNPKMAPYISAKRKGIHIINLTRTARFLSEACDLVFDAASRGKQFLIVGTKNKAADSVVWAAIKARCHCVNKKWLGGMLTNWSTTETRLHKFRDLRMEQKTGTLNRLPKRDAAVVKRQLSHLQTYLGGIKYMTGLPDIVIIVDQHEEYTALRECITLGIPTICLIDTNCDPNLADISIPANDDAISSIRLILNK

SEQ ID NO: 20327 - protein, 135 aa, Unknown
  Malus x domestica
MARTKQTARKSTGGKAPRKQLATKAARKSAPTTGGVKKPHRYRPGTVALREIRKYQKSTELLIRKLPFQRLVREIAQDFKIDLRFQSHAVLALQEAAEAYLVGLFEDTNLCATHAKRVTIMPKDIQLARRIRCER

SEQ ID NO: 20328 - protein, 72 aa, Bacillus clausii
MAKEDVIEVEGTVIEPLPNAMFRVELENGHKILAHVSGKIRMNFIRILPGDKVTVELSPYDLTRGRITYRYK

SEQ ID NO: 20329 - protein, 828 aa, Salmonella typhimurium
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPMLRMKDGSYHKDGEFTPVSWEQAFDVMEEKFKTSLKEKGPEAIGMFGSGQWTIWEGYAAAKLFKAGFRSNNIDPNARHCMASAVVGFMRTFGMDEPMGCYDDIEQADAFVLWGSNMAEMHPILWSRITNRRLSDPNVKVAVLSTFQHRSFELADNGIVFTPQSDLVILNYIANYIIQNNAVNQDFFTKHVNLRKGATDIGYGLRPTHPLEKAAKNPGSDASEPMSFDEYKAFVAEYTLDKTAEMTGVPKDQLEQLAQLYADPNKRVISYWTMGFNQHTRGVWANNLVYNLHLLTGKISQPGCGPFSLTGQPSACGTAREVGTFSHRLPADMVVTNEKHRDICEKHWQIPAGTIPAKVGLHAVAQDRALKDGKLNVYWVMCNNNMQAGPNINEDRMPGWRDPRNFIIVSDPYPTVSALSADLILPTAMWVEKEGAYGNAERRTQFWRQQIKAPGEAKSDLWQLVQFSRRFKTEEVWPEALLAQKPELRGKTLYDVLFATPAVSKFPLSELKEDQLNDESRELGFYLQKGLFEEYAWFGRGHGHDLAPFDDYHNARGLRWPVVEGKETQWRYSEGNDPYVKAGEGYKFYGKPDGKAVIFALPFEPAAESPDNEYDLWLSTGRVLEHWHTGSMTRRVPELHRAFPEAVVFIHPLDAKARDLRRGDKVKVSSRRGEVISIVETRGRNRPPQGLVYMPFFDAAQLVNNLTLDATDPLSKETDFKKCAVKLAKV

SEQ ID NO: 20330 - protein, 263 aa, Oryza sativa
MAEHLASIFGTEKDRVNCPFYFKIGACRHGDRCSRLHNRPTISPTVVFANMYQRPDMITPGVDAQGQPIDPRQMQEHFEDFYEDIFEELSKFGEIENLNVCDNLADHMIGNVYVQFREEDQAAAAHTALQGRFYSGRPIIVDFSPVTDFREATCRQLGLGRDLRKKLFGHYRKPQRGRSRSPSPSPRHRRERHDRDDYRGRDDYSGGGGRRGGSSRHERHDDGGRRRHGGSPPRRARSPVRESSEERRAKIEQWNRERDEKQG

SEQ ID NO: 20331 - protein, 203 aa, Rhinanthus cristatus
  misc_feature (10)..(10): Xaa can be any naturally occurring amino acid
  misc_feature (115)..(115): Xaa can be any naturally occurring amino acid
GVHLGHGTRXWNPKMAPYISAKRKGIHITNLTRTARFLSEACNLVFDAASRGKQFLIVGTKNKAADSVVWAAIKARCHCVNKKWLGGMLTNWSTTETRLHKFRDLRMEQQMGRLXRLPKRDAAVVKRQLSRLQTYLGGIKYMTGLPDIVIIVDQHEEYTALRECITLGIPTICLIDTNCDPNLADISIPANDDAISSIRLILN

SEQ ID NO: 20332 - protein, 195 aa, Acidobacteria bacterium
MRKATLDRNTAETKIHLELHVDGKGKYEISTGIRFFDHMLELFTRHGAFDVTLRCEGDLDVDQHHTVEDVGIALGQAFTQALGSKMGILRAGYFVMPMDETLAVAAVDLSGRSAYAVDTKVKVRIVGDLQTELVDDFFEGFSRGALANVHIKVMYGRSNHHKIEASFKAFARALRFACAKDKRLAKVLPSTKGLL

SEQ ID NO: 20333 - protein, 136 aa, Craterostigma plantagineum
MARTKQTARKSTGGKAPRKQLATKAARKSAPSSGGVKKPHRYRPGTVALREIRRYQKSTELLIRKLPFQRLVREIAQDFKTDLRFQSAAVGALQEAAEAYLVGLFEDTNLCAIHAKRVTIMPKDIQLARRIRGERA

SEQ ID NO: 20334 - protein, 137 aa, Bdellovibrio bacteriovorus
MSEEKKPYELLGGEEVLRQLCKRFYEIMDTIPEAKGIRDMHPGNLRGSEEKLFMFLSGWLGGPGLFVEKYGHPRLRMRHFPFKIGKSERDQWMMCMVQAFDELNIAEPLRSELLHSLLRLADHMRNVEEPESSENAD

SEQ ID NO: 20335 - protein, 265 aa, Oryza sativa
MAEHLASIFGTEKDRVNCPFYFKIGACRHGDRCSRLHNRPTISPTVVFANMYQRPDMITPGVDAQGQPIDPRQMQEHFEDFYEDIFEELSKFGEIENLNVCDNLADHMIGNVYVQFREEDQAAAAHTALQGRFYSGRPIIVDFSPVTDFREATCRQLGLGRDLRKKLFGHYRKPQRGRSRSPSPSPSPRHRRERHDRDDYRGRDDYSGGGGRRGGSSRHERHDDGGRRRHGGSPPRRARSPVRESSEERRAKIEQWNRERDEKQG

SEQ ID NO: 20336 - protein, 1468 aa, Ustilago maydis
MPYSSQQNGYTSASTSRLSEQTSSHSRSSREDRHLTEKGRRPPSPEARHRSDRDYDRRRSTEYVRDDDYRRSSRSSHDSRYADAYDHWRSARSAYSPTPRDDRRDEARNDLSSTKRHRSPEHSTSRLRHRSPESAHRRQNGTANRLDSKPDRGGDRKTGEALDSGRSRWSQRAYEYDDWRNERPSARYERYRHDREPHRSRREDEYETKRSRDDSNGNSIYAPTRRSRSRSRSRSRSRDRYRSRDHSRERRRERSRDRSNGTYSSRDDRRPKADRSAHTIKRDEHSTRLNGTSEDSKDLRHESQRRVSASVQSASEGPASTPVARAVYIKHAEVDQEAPAPPTTRDYHSCPQRWPDQADSAVRASSAPNGSATAPSRSDRPPANGSSGRHSPRSLPTREKAEEARTSSTRRPSSQTNDNVNNSRDPLTQRKATSERSFGHVLLPHELPVECRGKNYMATATYKEGVKSIYKSAADKHLVDVDTRDPRRLGKKSSRYRESLHSASFRWDSNSRGKKPLPPPRNLVLTNLSGLLQPHQILLHILPHGRIESSKLEIDPKIGQSLGIFRVTFAHDFDEHGKPLESMPAGQNPQHGAKVAKAACLALNGRMIGQTRAQAFLDRDGEVIAERIKAKLAENEHKLRPTIVPPAPPAAASSSPATPSTTKQSMPPPQVPRGPKVFMPAAPSPSYASSPASARANTDRYEYSATSHSRYRSSYEESRKLASSETYHRRRGTEEYDTYNRSKPYADAQVPAGSRSETRKDIKRPDEEILNELRDKKRPYVHIPRPKNCDIDVTSVEAQLRSTAPIWVREGQKGFYAAFHTSKEANQCKVVNETLTIGGYTLQVDVRSAPSQHAPSQQIRTPSGKHASVPLSMPAPPKQERKAIDTGLRPPTADEKLKVDWSAAELQDAVFRMLQKELADTFVRDVKSRVVGPYLTAYLKPDGEGGKMLAKATMKKPVIPTSINDHGTTLFEATGEARLPSFRKLAGAHPKKKASDADTTTSQAKRDQTDAKKKRGHTHRSKVHRDRDVSSSENESDDMERGMVVAARRNSYTRSKSSTKRRGAAAWLLEASDAEAGTDDVDSTETDALSRSVSASVEPTGEEQIEVDVGAKAKKIPKVKAATVSKKKGTTAARKKLDVAPPEAVVEADQGSETATPETDVPIKTAAAKAKVKPAKTSAKAKSALVDPFEAGLVEDSEDCHYLRLALEHLSRTGELASEHTLPDEIELEVEAEEQAMAAGGIPKHSTGSARTEGYYRIPPEQKAMHLPDRNKATEDVDTSSNAQILQSARNNRADSRRLVLGIEQHKRETATDTDIFKFNQLRTRKKQLKFAKSPIHDWGLYAMELIPAGDMVIEYVGEVVRQQVADEREKQYERQGNFSTYLFRVDDDLVVDATHKGNIARLMNHCCTPNCNAKILTLNGEKRIVLFAKTAIRAGEELTYDYKFQSSADDEDAIPCLCGSPGCRRFL

SEQ ID NO: 20337 - protein, 174 aa, Archaeoglobus fulgidus
MARKPARMWRRLERPYTRTEYIDGAPGTRVRMFDMGNKSADFPVMLTLVAKEAVQIRENALEAARVVANKYVSRRAGASNYKLKLRIFPHHILREHKMAVGAGADRISQGMRAAFGKPVGRAARVKPGTKIMSVWVKPEHFEIAKEALRRAAMKMPTPTKIVVEKGHELLKGKI

SEQ ID NO: 20338 - protein, 137 aa, Glycine max
MADSKSGLRKPVFIKVDQLRPGTSGHTLTVKVVNAKMVMQRGRSDGPQSRQMQIAECLVGDETGMIIFTARNDQVDTMTEGATVILRNAKIDMFKGSMRLAVDKWGRVELTEPASFTVKEDNNLSLIEYELVNVVVE

SEQ ID NO: 20339 - protein, 274 aa, Brassica napus
MMMRKEDLGLSLSLGLSQDHTPLQSQNPNSSISNNLHRFPWNQTFASTSDLGKIDVNSLPRTVDCEEEPGVSSPNSTISSTISGGKRSEREGISEHDEITPDRGYSRGNSDEEEDGGETSRKKLRLSKDQSAFLEETFKEHNTLNPKQKLALAKKLSLTARQVEVWFRSGRARTKLKQTEVDCEYLKRCVEKLTEENRRLQKEAMELRTLKLSPQFYGQMTPPTTLIMCPSCERVAGPASNHQHNHRPVPVNPWVACAGQVTHGLNFEALRPRS

SEQ ID NO: 20340 - protein, 72 aa, Escherichia coli; identical to SEQ ID NO: 312

SEQ ID NO: 20341 - protein, 121 aa, Staphylococcus aureus
MTTTPYDIIGKEALYDMIDYFYTLVEKDERLNHLFPGDFAETSRKQKQFLTQFLGGPNIYTEEHGHPMLRKRHMAFTITEFERDAWLENMQTAINRAAFPQGVGDYLFERLRLTANHMVNS

SEQ ID NO: 20342 - protein, 211 aa, Desulfovibrio desulfuricans
MSDMPKGTILQRDKETYAIRVTPPSGVVTPQELEAVAAVARKYDVPMLKITSGQRFALIGLKEKDLHAACSELPFRVAGHYVQACPGNQWCQLARQNALEMAGVIEEKFRTFDGPAKIKMGVSGCGTCCAESYVRDIGLVGTSKGWNILVGGNSGGRARIADVLAKDLPDDEAVGLLERFLEYYKTNGKTKQRVARFVEARGIESIREALL

SEQ ID NO: 20343 - protein, 331 aa, Cicer arietinum
MSIILMLVGVLLSSTAFEFTGAQSVGVCYGANGNNLPTKQAVVDLYKSKGIGKIRLYNPDEGALQALKDSNIEVILGVSNDALNSLTNAQSATDWVNKYVKAYSPNVKIKYISVGNEIHPDSPEANSVLPALQNIQNAISSANLGQIKVSTAIDTTLIGKSYPPNDGVFSDAASGYIKPIVNFLVSNGSPLLANVYPYFSYVNNQQSIGLDYALFTKQGNNEVGYQNLFDAILDSIYAALEKVGGSNVKIVVSESGWPSQGGTGASVGNAQTYYGNLIKHAKGGTPKRPNGPIETYLFAMFDENLKTDPETERYFGLFNPDKSPKYQLNFN

SEQ ID NO: 20344 - protein, 407 aa, Brassica oleracea
MESRVLLRATETVTGVPQLRRPIRAINRQFSTASSSFTAFAKPIGSIGEGGNLISGRQLRPLLLLDSLPEKREILKPVRAASAEGGDSAGETKVGFLGKYPWLVTGILLLMWYFLNVIFNILNKKIYNYFPYPYFVSVIHLFVGVVYCLVSWSVGLPKRAPVNSDILKVLIPVAVCHAIGHVTSNVSFAAVAVSFTHTIKALEPFFNASASQFLLGQPIPITLWLSLAPVVLGVAMASLTELSFNWLGFISAMISNISFTYRSIFSKKAMTDMDSTNVYAYISIIALFVCLPPAIIVEGPQLLKHGFNDAIAKVGMTKFISDLFWVGMFYHLYNQLATNTLERVAPLTHAVGNVLKRVFVIGFSIVIFGNKISTQTGIGTGIAIAGVALYSVIKAKIEEEKRQGKTA

SEQ ID NO: 20345 - protein, 46 aa, Glycine max
MAAPESPLWYVGVGRQSVSFRVMKQMGLEEGEGLGKDKQGVEGSRS

SEQ ID NO: 20346 - protein, 509 aa, Thermus aquaticus
MLLDADIKAQLAQYLQLLENDIVLTVSAGDDNVSRDMLALIDELTAMSPKIKVEKAKLERTPSFSVNRVGENTGITFAGVPLGHEFTSLVLALLQVSGRPPKVSQDVVDRIQQIRGKHHFETYVSLTCHNCPDVVQALNIMSVLNPDISHTMIDGAAFKEEAEQKGIMAVPTVFLNGKLFASGRMSLEDILAKLGSAPDASSFADKEPFDVLVIGGGPAGATAAIYAARKGIRTGIVAERFGGQILDTLGIENFISVKYTEGPKLAASIEEHVKQYNVDIMNSQRAKRLEKKDLIEVELENGAVLKSKTVVIATGARWRNLGVPGEEEFKNKGVAYCPHCDGPLFEGKHVAVIGGGNSGVEAAIDLAGIASHVTLLEFAPELKADAVLQDRLYSLPNVTVIKNAQTTEITGTDKVNGLTYIDRETGEEHHIELQGVFVQIGLVPNTEWLEGTVERNRFGEIIVDKRGATNIEGVFAAGDCTDSAYKQIIISMGSGATAALSAFDYLIRH

SEQ ID NO: 20347 - protein, 1004 aa, Colwellia psychrerythraea
MKRMLINATQSEELRVALVDGQKLYDLDIESPGHEQKKSNIYKAKITRIEPSLEAAFVDYGADRHGFLPMKEIAREYFPKGYTFQGRPNIKEVLHEGQEVIVQIDKEERGQKGAALTTFISLAGSYLVLMPNNPRAGGISRRIEGDERTELKASLSKLDLPKGMGLIVRTAGVGKDYEELKWDLSVLLHHWQAISDAGKSRPAPFLIHQETNLILRAIRDYLRRDIGEVLIDRPKTFESVKKHIEVVRPDFLNKIKLYTSDVPLFTHYQIETQIETAFQREVRLPSGGSIVIDPTEAMTSIDINSARATKGSDIEETAFNTNLEAAEEIARQLRLRDLGGLVVIDFIDMTPVRHQREVENRMRDSVHQDRARIQLGKISRFGLLEMSRQRLRPSIGETSQGVCPRCSGTGHVRGVESLALSILRLMEEEAIKENTLHVQAQVPVPVATYLLNEKRRSVMHVEKHHNVRVLIIPNPHMDTPQYEVLRVKNDETIVEASYELPVKKAELEEAKMPKFDKVAAKRDEPLIQGMTSPTRAPKADESPVKAEITTVSKQTKPSGFFGWLKSLFVAEEVVEEVKEVSTTQQPKKPQERRGNQQAKRRNNRGNNRNRNDRNGEDATNRPIQKENEARDTRPSRDEEVNKPKRQPRKTIAVDKEKVVKEEKNTERRQRRNNRKKIRVTPTDKVIETTEKLAVVSTPEIEQVNTPAVENVEVVATNDDKPRNRRSPRHLRANGQRRRRNNAENNSEATQQDQALTTENITTDESVEARYPATSVTEQEVVVTSTEEVAVETIAAAPVETKAVETEAVETVIDVPLNDTKELDTTKTEEEVSTADVAEQVTEVQQELPLEQKQDVVVTTEESPEVKEANAAAPVETDVTSPAIETVKQETVNDTAPVAKSVEVAETVIATQEDKVVAPKPAKKASSAVKKAAPKDKKLARQVKKANRLSGHAKAPMTKTETITTIKDIPTNFMADSERHVHQSSGRTAIIADVVNRSSAQATKP

SEQ ID NO: 20348 - protein, 451 aa, Cryptococcus neoformans
MSNYPSEPEFQQAVAEITQTLEPFLAKNPEYRRALDVVQVPERIVQFRVTWERDDGTIAINRGYRVQFNSALGPYKGGLRLHPTVNLSILKFLGFEQIFKNALTGLMMGGGKGGSDFDPKGKTDSEIRRFCYAFMQELSRHIGTDTDVPAGDIGTGGREIGFMFGAYKKYRNENAGILTGKGADWGGSHIRPEATGYGLVYYVTEMLRDLDNTDWKGKRVLISGAGNVAQYAALKVIELGGTVLSLSDSTGALVATGDEGFTPEEIMNIADIKLQRKSLTAFATGSKFQWHEGKRPWTLVSNADIALPSASQNELNDEEAKALIKAGVRYVAEGSNMGCTLDAIKIFEESRTAAKNATDAGVCFYAPGKAANCGGVAVSGLEMAQNSQRLKWTHEEVDAKLKAIMINCYQTCWETGKQYAEAGVVPSLVAGANIAGFVKVANAMREQGDWW

SEQ ID NO: 20349 - protein, 487 aa, Zea mays
VLERPRGLPSTADPAVQIAGNFAPVGERLPVHRLPVSGRIPPFISGVYARNGANPCFDPVAGHHLFDGDGMSYACRFTETARLTQERAVGRPVFPKAIGELHGHSGIARLALFYARAACGLVDPSAGTGVANAGLVYFNGRLLAMSEDDLPYHVRVADDGDLETVGRYDFDGQLGCAMIAHPKLDPATGELHALSYDVIKRPYLKYFYFRPDGTKSDDVEIPLEQPTMIHDFAITENFVVVPDHQVVFKLQEMLRGGSPVVLDKEKTSRFGVLPKHAADASEMAWVDVPDCFCFHLWNAWEDEATGEVVVIGSCMTPADSIFNESDERLESVLTEIRLDARTGRSTRRAVLPPSQQVNLEVGMVNRNLLGRETRYAYLAVAEPWPKVSGFAKVDLSTGELTKFEYGEGRFGGEPCFVPMDPAAAHPRGEDDGYVLTFVHDERAGTSELLVVNAADMRLEATVQLPSRVPFGFHGTFITGQELEAQAA

SEQ ID NO: 20350 - protein, 183 aa, Mycoplasma mycoides
MYDLKNIKKVLFTKEQINERIKQVANQVKQYYLDHPPVNGPLITIGLLKGCVIFNTEFVLNFDYPIQMDFMAVSSYNGMQSTGAIKIKLDTSLDLTNRDVLIVEDMVDTGLTLSKVKEHIIYKGANSVKVVTLVDKKDFHTVDFTPDWNCFNIDDYYIVGYGFDCNEDYRNLPYIALYQPDNN

SEQ ID NO: 20351 - protein, 244 aa, Zea mays
RAGPSRSSSVSRRRRSRRLPRAAVAMGRRPARCYRQIKNKPYPKSRYCRGVPDPKIRIYDVGMKKKGVDEFSHCVHLVSWEKENVSSEALEAARIACNKYMTKHAGKDAFHLRVRVHPFHVLRINKMLSCAGADRLQTGMRGAFGKPQGVCARVAIGQVLLSVRCKPNNAIHATEALRRAKFKFPGRQKIIESRKWGFTKFNRNDYLKFKSEGRILPDGVNAKLLGCHGRLANRAPGQAFLSAA

SEQ ID NO: 20352 - protein, 393 aa, Fusobacterium nucleatum
MAKRDYYEVLGIDKNASEDDIKKAFKKAAMKYHPDRFANASDAEKKDAEEKFKEINEAYQVLSDAQKKQQYDQFGHAAFEQGGAGFGGGFNAGGFDFGDIFGDIFGGGGSFGGFEGFSGFGGSSRRSYVEPGNDLRYNLEITLEEAAKGVEKTIKYKRTGKCEYCHGTGGEDDKMKTCPTCNGQGTIKTQQRTILGVMQSQSVCPDCHGTGKVPEKKCKHCRGTGTAKETVEKKINVPAGIDDGQKLKYAGLGEASQSGGPNGDLYIVIRIKPHDIFIRQGDNLYCEVPISYSTAVLGGEVEVPTLNGKKTVKVPEGTESGKLLKVSGEGIKSLRGYGKGDIIVKLTIETPKKLTDKQKELLQKFEESLNDKNYEQKSSFMKKVKKFFKDIID

SEQ ID NO: 20353 - protein, 187 aa, Oryza sativa
MAMVAMVVAAMAVAAVARGDMSADRTECADQLVGLAPCLQYVQGEAKAPAPDCCGGLRQVLGKSPKCLCVLVKDKDDPNLGIKINATLALALPSACGATHANVSHCPQLLHIPPNSKDAAIFSPGGDKGSPAAPAKDNSTTTTDSRAVQAANGGSRSSAATAGAALTALLAGYFLLLLPEFSAPSSF

SEQ ID NO: 20354 - protein, 202 aa, Striga asiatica
GVHFGHILRKWNPKMAPYISGKRKGNHITNLIRTARFLSEACNLVFYAASRRKQFLIVGTQKKEADSVAWAAKKARCHFVNKKWLRGMLTNWSTTETRLHKLRDLRIEQRVGRLNRLPKRDAAVVKRQLSRLQTYLGGIKYMTRLPDVVIILDQHEEYTALRECITLGIPTICLIDTNCDPDLADFSIPANDDSRSSIRLIL

SEQ ID NO: 20355 - protein, 147 aa, Unknown
  Malus x domestica
MASNTLMSCGIATTAFPSVLSSSKSKFATSAVQLPSIGANASSRFSMSAEWMPGEPRPPYLDGSAPGDFGFDPLRLGEVPENLERFKESELIHCRWAMLAVPGILVPEALGLGNWVKAQEWAAVPGGQATYLGNPVPWGTLPTILVI

SEQ ID NO: 20356 - protein, 204 aa, Sopubia cana
  misc_feature (118)..(118): Xaa can be any naturally occurring amino acid
RVHFGHGIRKWNPKMAPYISAKRKGIHIINLTRTARFLSEACDLVFYAASRGKQFLIVGTKNKVADSVAWAAIKARCHCVNKKWLGGMLTNWSTTETRLHKFRDLRMEQKSGRLNRLXKRDVAVVKRQLSRLQTYLGGIKYMTGLPDIVIIVDQHEEYKALRECITLGIPTICLIDTNCDPDLADISIPANDDARSSIRLILNK

SEQ ID NO: 20357 - protein, 481 aa, Vibrio cholerae
MALGCLYISTETVINMTYAPVNDVLSGKLAVDSEVTVRGWIRTRRDSKAGISFLAIYDGSCFNPIQAVVPNNLNNYDNEVLKLTTGCSVEVTGKIVESPASGQAFELAASDVKVVGWVEDADTYPMAKTRHSIEYLREVAHLRPRTNVIGAVARVRNCLAQAIHRFYHEQGYFWVSAPLITASDAEGAGEMFRVSTLDMENLPRTDAGKVDYNQDFFGKETFLTVSGQLNAEAYACAISKVYTFGPTFRAENSNTSRHLAEFWMVEPEVAFADLNTVAKLAEDMLKYVFKAVLAERRDDLEFFNDRINNEVIARLEQFVESDFAQVDYTDAIEILKNCGKTFEFPVEWGIDLASEHERFLAEEHFKAPVIVKNYPKDIKAFYMRMNEDGKTVAAMDVLAPGIGEIIGGSQREERLDILDARMREFGIDPEHMDWYRDLRRYGTVPHAGFGLGFERLVSYVTGMGNVRDVIPFPRTPRSASF

SEQ ID NO: 20358 - protein, 89 aa, Brassica napus
  misc_feature (85)..(85): Xaa can be any naturally occurring amino acid
MIREISGLQNDIVNIQERSSSSNNKIMDMRRDIRRPAQAPMMSKQEYFRTLSSQNSPRRLISASYFSLESMVVLVGLTASLLILXLILP

SEQ ID NO: 20359 - protein, 204 aa, Scrophularia californica
GVHFGHGTRKWNPKMAPYISAKRKGIHITNLTRTSRFLSEACDLVFDAASKGKQFLIVGTKNKAADSVAWAAIKARCHCVNKKWLGGMLTNWSTTETRLHKFRDLRMEQKTGRLNRLPKRDAAMVKRQLFRLQTYLGGIKYMTGLPDIVIIVDQHEEYTALRECITLGIPTICLIDTNCDPDLADISIPANDDAISSIRLILNK

SEQ ID NO: 20360 - protein, 796 aa, Ehrlichia chaffeensis
MFNLIRRSAEWGGKTLVLESGKIARQASGAVMVSYAGTTVLATVVTGKTKEPVDFLPLTVQFVAKSYAVGKIPGGFLKREGKPSDRETLISRLIDRSIRPLFPAGFYDEISIVCNLLSYDTVTPPEVTALVGATAALSISGVPFNGLVVGARVGYLPSEGKYLLNASADEMLCSSLDLFLSGNEDSVLMVESEASELSESQMLGAITFGHQHCQEVINLIKEFSHESGQTPIDFIPHDISSLVSDIESSYKEDFSLAYSNTIKKERVLKLEELRGKVLSEVADKYSAGDVECSDQDIVTALKTFERSLVRSKIIDTSSRIDGRAFDEIRDIEIEVDVLPKAHGSALFTRGNTQALVVTALGTPQDEQIVDDLDGDRRENFLLHYNFPPYAVGESAALRAPGRREIGHGKLAWRAIRYVLPEKSDFPYTIRVVSEITESDGSSSMATVCGASLALMDTGVPIKSPVAGIAMGLIKEDDRFIILSDILGDEDHLGDMDFKVAGTAEGVTALQMDMKISGIDIDIIEKALLQAKDGRMHILSKMNAVIQESRNRIKNHAPRIESIFINKDKIRNVIGSGGKNIRDICEKTGAKIEIIQDGTVMIYAVNNEAVEYAKSMIMDIVTEPEIGKVFEGTVVEIMKFGAFVSFLGGKKGLVHISEIRNEHISSVGSVISLNDKVKVLVIGIDREHIQLSMRRVDQESGEPIDGELYNIRKNSFSDDSCGSTGGSSFKESYNPNSRHGSHEKKRSGGSSRSSRRNSNGPNYYREDLPSSNGFGNNNRSFSNSRNGHDVPRKPRFF

SEQ ID NO: 20361 - protein, 325 aa, Rickettsia sibirica
MNKFKNIAVYGGGSFGTSLASLAAQNCNNVTLFLRDEAIAKEILHNKTNVKYLGDIKLPAHLQATTNLDIIKDFELIIIALPSYAFDDSIKLLKTHSISKDNTLLIATKGFARNPTALFSDRLKTLLPYNPTAFFVGPNLAKELAKNLPASASIASLDIDIANKIAYNLSSKIFTTNVSSDIVTLQVAGALKNIFAIKSGIDLARKQGENARATLIVAALKEIAILSKALGGMQKNSDILLEGVVGDLVLTCYSLGSRNTKFGYELGISSDKKKFLQEYKELVEGREALKLVLDLIKKYNLHMPIISEVASCVMPYVIPAKAGMT

SEQ ID NO: 20362 - protein, 110 aa, Lactobacillus delbrueckii
  misc_feature (101)..(101): Xaa can be any naturally occurring amino acid
LQPDTKIRTFAIGMDQNPIDLKYAREVADYLGTDHTEFIMTREDVLGVLREVIYTLETWDITTIRASIGMYILCKKIHETTDLKVILTGECSDELFGYKYXDFAPSPEEF

SEQ ID NO: 20363 - protein, 421 aa, Nostoc punctiforme
MSVEVLDDHPEPITSAQRAYQASLKLGITKGADRSRAVLAMAQALERSFDDILEANTLDLEASREMAVPELILDWLKLTPTRLEMTVDVLQRLGELSDPLRRVRTADYQLEDSQSYTQLMPLGVIGFIYEAFPDLGAIAAGFCIKTGNSIILKGSTEASHSNAAIAEALQNAIAEVGLPLGCVELITAEHGASIRDLVTQDQYVNLVIPYGRSSLVQQVVRQSTCPVLKSAMGNCYLYWSLNSSLEMVRWMILDSHQSEPDQVNAIEKVLIHRQALPSSLAVLWNSLMEKGFEIRGDAELVQAFPQLQLVKEGEWGNPYLTKTVAFKLVDSLESAIAWINEHSSGHADSIVTESYQESRQFALGVNSASTYINTSPRFSRNPSRGDSVFLGMSNQKGHRRGFISLETLTTVKHIVQGNGRF

SEQ ID NO: 20364 - protein, 204 aa, Striga gesnerioides
GFHFGHNIRKWNPKMAPYISGKRKGNHITNLIRTARFLSEACNLVFYAASRRKQFLIVGTQKKEADSVARAAIKARCHFVNKKWLGGMLTNWSTTETRLHKLRDLKIEQRAGRLSRLPKRDAAVVKRQLSRLQTYLGGIKYMTRLPDVVIILDQHKEYTALRECITLGIPTICLIDTNCDPDLADFSIPANDDSRSAIRLILNK

SEQ ID NO: 20365 - protein, 529 aa, Shewanella oneidensis
MSADHTVTQLDSFSATTHSHATHSVQPELNFWQIFNMCFGFLGIQFGFALQNANVSRIFQTLGASIDEIPILWIAAPLTGLLVQPIIGYLSDNTWGCLGRRRPYFLIGAILTTLAIFVMPHSPTLWIAAGMLWIMDASINIAMEPFRAFVGDNLPPSQRTQGYAMQSFFIGIGAVVASALPYILSNFFNVANTAPAGEIADSVRYAFYFGGTVLFLAVTWTVISTKEYSPEELAAFHAKTKTDVEEQCKRSRTHKDYQFASFVWMGLGALLTFTVWAQDLDKQLYILSIGIFAFGPLQLYCALRLSQSQPSQRAQLGMVFNVVDDLFHMPKAMHQLAIVQFFSWFALFAMWIYTTSAVTSYHFGSSDVLSQAYNDGADWVGVLFASYNGFSAIAALFIPLLAKRIGIKLTHTFNMFCGGFGLISFYFIKDPNLLWLAMIGVGIAWASILSIPYAILSGTLPPKKMGVYMGIFNFFIVIPQLLAASVLGLILNGLFDGQPIYALITGGVFMLCAGIAVLFVEQPKALTPH

SEQ ID NO: 20366 - protein, 740 aa, Nostoc punctiforme
MLPKPKKYWTPQHWASWKPFGIGEQYPNNYWEVFRAIWLSRDKLPYAWNILDKGVCDGCALGTTGMKDWTLDGIHLCNVRLRLLRMNTMPAFDPVLLEDVSQLQKQKSAQLRDLGRLPFPMMRQRGEKGFRRISWDEALGIISDRIRATTPDRLSFYITSRGTVNETYYATQKAVRAMGSNNIDNAARICHSPSTAGLKAALGAGATTCSYKDWIGTDLLIFIGSNVANNQPVTVKYLHYAKKAGTKIVVINTYREPGMERYWVPSIVESAVFGTKFAEDFFLINMGGDIAFLNGTIKHIIANNWVDQSFIDIHTVGFAELKTSLESQSWEELERLSGTCREQMYAFAKMVKEANKAVFVWSMGITQHECGEDNVRSIINLALTKGFVGREGCGLMPIRGHSGVQGGAEMGCYATVFPGGKPITPENAAQLSQHWGFDVPASKGLIAPEMINAAYQAELDVLFSVGGNFLEVLPEPDYVEAALKKIPLRVHTDIVLSSQMLVEPADIVVLLPATTRYEIPGGVTETNTERRVIFSPEIPGPRIGEARPEWEVFLELARRVQPDLADKLAFADTSAIRQEIAQVVPQYAGIQHLQQPGDQFQYGGSHLCFGWNFPTSDGKAHFGVLLPRQRELPEGYFLVATRRGKQFNSMVQERKDAITGAVREAVLINAADAALLDLKDGDKVILKNELGELFCEVYIAPIQSGNLQVHWPEGNVLLDKSKRSLEGAPDYNAIARLEKI

SEQ ID NO: 20367 - protein, 204 aa, Tozzia alpina
GVHFGHGTRKWNPKMAPYISAKRKGIHITNLTRTARFLSEACDLVFDAASRGKQFLIVGTKNNAADSVVWAAIKARCHCVNKKWLGGMLTNWSTTETRLHKFRDLRMEQKTGRLNRLPKRDAAVVKRQLSHLQTYLDGIKYMTGLPDIVIIVDQHEEYTALRECITLGIPTICLIDTNCDPNLADISIPANDDAISSIRLILNK

SEQ ID NO: 20368 - protein, 552 aa, Magnaporthe grisea
MRIATSTLLVGAASAAFAPQDGTQRVLNGFDSIKSAAHSIQKPLQTFEEAMASMTSEAKANWDHLKLLVPDAEEQAKTFFPKKPKPASRKPDSAWDHIVKGADIQAMWVEGATPEETHRKIDGKLDNYNLRARSVDPSKLGVDTVKQYSGYLDDEANDKHLFYWFFESRNDPKNDPVVLWLNGGPGCSSLTGLLFELGPGAINAKIEIVHNPYAWNNNASVIFLDQPVNVGYSYSGGSVSNTVAAGKDIYALLTLFFHQFPEYAKQDFHIAGESYAGHYIPVFASEILSHKKRNINLKSVLIGNGLTDGLTQYEYYRPMACGEGGWKAVLSESECQAMDNALPRCQSMIQNCYDSGSVWSCVPASIYCNNAMIGPYQRTGRNVYDIRGPCKDSGNLCYPELGYISEYLNRREVMEALGAEVSSYDSCNFDINRNFLFQGDWMQPYHRLVPELLNQIPVLIYAGDADFICNWLGNQGWTEALEWKGKKDYNRADYSPLTLASAHDVKPYGKVKSSGNFTFMKIFEAGHMVPYDQAEPSVDFVNRWLAGEWFAA

SEQ ID NO: 20369 - protein, 422 aa, Candida glabrata
MFVRLARIPRITRHYRLGLFSTQPKPKPNEYLYYRNKHKSKMEAPIKRSSSAVSLVELEREPFKVTVIGSGNWGTTIAKVVAENTKANPQVFQERVDMWVFDENIDGTMLTEIINTKHQNVKYLPNIDLPENLVANPDLLKSVEGADILVFNIPHQFLPKIVDQLRGHVEPHVRAISCLKGFEVGKKGVQLLSTYITEELGIECGALSGANLAPEVAKEHWSETTVAYHIPKDYQGDGMDVDHKVLKLLFHRPYFHVSVIDDVAGISIAGALKNVVALGCGFVEGLGWGNNAAAAIQRVGLGEIIKFGQMFFPESRVETYYQESAGVADLITTCSGGRNVRVATHMAKTGKSAEDSEKELLNGQSAQGVITCKEVHEWLSTCEMIEEFPLFEAVYKIVYEDVPMHKLPEMIEELDDIVVAGQ

SEQ ID NO: 20370 - protein, 335 aa, Geobacter sulfurreducens
MSERIGVIGAGSWGTTLANLLARKGLDVTLWAYEAELVEEMRATRVNSLFLPGIELAPALSFTNSLEEAATGKDFLVLVSPSQVMRGVLAQLAPLLRPGVVLVNASKGIELDTLMTMDQVCAAVLPPEVARCFSVLSGPSFAREVSLEMPTAVVAASGDPAVAAAVQRLFTTPSFRVYTNTDVVGVEIGGALKNVIAVAAGISDGLGLGHNTRAALITRGLAEMTRLGLSMGAQPETFAGLAGMGDLVLTCTGDLSRNRTVGMKLGQGMKLADVLGEMRMVAEGVKTAESAYRLARRTGVEMPITEKVYQVLHEDKPARQAVMELMTRDLKAERW

SEQ ID NO: 20371 - protein, 321 aa, Escherichia coli
MGTTKHSKLLILGSGPAGYTAAVYAARANLQPVLITGMEKGGQLTTTTEVENWPGDPNDLTGPLLMERMHEHATKFETEIIFDHINKVDLQNRPFRLNGDNGEYTCDALIIATGASARYLGLPSEEAFKGRGVSACATCDGFFYRNQKVAVIGGGNTAVEEALYLSNIASEVHLIHRRDGFRAEKILIKRLMDKVENGNIILHTNRTLEEVTGDQMGVTGVRLRDTQNSDNIESLDVAGLFVAIGHSPNTAIFEGQLELENGYIKVQSGIHGNATQTSIPGVFAAGDVMDHIYRQAITSAGTGCMAALDAERYLDGLADAK

SEQ ID NO: 20372 - protein, 477 aa, Leptospira interrogans
MSLLPTVCIIGAGPSGIAVCKALKDKGIPFECYEAGSEVGGNWKFKNDNKMSSIYKSLHTNTHKDKMQYKDYPMPNSYAAYPDHQKISEYFINYVNHFGFRDHIFFKTPVTHVKHEEDGTWSILTEDGKQKYYDVLIVSNGHHWSQRWPKPDFPGKFTGDIIHSHSYIDPNKPIQLTGKRVVILGMGNSAMDIAVELCRPGISSKVFLAARRGAYIIPNYLFGKPLDKIATLFPVHTPFWLKSLIIKFALKLGVGNVEDFGLQKPDHKPGAAHFTISQDILVRLGRGDIIPKPNIESYNGNKVKFVDGSEEEIDVIIYCTGYDVKFPFFDENFLSAKDNHLPLFHRMVKPEFKNLFFVGLFQPLGPIAPLSEFQGKWISEYLVGNYEFPSEEKMNQSIEKYESKMKRRYITSARHTMQVDFEVFLYDMKSELKKGIKRAAKNGNKLPVPALAQNKSILSNDISVKRFKNKTELFSEI

SEQ ID NO: 20373 - protein, 282 aa, Kineococcus radiotolerans
MTTVRTALTQVTWPGTKDEMLDKHEVLAREAAAQGAQVLCFQELFYGPYFGITQDSKYYRYAEAADGPIVQRFAALAEELGVVTVLPIYEEQQAGVYYNSAVVVDADGSVRGTYRKNHIPHVDRFWEKFYFRPGNLGWPVFETAVGTIGVTICYDRHFPEGWRALGLAGAEIVFNPNASKPGLSNRLWELEQPTAAAANGYYVCVPNRVGREDNEYGDLAVDFYGTSFVVDPRGNYVGERGSGTAEELLVRDLDMDLVRTARDEWQFYRDRRPDAYGTLVAP

SEQ ID NO: 20374 - protein, 426 aa, Mycobacterium tuberculosis
MSAPLAEVDPDIAELLAKELGRQRDTLEMIASENFVPRAVLQAQGSVLTNKYAEGLPGRRYYGGCEHVDVVENLARDRAKALFGAEFANVQPHSGAQANAAVLHALMSPGERLLGLDLANGGHLTHGMRLNFSGKLYENGFYGVDPATHLIDMDAVRATALEFRPKVIIAGWSAYPRVLDFAAFRSIADEVGAKLLVDMAHFAGLVAAGLHPSPVPHADVVSTTVHKTLGGGRSGLIVGKQQYAKAINSAVFPGQQGGPLMHVIAGKAVALKIAATPEFADRQRRTLSGARIIADRLMAPDVAKAGVSVVSGGTDVHLVLVDLRDSPLDGQAAEDLLHEVGITVNRNAVPNDPRPPMVTSGLRIGTPALATRGFGDTEFTEVADIIATALATGSSVDVSALKDRATRLARAFPLYDGLEEWSLVGR

SEQ ID NO: 20375 - protein, 339 aa, Pseudomonas aeruginosa
MSTVDPVEQLLANGLKNLWYPICPVGFIEDKPVSLRRLGYKLAVWRDTDGTLHALEDHCPHRGAPLSRGVNLGDRLQCPYHGVEVRCDGVTARVPGSPGCKLEGSQATRFFHITEAAGAVWLYNSAGNVEEAPPLVLPEQLTDPEFSHFLCYTEWRGDYRYVLDNVMDPMHGTYLHKQSHSMSEGESQARFVTRDTDTGFIFEKDGQRGVNFDWTEWADTGMHWMRLEIPYPKTGGPGGNFHIVGSYTPIARDLCAVFHWRCRPLTGWQRDTWRFLYRNRLEARHWAVLEQDREMLEFMEPDANQRENLYQHDLGLVRLRRHLKNLAKAQLELIEARQL

SEQ ID NO: 20376 - protein, 133 aa, Rhodopirellula baltica
MTWRVYNVLKFSVRMFVGAAPVKKVEAIVRHFKLEDVKNALTEQGIHGMTVSEVRGFGRQKGHTEIYRGTEYAIDFVPKVKIEVVCTSDNLQTVIDTILQTAQTGQIGDGKIFVTNLEESVRIRTGERGEEAL

SEQ ID NO: 20377 - protein, 432 aa, Oryza sativa
  misc_feature (323)..(323): Xaa can be any naturally occurring amino acid
MVGKRVAVVVGGSVAGLACAHAVAEAGWEAVVVEKAAAPGAGSGTGAGLGLDAQSMETLARWIPGRLDAATLPLAVDLNRATDGETKAGRTLTRDEGFGFRAAHWGDLHRRLHEALPAGVTVLWGHQFVSFEMAPEGDGDGGVVVTARVLRTGETVEVAGDLLVAADGCTSAIRRRFLPELKLRYSGYCAWRGVFDFSGKEGCTTMVDIRRAYPELGNCLYFDLAYKTHAVLYELPKNRLNWLWYINGDEPELMGSSVTMKVNEATVSEMKEKAERVWCPELARLIGETAEPFVNVIYDAEPLPGLSWAGGRVALVGDAAHPXPPPHGLRSTNMSILDARVLGCCLARWGGDGNAEPTSTPRRALAEYEAARRPVVAAQVLHARRLGRLKQGLGMGSAGDGEGFDARTATEEEISQLRQSSMPYFSGAPTIE

SEQ ID NO: 20378 - protein, 117 aa, Arabidopsis thaliana
  misc_feature (19)..(19): Xaa can be any naturally occurring amino acid
HQTLRPSSTLSSATMVASXAQAGIYTPGNGLKSSAAFPATRKANNNITSITSNGGRVNCMQVWTTIGKKNFETLSYLPDLTDSELAKEVHYLIHNKSIPCVQFKLQHPFVYRKHSNS

SEQ ID NO: 20379 - protein, 150 aa, Brassica napus
MAPKAEKKPAEKKPASEKPVEEKSKAEKAPAEKKPKAGKKLPKEAGAGGDKKKKMKKKSVETYKIYIFKVLKQVHPDIGISSKAMGIMNSFINDIFEKLAGESSKLARYNKKPTITSREIQTAVRLVLPGELAKHAVSEGTKAVTKFTSS

SEQ ID NO: 20380 - protein, 485 aa, Colwellia psychrerythraea
MSAELLINVTPSETRVALIENGSLQEVHIERQAKRGIVGNIYLGKVIRVLPGMQAAFVDINLDKAAFLHASDINSKLILKEETDQVPDIRSLVHEGQHIMVQVVKDPLGSKGARLTTDITIASRYLVLMPNSQHAGISLRIENPNERDRLKDIVTPYCDEQQGFIVRTAGEGADELDLQHDAEFLRRVWHKVLARKQRKQTNLPLYQDLSLSFRVLRDFVGINLERIRIDSNLTFQELTVFTEEFVPELTPLLEYYPGELPIFDLFSVEREIQRALHRKIELKSGGYLIIDQTEAMTTIDINTGAFVGHRNLADTIFSTNIEATQVIARQLRLRNLGGIIIVDFIDMHNDDHKRRVLHSLDMAMSKDKVKYSLHGFSALGLVEMTRQRTRESLEHVLCGECPLCTGRGHLKTVETVCFEVLREIVRVNRAHDADKFTVYASTAVSNSLVNDEYHNLAEVEVFIGKLIKVQAEPMYNQEQFDVVMM

SEQ ID NO: 20381 - protein, 242 aa, Brassica napus
  misc_feature (132)..(132): Xaa can be any naturally occurring amino acid
MAMAVSGAVLSGLGSSFLAGGKRSAAALGNAGARRVGRKTLIVAAAAAQPKKSWIPAVKGGGNFLDPEWLDGSLPGDFGFDPLGLGKDPAFLKWYREAELIHGRWAMAAVLGIFVGQAACGVPWFEAGADPXPFSFGSLLGTQLLLMGWVDSKRWVDFFNPDSQSVEWATPWSRTAENFAKYPGDPLGLAGKTRGGVYESDREKLERLKVAEIKHSRLAMLAMLIFYFEAGQGKTPLGALGL

SEQ ID NO: 20382 - protein, 188 aa, Oryza sativa
MGDDGGGVKVAAAATTATGMKQITRLRELLQKWQAMALGANKGDVATAGDEEDEEVVEVAPAAAAAAIPPFVMRRLQRTVTVDSDDESCQSPEPPADVPRGYCPVYVGPEQRRFVIPTRYLGHPVFRLLLEKAEEEFGFCHQGALAIPCETEAFKYILQCVERHDNGLAAGDVVDGVVDVNDRAPPRD

SEQ ID NO: 20383 - protein, 397 aa, Cenarchaeum symbiosum
MSMAPQELENSASRYAGEAIKCDSQGARGMAIANYQKAIDSLVRLMHLYPRSKLNQLYKERTTSYQKRIKALRESGSVEPAIDPRASPSEAKAGMDTQSAKKDFDDLIMKEKPDISWNEVIGLDAVKTALRESIVYPSKRPELFPLGWPRGILLYGPPGCGKTILAAATASEIDGYFINVDAASMMSKWLGEAEKNVAKLFTMAGGYAEREDKPVILFIDEVDSLLGSRNTEVGGESRLKTQFLIGMDGIKDKGKKIKLYVIGATNKPWSLDQPFLRRFQKRIYVDLPTDEARKKIFELYTDPLNKDPKLRTPMLAKLFEGYSASDIKDACQAAQLMVVHELFNAPGYSEPVEGEESPRPRDISMADFRDILARRKPSVSNEMRLAYHKWSQDFQAS

SEQ ID NO: 20384 - protein, 306 aa, Unknown
  Dehalococcoides sp. CBDB1
MSTLLYDVIIIGGGPAGLTAALYTGRSKLKTLVIERAFVGGQITRSEKVDNYPGFPEGITGFDLTQQMQIQAEKYGVEITSAEVNAIHKTKDHFEVVTETGGLSGRCIIICGGTERNKLEVPGEEEFSGRGVSYCATCDAPFYNDKVVAVVGGGNMAFYEALHLSEFAKKVYLIHRRQGFRADAVLMDKAKNKSNIELVLDTVVTSINGQDSIQSLSLNNLKTLKTSTLPIDGLFVAVGLQPNTTYLKGVVDMDKNGSILVNDQMETSVSGILSAGDIRSGSIRQVISAAGDGAVAALSAKRYLDL

SEQ ID NO: 20385 - protein, 1212 aa, Daucus carota
MHTQRRMDSMSLLFLLILLFCNFSESRKLSGQVKDQGNEVEGLANFKKFSVDAGPNGFLKTWDSSSSSSPCSWKGIGCSLEGAVTVLNLTGAGLVGHLQLSELMDNLPSLSQLYLSGNSFYGNLSSTASSCSFEVLDLSANNFSEPLDAQSLLLTCDHLMIFNLSRNLISAGSLKFGPSLLQPDLSRNRISDLGLLTDSLSNCQNLNLLNFSDNKLTGKLTSFLSSCKNLSTVDLSYNFFSQIHPNFVANSPASLKFLDLSHNNFTGNLVNLELGTCHNLTVLNLSHNSLSGTEFPASLANCQFLETLDMGHNDFHLKIPGDLLGNLKKLRHLSLAQNSFFGEIPPELGNACRTLEVLDLSGNQLIEQFPTEFSLCTSLVTLNVSKNQLSGDFLTSVLSPLPSLKYLYLSFNNITGSVPPSLTNATQLQVLDLSSNAFTGTIPTGFCSTSSSFSLEKLLLANNYLKGRIPSELGNCKNLKTIDLSFNSLIGPVPSEIWTLPYIADIVMWGNGLTGEIPEGICIDGGNLQTLILNNNFISGSIPQSFVKCTNLIWVSLSSNQLRGTIPAGIGNLLNLAILQLGNNSLTGEIPPGLGKCKSLIWLDLNSNALTGSIPPELSSQSGLVSPGPVSGKQFAFVRNEGGTACRGAGGLLEYEGIRAERLEKFPMVLACPSTRIYSGRTVYTFASNGSIIYFDLSYNALSGTIPESFGSLNSVQVMNLGHNNLTGSIPSSFGGLKYIGVLDLSYNNLQGAIPGSLGGLSFLSDLDVSNNNLSGSVPSGGQLTTFPSSRYENNAGLCGVPLPPCGSENGRHPLRSNSQGKKTSVTTGVMIGIGVSLFSIFILLCALYRIRKYQQKEELRDKYIGSLPTSGSSSWKLSSVPEPLSINVATFEKPLQKLTFAHLLEATNGFSANSLIGSGGFGDVYKAQLGDGRVVAIKKLIHVTGQGDREFMAEMETIGKIKHRNLVPLLGYCKIGEERLLVYEYMKWGSLESFIHDRPKVGGGLRIDWPARKKIAIGSARGLAFLHHSRIPHIIHRDMKSSNVLLDENFEARVSDFGMARLVNAFDTHLSVSTLAGTPGYVPPEYYQSFRCTAKGDVYSYGVVLLELLSGKRPIDPAQFGDDNNLVGWAKQLHKEKRDLEILDSELLLHQSSEAELYHYLQIAFECLDEKAYRRPTMIQVMAMFKELQMDSETDILDGLSVKNSVIDESL

SEQ ID NO: 20386 - protein, 495 aa, Aspergillus niger
MSSALLDEAARIARQFDYPAAEVQRGVTEYIREIDEGLSKEHTTLSQIPTYVTAVPNGTEKGLYLAVDLGGTNFRVCSIDLHGDTTFSLTQSKIMIPRETMASGTAKDLFLFLARQIESFLRIHHNDHFEAHLRRRNEKNGNCEEDLFDLGFTFSFPVRQLGINKGTLIRWTKGFNIPDAVGKDVCALLQNAIDDLGLPVRVAALVNDTVGTLMARSYTSPGETGTFLGAIFGTGTNGAYVEKLDRITKLQTIEHSEYDKTTGEMIINAEWGSFDNHLSVLPNTIYDQQLDADSNNPGIQMFEKRVSGMFLGEILRRVMLDMQRNESLGFLRAGGASTVSVPQESSLYRQWGIDTSLLSLVEADKTENMEQIKVALKDHLKIERPTTDDCKAIQTVVHAIGKRAARLSAVPLAAILLSTGKLQKDDLVDIGVDGSLVEFYPNFEGYMRDALREVPEVGEAGNKKIRIGISKDGSGVGAALIALVASKEETRRKSQ

SEQ ID NO: 20387 - protein, 462 aa, Bacillus subtilis
MANKELKRGLGARHIQMIALGGTIGVGLFMGSASTISWTGPSVLLAYAICGIFIFFIMRAMGEMLYVEPSTGSFATFGHQYIHPMAGYITAWSNWFQWIIVGMSEIIAVGSYTKYWFPDLPAWIPGIVAMVILGAANLISVKSFGEFEFWFAMIKIVTIILMIIAGIGIIFFGFGNGGDAIGLSNLWSHGGFFAGGFSGFFFALSLVIAAYQGVELIGITAGEAKDPQNTLRNAIQSIIWRILIFYIGAIFVIVTVYPWDELNSLGSPFVSTFSKIGITAAAGIINFVVITAAMSGCNSGIFSAGRMLYTLGVNGQAPKFFKKISRNGVPLYGTIAVLIGLAVGVVLNYIAPPKIFVYVYSASVLPGMIPWFIILISHIGFRKAKGAALDKHPFKMPFAPFTNYLTIAFLLMVLVGMWFNDDTRISLIVGVIFLALVVISYYVFGIGKRTQANLTKSEQAAE

SEQ ID NO: 20388 - protein, 246 aa, Coprinopsis cinerea
MAAFFSSLTVASVGLTCKSFLNLGFCSIQVNGLNILLDALNHPERRNDRGLVTVPGRPGGLLAPPISSSPTQRVFSSFFRLGQTLETFRGQGIYQESVNTAIQKLNEGSWVHLFGEGKVNQPDSYTIDPEGYAHIPRFKWGVGRIVMESSNLPVVIPMWLSGYDKLMPEGRPFPRKYLPRLGVRLSVTFGEPIPPELLSQAINHSAPDDKGAPSIDAQRSRLTALIHNHVESLGRTVCGPLLQMKQ

SEQ ID NO: 20389 - protein, 173 aa, Zea mays
MSRSVEPLIVGRVIGEVLDSFNPCVKMIVTYDSNKLVFNGHEIYPSAIVSKPRVEVQGGDLRSFFTLVMTDPDVPGPSDPYLGEHLHWIVTDIPGTTDASFGREVISYESPRPNIGIHRFIFVLFKQKGRQTVTVPSFRDHFNTRQFAEENDLGLPVAAVYFNAQRETAARRR

SEQ ID NO: 20390 - protein, 151 aa, Lactobacillus delbrueckii
SAPNVAAVGLAAANGVKISWFGWVAAAIVPALISFILVPIIIYKMYPPKIKETPNAKEWADGQLKEMGAIKASEKVMMAVFILALVLWMLSSFIGLDATWVAFLATALLLVTGVLTTKDMLSZTGAWNVVVWFSILIFMANQLSLKGGVIP

SEQ ID NO: 20391 - protein, 657 aa, Shigella flexneri
MTQLAIGKPAPLGAHYDGQGVNFTLFSAHAERVELCVFDANGQEHRYDLPGNSGDIWHGYLPDARPGLRYGYRVHGPWQPAEGHRFNPAKLLIDPCARQIDGEFKDNPLLHAGHNEPDYRDNAAIAPKCVVVVDHYDWEDDAPPRTPWGSTIIYEAHVKGLTYLHPEIPVEIRGTYKALGHPVMINYLKQLGITALELLPVAQFASEPRLQRMGLSNYWGYNPVAMFALHPAYACSPETALDEFRDAIKALHKAGIEVILDIVLNHSAELDLDGPLFSLRGIDNRSYYWIREDGDYHNWTGCGNTLNLSHPAVVDYASACLRYWVETCHVDGFRFDLAAVMGRTPEFRQDAPLFTAIQNCPVLSQVKLIAEPWDIAPSGYQVGNFPPLFAEWNDHFRDAARRFWLHYDLPLGAFAGRFAASSDVFKRNGRLPSAAINLVTAHDGFTLRDCVCFNHKHNEANGEENRDGTNNNYSNNHGKEGLGGTLDLVERRRDSIHALLTTLLLSQGTPMLLAGDEHGHSQHGNNNAYCQDNQLNWLDWSQASSGLTAFTAALIHLRKRIPALVENRWWEEGDGNVRWLNRYAQPLSTDEWQNGPKQLQILLSDRFLIAINATLEVTEIVLPAGEWHAIPPFAGEDNPVITVVWQGPAHGLCVFQR

SEQ ID NO: 20392 - protein, 560 aa, Salicornia europaea
MLSQLSSLFYSKMDMLSTSDHASVVSMNLFVALLCGCIVIGHLLEENRWMNESITALLIGLCTGVVILLISGGKSSHLLVFSEDLFFIYLLPPIIFNAGFQVKKKQFFRNFITIIMFGAIGTLVSFSVISLGAMTIFKKMDIGSLELGDYLAIGAIFAATDSVCTLQVLNQDETPLLYSLVFGEGVVNDATSVVLFNAIQNFDLTNIDHRIAIQFSGNFLYLFFASTMLGAMTGLLSAYVIKKLYFGRHSTDREVALMMLMAYLSYMLAELFYLSGILTVFFCGIVMSHYTWHNVTESSRVTTKHAFATLSFVAEIFLFLYVGMDALDIEKWRFVSDSPGTSVAVSSILLGLLMVGRAAFVFPLSLLINFSKKSHSEKITFNQQIVIWWAGLMRGAVSMALAYNQFTRSGHTQLRGNAIMITSTITIVLFSTMVFGLLTKPLILFLLPHSKHFNSASTVSDLGSPKSLSLPLLDGGQDSEADMDNQDEAVNNRYEGTHNRTIARPGSLRMLLNAPTHTVHYYWRKFDDSFMRPVFGGRGFVPYVPGSPIEQNTDNLLDRT

SEQ ID NO: 20393 - protein, 305 aa, Bacillus cereus
MKLCENVTELIGDTPVVRLSKFIPEDAADVYVKLEMFNPSRSVKDRAAYNLLHVAEENGHIKPGDTIIEPTSGNTGIGLAMNAAAKGYKTILIMPDNMSKERINLLKAYGAEVVLTPAEQRMPGAIAKALELQKQIPNSFIPQQFENPANPNIHRYTTALEIYEQMDGELDAFVATAGTGGTITGTGETLKEKLPNLYIAVVEPKGSPVLSGGVPGPHKLVGTSPGFIPKNLNTEVYNEIIQIADEEALTTMRNLARQEGLLVGPSSGASVYAAIMIAKRLGAGKKVLCIAPDTGERYLSMGLFE

SEQ ID NO: 20394 - protein, 53 aa, Glycine max
PIRHEALLKRLDFPEMKFSLYFMGYENTAEAPSNPIDKVVWTFSHKATIELTQ

SEQ ID NO: 20395 - protein, 443 aa, Oryza sativa
MEQTLDVPRSLRLPAPKAQQQMDEFWRDRQKEIETTKDFSEHAIPMARLKKIVSSQKGNMMMTFDMPAFLSKMCELFVQELAVRAWASAQSHNRCIILDTDIAKAIASTESYDFLVDILRNHCVKHKSTPCSTLTTKRCRLVDQPSTSHMPYQHQLPQFAPTYTPAIPITPSLMPPISHYIPFQYPSLSQEVSPMMASAPIVNRSMLLIHNIARGLSLQGNNISTFANNNIPDNIVGFSSPAVLASMMSPALLEVAGTSLNPPNSHSICTMNMINSSDPSGSSVGDINVANQASLAPSGHFNPAILRESSCPSFLHSNNNDTIVAIPEGVDISGTMDVASDVAAIVINGQEEHERETNVEHHQQNEIYESIDIGIINASVADGNKCSISWDELGMADDSLLDKFLEEFQVRNDGVLCTGIELHEDPFLGDVMLEIPSTSNANK

SEQ ID NO: 20396 - protein, 717 aa, Arabidopsis thaliana
MEELDRSRTFARDVKRIVVKVGTAVVTGKGGRLALGRLGALCEQLAELNSDGFEVILVSSGAVGLGRQRLRYRQLVNSSFADLQKPQTELDGKACAGVGQSSLMAYYETMFDQLDVTAAQLLVNDSSFRDKDFRKQLNETVKSMLDLRVIPIFNENDAISTRRAPYQDSSGIFWDNDSLAALLALELKADLLILLSDVEGLYTGPPSDPNSKLIHTFVKEKHQDEITFGDKSRLGRGGMTAKVKAAVNAAYAGIPVIITSGYSAENIDKVLRGLRVGTLFHQDARLWAPITDSNARDMAVAARESSRKLQALSSEDRKKILLDIADALEANVTTIKAENELDVASAQEAGLEESMVARLVMTPGKISSLAASVRKLADMEDPIGRVLKKTEVADGLVLEKTSSPLGVLLIVFESRPDALVQIASLAIRSGNGLLLKGGKEARRSNAILHKVITDAIPETVGGKLIGLVTSREEIPDLLKLDDVIDLVIPRGSNKLVTQIKNTTKIPVLGHADGICHVYVDKACDTDMAKRIVSDAKLDYPAACNAMETLLVHKDLEQNAVLNELIFALQSNGVTLYGGPRASKILNIPEARSFNHEYCAKACTVEVVEDVYGAIDHIHRHGSAHTDCIVTEDHEVAELFLRQVDSAAVFHNASTRFSDGFRFGLGAEVGVSTGRIHARGPVGVEGLLTTRWIMRGKGQVVDGDNGIVYTHQDIPIQA

SEQ ID NO: 20397 - protein, 224 aa, Glycine max
MENNQQQGAQAQSGPYPGGAGGSAGAGAGAGAGAAPFQHLLQQQQQQLQMFWSYQRQEIEHVNDFKNHQLPLARIKKIMKADEDVRMISAEAPILFAKACELFILELTIRSWLHADENKRRTLQKNDIAAAITRTDIFDFLVDIVPRDEIKDDAALVGATASGVPYYYPPIGQPAGMMIGRPAVDPATGVYVQPPSQAWQSVWQSAAEDTPYGTGAQGNLDGQS

SEQ ID NO: 20398 - protein, 72 aa, Caulobacter crescentus
MAKEELLEFPGTVSELLPNATFRVKLENDHEIIAHTAGKMRKNRIRVLAGDKVLVEMTPYDLTKGRITYRFK

SEQ ID NO: 20399 - protein, 354 aa, Unknown
  marine gamma proteobacterium HTCC2207
MASSNDVMVTSAPTRSEFALDMWYVAALSAEVSDKPLARTLLNEPVVLFRTQDGQIGALEDRCCHRALPLSLGTVDESGLRCGYHGLLFNCAGACIEIPGQEKIPSKAKVTAYHAIEKGPLIWIWFGSELDSEPSCEPPEYSVHTDKRYLFDGDVYHYEAPYQLIHDNLLDLSHLGYVHANTIGGNAKIHMNAEMKVESEGDSVRVTRYMPNSTPPPTYTAAYPFAGQVDRWQEIVFYPSHLEIWTGAVDVNTESLDDPNRGGFHLRGFHGVTPQTAETSFYIWTQASNPTNNPAETMQLVIEQTAETFDEDKVVIEAQYANMQRFGQKAMLDIHVDVGANRARRIIKRLISAK

SEQ ID NO: 20400 - protein, 153 aa, Bacillus cereus
MGYIEDMRDLVGNQPLILIGSHAIIVNENNEILLQLRTDFNRWGIIGGALEYNETLEDALKREVYEETGLIIKNPELFRTYSGPDYFQIYPNGDQVHGVLVVYICREFHGELVCDHTESKELRFFSLNELPSNLPPVIERIIKEFQQSNLYVK

SEQ ID NO: 20401 - protein, 140 aa, Triticum aestivum
  misc_feature (124)..(124): Xaa can be any naturally occurring amino acid
MATSTAAVLSPPTVAGLRLAPSPRAAVSFRAPARRSVAARAALEPSVVISLSTGLSLVMGRFVFFNFQRENVAKQVPEQNGKTHFEAGDERAKEFAGILKSNDPVGFNLVDVLAWGSIGHIVAXYILATTSNGYDPPFFG

SEQ ID NO: 20402 - protein, 57 aa, Oryza sativa
  misc_feature (12)..(12): Xaa can be any naturally occurring amino acid
  misc_feature (19)..(19): Xaa can be any naturally occurring amino acid
SIVSREMTRRYXTFLFSYXDTVLVVFGACSVVLFCAYDLFKDPFVSVAVIEQVVSPA

SEQ ID NO: 20403 - protein, 338 aa, Variovorax paradoxus
MNLKKFPRHVLTFGPTPIQPLKRLSAHLGGKVDLYAKREDCNSGLAFGGNKTRKLEYLIPEALEGGYDTLVSIGGIQSNQTRQVAAVAAHLGLKCVLVQENWVNYSDAVYDRVGNIEMSRIMGADVRLDAAGFDIGIRQSWEQAMADVRAAGGKPFPIPAGCSEHPRGGLGSVGFAEEVRQQEAELGFKFDYLVVCSVTGSTQAGMVVGFAADGRADRVIGIDASAKPQQTFEQILRIAKNTAELVELGRDITEKDVVLDRRFGGPEYGLPNEGTLEAIRLSARFEGMLTDPVYEGKSMHGMIEKVRLGEFPAGSKVLYAHLGGVPALNAYSFLFRNG

SEQ ID NO: 20404 - protein, 553 aa, Desulfovibrio vulgaris
MFCFQCQETAKNTGCTVKGMCGKPEETANLQDLLIFVLRGIAIYGEKLKELGQPDRSNDDFVLQGLFATITNANWDDARFEAMISEGLARRDKLRNAFLAVYKAKNGKDFSEPLPEAATWTGDSTAFAEKAKSVGILATENEDVRSLRELLIIGLKGVAAYAEHAAVLGFRKTEIDEFMLEALASTTKDLSVDEMVALVMKAGGMAVTTMALLDEANTTTYGNPEITQVNIGVGKNPGILISGHDLKDMAELLKQTEGTGVDVYTHGEMLPANYYPAFKKYPHFVGNYGGSWWQQNPEFESFNGPILLTTNCLVPLKKENTYLDRLYTTGVVGYEGAKHIADRPAGGAKDFSALIAQAKKCPPPVEIETGSIVGGFAHHQVLALADKVVEAVKSGAIKRFVVMAGCDGRQKSRSYYTEVAENLPKDTVILTAGCAKYRYNKLNLGDIGGIPRVLDAGQCNDSYSLAVIALKLKEVFGLDDINDLPVSYDIAWYEQKAVAVLLALLFLGVKGIRLGPTLPAFLSPNVAKVLVENFNIKPIGTVQDDIAAMMAGK

SEQ ID NO: 20405 - protein, 391 aa, Desulfovibrio vulgaris
MRKIVESVYWVGAVDWDRRLFDSLVPLPDGTTYNAYLVEGSEKTALIDAVDPDMVDTLLGHLDGVEKLDYVISQHAEQDHSGTIALVLDLYPEAKVVTNAKAKSMLMDLLLIPDDKFIVVGDGETLSLGDKTLTFILTPWVHWPETMSTYLAEDKILFSCDFFGSHIATSDLFVRDQGRVHEAAKRYFGEIMMPFRTIIAKNLEKLGPYDIRMIAPSHGQIYDSPGWIIDAYRDWVSGVAHNLVAFPFVSMHGSTRLMVDHLAAALSERDVRVELFNLAVTDIGKLAMSLVDAGTIVLGTPTVLAGPHPMAAYAAFLANALRPKAKYLSIVGSYGWGGKTVETLAGMIPNLKVEVLDPVLCKGLPTDDTYGALDRLADAIAAKHKESGFQR

SEQ ID NO: 20406 - protein, 217 aa, Arabidopsis thaliana
MDQQGQSSAMNYGSNPYQTNAMTTTPTGSDHPAYHQIHQQQQQQLTQQLQSFWETQFKEIEKTTDFKNHSLPLARIKKIMKADEDVRMISAEAPVVFARACEMFILELTLRSWNHTEENKRRTLQKNDIAAAVTRTDIFDFLVDIVPREDLRDEVLGGVGAEAATAAGYPYGYLPPGTAPIGNPGMVMGNPGAYPPNPYMGQPMWQQPGPEQQDPDN

SEQ ID NO: 20407 - protein, 241 aa, Photorhabdus luminescens
MATVSMRDMLQAGVHFGHQTRYWNPKMKPFIFGARNKVHIINLEKTVPMFNDALAELNKIASRKGKILFVGTKRAASEAVKEAAQNCDQFFVNHRWLGGMLTNWKTVRQSIKRLKDLEAQSQDGTFDKLTKKEALIRSRELGKLENSLGGIKDMGGLPDALFVIDAEHEHIAIKEANNLGIPVFAVVDTNSDPDGVDFIIPGNDDAIRAVKLYLGAVATAVREGRSQDLAVQAEESFVEAE

SEQ ID NO: 20408 - protein, 526 aa, Erwinia carotovora
MLDNTMKVQLKAYLEKLTKPVELIATLDDSAQSAEVRTLLTEIAELSNQVSFIENNTVVEKNGQPARKPSFLITNPGSQSGPRFAGAPMGHEFTSLILALLQVGGHPSKEAKELLDQIRNLDGSFHFETYYSLSCHNCPDVVQALNLMAVLNPNITHTAIDGGVFQDEIQSRNVMGVPTIFLNGEHFSQGRTSLAEIVTKIDTGAGAKQVDKLNQRDVYDVLIIGSGPAGAAAAVYSARKGIRTGLVGERFGGQVLDTVDIENYISVPKTEGAKLATALKSHVDDYDVDVIDAQSAEALIPGGEPGKPHQVITVSGATLKARSVIIATGARWRNMNVPGEDQYRTRGVTYCPHCDGPLFKGKHVAVIGGGNSGVEAAIDLAGVVKHVTLLEFAPELKADSVLQEKVRSLPNVDIILNAQTTEVKGDGQKVTGLSYKDRITDTVHDLPLEGIFVQIGLLPNTHWLEGTVARNRIGEIEIDAKCETSVKGVFAAGDCTTVPYKQIIIATGEGAKASLSAFDYLIRTRA

SEQ ID NO: 20409 - protein, 288 aa, Vibrio parahaemolyticus
MSKVVKFAALQLTKSWDLEENLVKAKKAIREAAQNGANVILPQELFAAPYFCKKQEAKYFELAEETANSHLIQEMSALAKELGVVIPVSYFEKAGNTFFNSLVMIDADGTVLDNYRKSHIPDGPGYSEKYYFSPGDTGFKVWQTKFGKFGAGICWDQWFPELARSLALHGAEAIFYPTAIGSEPQDPTLDSRDHWQRTMQGHSAANLVPVIASNRVGTEVDDGIETTFYGSSFITDHTGAKIAEAPREGETIIYAEIDLAATAKARHAWGLFRDRRPDLYTSVGKLAV

SEQ ID NO: 20410 - protein, 609 aa, Parachlorella kessleri
MQQALQTGPRTLPGSACQTVLPRFSGLRPAQQRSQRSYSAKLAANAQRAALSVSAAAATAVKPTLATPPTEKATKPMNIVFVSAEVAPWSKTGGLGDVAGALPIELAKRGHSVISIAPRYDQYWDAWDTGVTINVGGEQVRFFHSVKKGVHRVWVDHPWFLAKVWGMTGAKLYGSKSGADYIDNQKRFKMFCEAALQALRVLPFAPGEDCLIVANDWHSSLIPVLLKDVYQPRGEFKDTKVALCCHNIAFQGRFWADSWHELGLPDSSKPKFEFSDGYPKIFDETSPADESGRLADLAPAGKRFEKINWLRAGILSADKVLTVSPNYATEIASGPALGVELDTVIAKKGVEGVVNGMDVEEWNPALDKFLQFKYNAETVEAGKAYAKAALQKEAGLPVDPKAPLFGFIGRLEEQKGVDILLAALGKIPKSTNAQVVILGTGKKALEASVKNLTKAFPGRAAGVVKFSNPLAHLITAGSDFMLVPSRFEPCGLIQLHAMQYGTVPLVSSTGGLVDTVKEGVTGFHMGAFDPDTLLEADADAVAQTIARASEVFTTPAYKEMRNKCITQDLSWAKPAKKWEAILIELKYGPGPTPEATADKAAVTTPVQKI

SEQ ID NO: 20411 - protein, 705 aa, Saccharophagus degradans
MRTQNATITRLVLFLSLSLAISACNGNGPKQNTISEQTPPADQTPAQPDDTAGADTEGTEDPKETPDTENNSPTVRIHYLNSNQAYDNWGLHLWGDAIASSTATNWTSPFALTRAENDYGLYEVPLADPNGTFNFIMHFGDFKNPAYDFSIIPAQFGTDVWLVQDTPADVTNGVAIPFDNEADARAAYESLMANIGNASAALDLTDIEIKDSDTGLAADWVDTAHFAEIYIRGYQDSDGNGIGDIQGLISRLDYLAESGINGIWLMPAMESSDNDHGYATSDYRAIESDYGTMQDFQQLLDEAHARNIAIVMDYVMNHSSNANPLFQDALSSPTNSKRDWYIIRDDKLEGWNTWGSDPWKSNANGYYYAAFSSQMPDFNLRNPDVIRFHQNNLRFWLNMGVDGFRFDAVGVLVENGKDAWEDQDDNHPVINAMKTTIEAYQKRYIVCESPTGYAAFAQQNSCGRAFNFSAGHGILRSVKQGKLDAEFVEQLNASNIDAMPLILANHDAFAGIRVWDQLNGNKTHYKLAAASYLLASRNPFTYYGEEIGLAGAANLSGDWSIRTPMSWNNDPQNAGFSTAQPFRELSANVMTQNVEAQLGKTDSLLAYYRSIYDLRNAHPVIANGNLNVQGQANDNALVLVRTSDDAQAVILFNYSAQATSKSVSGLTASANYSGALGASNNVSANASGTATVTIPAQTAVVYIRQ

SEQ ID NO: 20412 - protein, 416 aa, Helicobacter pylori
MAYFLEQTDSEIFEFIVEEFKRQNEHLEMIASENYTFPSVMEAMGSILTNKYAEGYPNKRYYGGCEVVDKIESLAIERAKKLFNCQFANVQAHSGSQANNAVYHALLKLYDKILGMDLSCGGHLTHGAKVSLTGKHYQSFSYGVGLDGYIDYEEALKIAQSVKPQIIVCGFSAYPREIDFKKFREIADAVGALLLGDIAHVAGLVVANEHAHPFPHCHVVSSTTHKTLRGPRGGLILTNDEEIAAKIDKAIFPGTQGGPLMHVIAAKAVGFKENLKPEFKAYAKLVKSNMQVLAKTLKEKNHKLVSGGTSNHLLLMDFLDKPYSGKDADIALGNAGITVNKNTIPGETRNPFVTSGIRIGSAALSARGMGAKEFEIIGNKISDILNDINNVSLQLHVKEELKTMANQFPVYHQPIF

SEQ ID NO: 20413 - protein, 426 aa, Glycine max
MAIEHEDDLKDEKNPRPLDEDDIALLKTYGLGPYSTSIKKAEKEIKDMAKKVNDLCGIKESDTGLAAPSQWDLVSDKQMMQEEQPLQVARCTKIINPNSEDAKYVINVKQIAKFVVGLGDKVSPTDIEEGMRVGVDRNKYQIQIPLPPKIDPSVTMMTVEEKPDVTYNDVGGCKEQIEKMREVVELPMLHPEKFVKLGIDPPKGVLCYGPPGTGKTLLARAVANRTDACFIRVIGSELVQKYVGEGARMVRELFQMARSKKACIVFFDEVDAIGGARFDDGVGGDNEVQRTMLEIVNQLDGFDARGNIKVLMATNRPDTLDPALLRPGRLDRKVEFGLPDLESRTQIFKIHTRTMNCERDIRFELLARLCPNSTGADIRSVCTEAGMYAIRARRKTVTEKDFLDAVNKVIKGYQKFSATPKYMVYN

SEQ ID NO: 20414 - protein, 248 aa, Triticum aestivum
LSITHGVMTFEKTLAPVGAEGVVFPNGTLVVDGRPVAVVYFRAGYAPTDYPSEVEWSARLLIEQSSAIKCPSISYHLVGTKKIQQELAKPSVLERFLDNEEDIAKLRKCFAGLWSLDNEEIVKSAIEKPDLFVLKPQREGGGNNLYGHDLRETLIRLKNEQGEALAAYILMQRIFPRASLTQLVQGGVCFEELSISELGIFGSYLRNKDKVVINNQCGYLMRTKVSSSNEGGVAAGFAVLDSILLTDE

SEQ ID NO: 20415 - protein, 194 aa, Methanothermobacter thermautotrophicus
MITMRRSMKTRETLETHVKVDLEIDGSGKSSVNTGLGFLDHMLESVARHGLLDLEVEARGDLEVDDHHTVEDVALTLGEALREALGDKSGIRRMAHAMVPMDDALATVALDLSGRPYTVLELEFDDAVIGDVKSQNIGHFIESLAVSAAMNIHASVRGRNDHHKAEALFKALALAIRDAVRVEHGEIPSTKGKL

SEQ ID NO: 20416 - protein, 79 aa, Triticum aestivum
MSTNPSKYVFNHTMIRVKDPKASIKFYTEVIGMKLITSADYEQSKFTLYFLAFIDSVPESEEEKKKLAFSIPGVLELTQ

SEQ ID NO: 20417 - protein, 651 aa, Unknown
  Myxobacter sp. AL-1
MKAFFFVLLLTFAMLFMPASGKADIASAKESQNYAELLQKSILFYEAQRSGKLPESSRLNWRGDSALEDGKDVGHDLTGGWYDAGDHVKFGLPMAYSAAVLSWSVYEYRDAYEAAGQLDAILDNIRWATDYFIKAHTDRYEFWGQVGNGAQDHAWWGPAEVMPMKRPAYKIDAACPGSDLAGGTAAALASASRLRSTDAVNRDSFVRRASSSCAHAKELYDFADRYRGKYSDCITDAHEYYNSWSGYKDELTWGAVWLYLATGDQKYLDKALASVSDWGDPANWPYRWTLSWDDVSYGAQLLLARLTNESRFTASVERNLDYWSTGYNHNGSTERITYTPGGLAWLEQWGSLRYASNAAFLAFVYSDWVKDAGKAKRYRDFAVQQMNYMLGDNPQQRSFIVGYGTNPPKHPHHRTAHGSWADHMNVPENHRHTLYGALVGGPGKDDSYRDETNDYVSNEVAIDYNAAFTGNAAKMFQTVWCRAITAAHFPEKETPEDEFFAEASINSSGNNYSEIRVQLNNRSGWPAKKTDKLSFRYYVDLTEAVNAGFSSEDIKISTGYNEGASVSQLKPYHIGEHIYYTEVSFSGVMIYPGGQSAHKKEVQFRLAAPAGTSFWNPKNDHSYRGLSHTLAKTRYIPVYDEGRLVFGNEPD

SEQ ID NO: 20418 - protein, 223 aa, Candida albicans
MSREALINRITNETKIQIALNLDGGKLELKESIFPNQSIIIDEHHAKQVSGSQYINVQTGIGFLDHMIHALAKHSGWSLIVECIGDLHIDDHHTAEDVGISLGMAFKQALGQIKGVKRFGHGFAPLDEALSRAVVDLSNRPFAVIELGLKREKIGDLSTEMIPHVLESFAGAVGITIHVDCLRGFNDHHRAESAFKALAIAIKEAISKTGKNDIPSTKGVLSK

SEQ ID NO: 20419 - protein, 284 aa, Triticum aestivum
PRATSFSSNDEAFTWAKKDNRRLLHVVYRVGDIDRTIKFYTECLGMKLLRKRDIPEEKYTNAFLGYGPEETNFAIELTYNYGVDSYDIGAGFGHFGIATDDVAKTVELIRAKGGKVTREPGPVKGGKTVIAFIEDPDGYKFEILERPGTPEPLCQVMLRVGDLDRAISFYEKACGMKLLRKRDNPEYKYTIAMMGYGPEDQNAVLELTYNYGVTEYDKGNAYAQIAIGTDDVYKTAEVVKLSGGKVVREAGPLPGLGTKITAILDPBGWKSVFVDNIDFAKELE

SEQ ID NO: 20420 - protein, 188 aa, Thermobifida fusca
MVRVPRERSGTRSALGEASTYPVGAMTSQHDDQMTFYEAVGGEETFTRLARRFYEGVAADPVLRPMYPEEDLGPAEERLRLFLMQYWGGPRTYSERRGHPRLRMRHFPYRIGAEERDRWLTHMRAAVDDLALPAHLEQQLWEYLVYAAYAMVNVPEDAQPPMVQRSFTVTSNERDRGDEGETIRISLR

SEQ ID NO: 20421 - protein, 407 aa, Clostridium perfringens
MRYIVVGASAAGISGAKTLRELDKDAEIILVSKDENVYSRCILHHYISGHRDIEALDFTDRDFFEKYNIEWKKGLEVKAIDDREHVIVLSNGESLKYDKILLATGASAFIPPVENLREAKNVVGLRNLEDAIKIKEEAEKVKNVVVLGAGLVGIDAIAGLAFKDLNVTLVEMGDRVLPIQLDKYASSKYEKRFEDAGVKLKLGVRAEKVLIDENKNPKALLINTGEEIPCELIIVATGVRSNVAFLKDSSIETDRFGLIINEKGETNARDVYGAGDITGRNPIWPTAVKEGIIAANNMVGNEIFMEDFFGSKNTMNFLGLTTMSLGVVNAPDDSYTEEIDISGENYKKIIHKDGKIYGAIIQGDLSYAGVLTQLIKEKIHVSKVKKPLFEIDYADFFNIKENLEYTY

SEQ ID NO: 20422 - protein, 219 aa, Zea mays
  misc_feature (24)..(24): Xaa can be any naturally occurring amino acid
MARRASLLLAAALLVAVAAAAVPXPTCERIECPAYEVVDSANGFEIRRYTDAMWITTAPIEDISFVAATRTGFLQLFDYIQGKNAYNQTIEMTAPVLTRVSPSDGPFCASAFAVSFYVPAKNQADPPPAEGLRVDRWAGARYAAVRRFGGFVADADVGEQAARLEASLQGTRWAAAVNDARRADPASPYTVAQYNSPFEFTGRVNEIWMLFDADDDASM

SEQ ID NO: 20423 - protein, 264 aa, Solanum tuberosum
MAELREKWCLKGTTALVTGGSKGIGYAIVEELANFGARVYTCSRNENELQECLDIWRKKGLKVEGSVCDLLSRTEREKLMKTIEDVFDGKLNILVNNAGVAIHKEAKDFTKEDYNIIMGTNFEAAYHLSQIAYPLLKASQNGNVIFVSSIAGFSALPSLSLYSASKGAINQMTKNLACEWAKDNIRVNSVAPAVILTPQIETAIKKNPQQKEEIDSIVVKTPLGRAGKPEEVSAVIAFLCFPAASYITGQIIWADGGFTANGAF

SEQ ID NO: 20424 - protein, 224 aa, Pichia pastoris
MTGEHKRSSLIKRITNETKIQIALSLDGGPVSLAQSLFKDKDYSAEHAAQATSSQFISVNTGIGFLDHMLHALAKHGGWSVIIECVGDLHIDDHHSAEDTGIALGMAFKEALGHVRGIKRFGSGFAPLDEALSRAVIDMSNRPYAVVDLGLKREKIGDLSCEMIPHVLESFAQGAHVTMHVDCLRGFNDHHRAESAFKALAIAIKEAISSNGTDDIPSTKGVLF

SEQ ID NO: 20425 - protein, 353 aa, Alteromonadales bacterium
MSNPYLFIDRDGTIIEEPITDKQVDSLEKLAFLPGVIPALLQLQAAGYRLVMVSNQDGLGTDSFPTADFDIAQDKMMDIMQSQGISFDEVLICPHFDEQNCDCRKPKTGLLTELMRSGKVDLARSYVIGDRQTDIGLAQNLCCEGILYDGSWPAIVTKLTTANREGRVTRNTKETQIDVAINLDQTKNGSIETGLGFFDHMLDQIRTHANIGLNIKAKGDLHIDEHHLVEDIGIALGVALKQALGTKSQIARYGFALPMDECKAEAQIDLSGRASFVLNANFSREKAGDLDVQMVEHFFKSLSDNAAISLILSVSDGNCHHQVEGLFKAFSRALRMAVAQDTTQQTASSKGCL

SEQ ID NO: 20426 - protein, 468 aa, Saccharomyces cerevisiae
  misc_feature (1)..(1): Xaa can be any naturally occurring amino acid
  misc_feature (13)..(13): Xaa can be any naturally occurring amino acid
  misc_feature (91)..(91): Xaa can be any naturally occurring amino acid
  misc_feature (110)..(110): Xaa can be any naturally occurring amino acid
  misc_feature (170)..(170): Xaa can be any naturally occurring amino acid
  misc_feature (273)..(273): Xaa can be any naturally occurring amino acid
  misc_feature (384)..(384): Xaa can be any naturally occurring amino acid
XGSDKIHHHHHHXSSSQQIAKNARKAGNILKTISNEGRSDILYKIHDALKANAHAIEEANKIDLAVAKETGLADSLLKRLDLFKGDKFEVXLQGIKDVAELEDPVGKVKXARELDDGLTLYQVTAPVGVLLVIFESRPEVIANITALSIKSGNAAILKGGKESVNTFREXAKIVNDTIAQFQSETGVPVGSVQLIETRQDVSDLLDQDEYIDLVVPRGSNALVRKIKDTTKIPVLGHADGICSIYLDEDADLIKAKRISLDAKTNYPAGCNAXETLLINPKFSKWWEVLENLTLEGGVTIHATKDLKTAYFDKLNELGKLTEAIQCKTVDADEEQDFDKEFLSLDLAAKFVTSTESAIQHINTHSSRHTDAIVTENKANAEKFXKGVDSSGVYWNASTRFADGFRYGFGAEVGISTSKIHARGPVGLDGLVSYQYQIRGDGQVASDYLGAGGNKAFVHKDLDIKTVTL

SEQ ID NO: 20427 - protein, 300 aa, Enterococcus faecalis
MKKAVLIVNPSSGGEKAKEFETLAEEKLKQLFDEVVVKQTEKGGDAEQFAREAAESHFDSVFVMGGDGTVNEGISGLAEQAYRPKFGFFPLGTVNDLARALNLPMDPEEAIQQLDLEKTSALDVGKINDDYFMNVVAIGTIPESINDVDVEQKTKLGKLAYFISGAKHLANAQTYPFHLSLDQKEQTIESSTVLVGLTNSIGGFETLLPEAQVDDGKLHLVYLKDQSLWDAVKAVPDLLKGVDQSTDNLVYLTFKEGTISLENQEELTTNVDGDEGAALPITLKILPKHLTVYCGEEQTK

SEQ ID NO: 20428 - protein, 256 aa, Triticum aestivum
MEPSSQPEPVVGVATAGSQAYPPPAAYPAPAMPAAIPPGSQPAVPFPANPAQLSAQHQLVYQQAQQFHQQLQQQQQQQLREFWATQMEEIEQATDFKNHTLPLARIKKIMKADEDVRMISAEAPVVFAKACEVFILELTLRSWMHTEENKRRTLQKNDIAAAITRTDIYDFLVDIIPRDDMKEEGLGLPRVGLPPAALGAPADAYPPYYYVQAQQVPGVGMMYGGQQGHPVAYAWQQPQGQQAEEAPEEQQQSPSN

SEQ ID NO: 20429 - protein, 552 aa, Cryptococcus neoformans
MGQTLSEPMTEKHTTDVVRGKQFWVGLSDMQGWRISMEDAHSVHLYLPPSSDDSKPHSPASDVPAQPEGSTVTNHNEPEVANAMFGVFDGHGGQTVAKFAGTTLHSRLSALDAYKSGDYITALTQAFIKTDEDLRADPSFLNDPSGCTAVVGLITTDGRIIVANSGDSRSVLGYQGQAKALSNDHKPTNEEETARITAAGGFVEFGRVNGNLALSRAMGDFEFKQNFSLAPEKQIVTVVPEIITHELDGEEEFLVLACDGIWDCLTSQQVIDFTRRAIANGDPLGKICENMMVKCLAKDSSTGGIGCDNMTVVIVALLNGRTPEEWQAWVKERVEQKVGHDTPESIPDVFPQNSGPSNSGFAGSGFRVAGGAGGLANIASILGASGITFRPAYDSDDDDDGIQLMGDGPVSPDKLSSPGLIDNEAVEGGTKPKDVTGQLEKEEEETMFGGEGKKGSVRLLDEDGDSSMDSDDSDSTTTGNDPAPQPIPSSSHQATHSPIPPNFSSIGSPTVPTPQELQGLQASNRSEPQGDAYSDAVKVEGLMDKSESPLNL

SEQ ID NO: 20430 - protein, 234 aa, Oryza sativa
  misc_feature (136)..(136): Xaa can be any naturally occurring amino acid
MAGGGDELKLLGMWASPFALRAKLALSFKGLSYEYVEEDLKNKSELLLTSNPVHKKVPVLIHNGKPVCESQVIVQYIDEAFPDAGVPLLPSDPYDRAVARFWAAYIDDKLLKSWLQASMCKTEQEKAAAMKETFAXAVANLEAAFKECSKGKPFFGGDAVGYVDVTLGAVIGFVRVGEAVHGMRLFDASRSPLLDAWLDRFAALDAAKAVLPDTGRLAEYAKMKQAEWAAAATN

SEQ ID NO: 20431 - protein, 367 aa, Mycoplasma penetrans
MPKKAEAKTGSSSKTTKRTVAKKDVKAEVNETNKTAEKVSSKKVNKTANSVDTNESSSNSTPSTGSKFELSSFKEKVAEIENNILQKIKENPTITGKPFRKLVSVNKLMETGAHIGLTTRKWNPKMKKFIYTKKGNNHIIDLLHTVISLNVAYNFLLDLVKANSNSESSPVLIVGTRGKTIKNHVKEQAKRSHAFYINERWLGGTLTNFSTITKSVAKFNNLILIHKNGEINKYTKKEQVELKKKTEKYAKYFSGIRTMKELPKVIILTDPEINKIAIKEARNLGIPVIAICNTNANPDLVDYVIPANNHSIKSVYLLVGLLCDAVAEAKGLPKAFAEKKDEEILLPEVIKRKPENRRQNNHSFNKN

SEQ ID NO: 20432 - protein, 139 aa, Triticum aestivum
  misc_feature (31)..(31): Xaa can be any naturally occurring amino acid
DGGVLREITMHDLLETIHICETDHLAIDVSXDSLPPLYVGYKDPGDRLHVGDARQLLRNSPEGKYDAINCDSSDPIGPAQELVEKPFFQTIAWASKPGRVLHNIAESMMVYTHVIQDMLSICREGFMAGLPYAWASVTT

SEQ ID NO: 20433 - protein, 451 aa, Unknown
  Mycobacterium sp. JLS
MTETDHAHDAVSADNLPSGDEFFHRGNYAPVADELTAFDLPVEGQIPADLQGWYLRNGPNPRQPSAHWFTGDGMIHGVRIENGRAAWYRNRWVRTESFEQHFPVYNSDGSRNLHSSVANTHVVNHAGKTLALVESSLPYEITNDLQTVGAYDFGGKLVDSMTAHPKICPTTGELHFFGYGNLFEPYVTYHRADADGELTVNRPLDVKALTMMHDFAMTSGHVVFMDLPIVFDMGIALEGKGDMPYRWDDDYGARLGVLRRDDPFGEVRWFDIDPCYVFHVANAYEDGNTLVLQAVRYPELWRGTGGFEAEGVLWSWTLDLATGTVRERQLDDRAVEFPRIDDRLAGLPARYAVSVGDQRLVRYDLTSGTAVEHAFGTADAPGGPGEAVFVPATSGPADEQNGWYMAYVYDPQRDGSDLVILDAADFGAPPVARVQLPQRVPYGFHGNWIAG

SEQ ID NO: 20434 - protein, 700 aa, Zea mays
MSVSPSSLCGGDPAMRIVVWFRRDLRVEDNPALAAAARAGGEVVPAYVWSPEEEGPYYPGRVSRWWISQSLNHLDASLRRLGAGKLVTRRSADAAVALLQLVRDTGATHVYFNHLYDPISLVRDRRLKEMLAAEGIVVQSFNSDLLYEPWEVVDDEGQPFTMFDPFWNRCLSMPYDPPAPLLPPKRINSGDLSMCPSEDLIFEDESERGSNALLARAWTPGWQNADKALTAFLNGPLADYSVNRKKADSASTSLLSPHLHFGELSVRKVFHLVRMKQLVWSNEGNHAAEESCTLFLRSIGLREYSRYLSFNHPSSHERPLLAHLRFFPWVVDESYFKIWRQGRTGYPLVDAGMRELWATGWLHDRIRVVVASFFVKVLQLPWRWGMKYFWDTLLDADLESDALGWQYITGSLPDGRELDRIDNPQFEGYKFDPHGEYVRRWIPELARLPTEWIHHPWDAPVSVLQAAGIELGSNYPLPIVELDAAKGRLQAALSEMWQLEAASRATMNNGTEEGLGDSSEVLFPQELQMEVDRQPAPAEAAANVHVPVPMPARRRGDQMVPTMTTSSLNRAGTEVSADLVVANSEEEDTRAQVPFHAHLHPRAEAPPAARRTNNGARQHDVFQQPRNHRREALLAPSASEASSSWTGREGAVVPVWSPPAASGHSDAFAADEADVSSRSYLGRHPQSHRLMNWSQLSQSS

SEQ ID NO: 20435 - protein, 92 aa, Unknown
  Alstroemeria hybrid cultivar 'Samora'
AKIQDKEGIPPDQQRLIFAGKQLEDGRTLADYNIQKESTLHSVLRLRGGMQIFVKTLTGKTITLEVESSDTIDNVKAKIQDKEGIPPDQQRL

SEQ ID NO: 20436 - protein, 127 aa, Candida albicans
MSSVQTTVASEYSSEIQTVPIEHRFNPYSDNGGTVLGIAGEDFAVLAGDTRQVEGYSIQSRYESKIHDVGDDILMTANGFAADGVALIDRFKQSLIWYKFDNNGKKLAIKSAARYIQQLLYGKRFFP

SEQ ID NO: 20437 - protein, 218 aa, Bdellovibrio bacteriovorus
MIKSKVRTASKGFPRAFSCDLPPPPLEYAHQGETMRIFTLIALILCTSFAWAKDTPSSFFDLSANSLSGKKVNFSTYRGKVVLVVNTASQCGFTPQLKELEEMYKKYADRGFVVLGFPSNDFKQEKGTNDEVQTFAAKEFGVTFPLFDKAPVSGKDIQPVYQFLTTQKPGLIFKDVAWNFEKFLINRKGQVVERWSSITKPSSDSITKSVEKALNEPL

SEQ ID NO: 20438 - protein, 157 aa, Brassica napus
AEKSVLRGCSEKLADSEPFPAAGCAIATGLASCTEFEKKPLFVTKNWRNMLCKCEKCLEMYSERKVSYLLDAEDTIAEYENKAKEKRTEKLEEQEGEALDHFNNLDHVTKVELSHGIKDFKEGFRSLLESVGTSRAITSEDVEEMFSKLKNKRKRME

SEQ ID NO: 20439 - protein, 72 aa, Cytophaga hutchinsonii
MSKQSSIEQDGKILEALSNAMFRVELSNGHQVIAHISGKMRMNYIKILPGDKVRMEMSPYDLTKGRIVFRYK

SEQ ID NO: 20440 - protein, 485 aa, Candida albicans
MSIKPFPELSHDQEKELVTNLSQWSLGNGLVMYPPNFEGFQANVAPITLFPTPIPKESFHRAVKVQKLFNELYINVITKDVKWFSSILEDLSKHDSEFTGRLFEVYQKSSKIQPLSLGLFRSDYMIHQDTNEIKQIEFNTVSVSFGGLSSKIGQLHQYLNGTGQYDSKYNYKYYDDEDEIPVSTSASDLAQGLADGNFYYHNGEPKTSSVVLFIVQPNERNSFDQRHVEYALFKEHGIKSVRFTLEEVEEHVTVNQNRLYIKSTMDEVSVVYYRSGYAPSDYDVNPEKTWAARLLLEDTLAIKCPSVLTQLSGTKKVQQLLTKKEVISKFLSNSSDQELNEVLSTFVAIYSLDDSNEGDTGRKLAFEEPEKFVLKPQREGGGNNVYKENIPSFLEKLDKQEWGAYILMELINPPTHKNKIIRNNEVFHEDIISELGVFGTTVFNEKTGEILTNKNAGWLLRSKFSNSNEGGVAAGFGCVDNIYLY

SEQ ID NO: 20441 - protein, 421 aa, Burkholderia xenovorans
MDTPARLNDLQRTTLAIVLAGGRGTRLGPLTNKRVKPAVHFGGKYRIIDFALSNCLNSGIRRIAVVTQYKAHSLLRHLQRGWSFLRGEFGEFIDLWPAQQRVEGAHWYRGTADAVFQNLDIIRSIRPKYVVVLAGDHIYKMDYTRMIADHAESGADCTVGCIEVPRMDAVAFGVMHVDENRRVTGFVEKPADPPAIPGRPDTALASMGIYVFSADYLYSLLEENISSVDTDHDFGKDILPRVVTQGTAIAHPFSMSCVSSDPNVEPYWRDVGTIDAYWAANLDLASTIPTLDLYDRSWPIWTYQEQLPPAKFVRDMKGLQGSGNNLIVCGGCVISGSQISRSVLSSNVKVSSFCNINEAVLLPQVTVGASCRLQKVVIDRGCAIPDGTVIGEDPVSDAERFYRTDDGVVLVTPEALRQMPK

SEQ ID NO: 20442 - protein, 72 aa, Clostridium thermocellum
MSKEDVIEVEGKVVEALPNAMFEVELENGHKVLAHISGKLRMNFIRILPGDKVTVELSPYDLTRGRITWRAK

SEQ ID NO: 20443 - protein, 82 aa, Oryza sativa
NEIRKVEEGVWDKKDNPLKNAPHPADHVNATEWNHCYSREEAAYPLAWVKTRGKYWPPVGRVDNAFGDRNLVCTCDPITDYF

SEQ ID NO: 20444 - protein, 809 aa, Leptospira interrogans
MEEIKSSTIIPENIAVLGGGPMGIYLSTYLSPKAKEIYLWYDDRKRAAKIEKERIATILEDSISIPENVRIQSEFDFLKNGSWALIIAVPSRLMEGILDELSKVLDKNSSHFIFTFTKGLLSSSTRKKTNCITYSEYLQKLCVAGKFKNIEYTAVNGPNLLGELKRGHHSFYCLASSGTQSIEIFETLFCGSRNHTKTYEDLIGLEVSGAMKNPIAIACGIASGIPECGSNFEGELISLGYSEIITLLKALEIPIQPVQEYGLADLIASCTSRYSRNKAYGHRFVHKLISGEDRPNLIERIELFFNPAEFIQKEVSQSESHVEGAFALASIISLAEEKKVEIPLYDTLFQILTRRVSPTELIRFVSKSTSDEVHHISKIATKRSGLGMASGKKFQEALSKNVLRRINGQPGMTDRILKQSSLLIKSLEKRYQEAKESNDVTDLLQIPKEIQFWSEVEKKFQETGNKDLTKILDFYVTEIADDYKPFLRDTLIHLIAPARYVLSGFKSGAGLPKIGGCVKEVKALASRYDILYTPTHRSHLDSIEVAFGLKWLGLPVPRYAADKKVMATPGLASVLKSLGAYMVDRKRNRNILYLECLTQYSTMMLEAGIPTLVYPEGTRSRTGGILPIKTGILSTSVEAYKHTGSEVIVVPIVLSYENVPEDEEFCGKDKKSGFKDFFYKRKEVYMDLCEPIPVSRYIHEEDPTGSIGFEITQGWKKYRRILPNQLVARMIVESGGEVNTNELRNLIKETLLTKKGNYLIQDSNEILKRGLKILKQKKIIFLENGNLKILDKDLIQYYANMCSDESSYS

SEQ ID NO: 20445 - protein, 557 aa, Escherichia coli
MTESFAQLFEESLKEIETRPGSIVRGVVVAIDKDVVLVDAGLKSESAIPAEQFKNAQGELEIQVGDEVDVALDAVEDGFGETLLSREKAKRHEAWITLEKAYEDAETVTGVINGKVKGGFTVELNGIRAFLPGSLVDVRPVRDTLHLEGKELEFKVIKLDQKRNNVVVSRRAVIESENSAERDQLLENLQEGMEVKGIVKNLTDYGAFVDLGGVDGLLHITDMAWKRVKHPSEIVNVGDEITVKVLKFDRERTRVSLGLKQLGEDPWVAIAKRYPEGTKLTGRVTNLTDYGCFVEIEEGVEGLVHVSEMDWTNKNIHPSKVVNVGDVVEVMVLDIDEERRRISLGLKQCKANPWQQFAETHNKGDRVEGKIKSITDFGIFIGLDGGIDGLVHLSDISWNVAGEEAVREYKKGDEIAAVVLQVDAERERISLGVKQLAEDPFNNWVALNKKGAIVTGKVTAVDAKGATVELADGVEGYLRASEASRDRVEDATLVLSVGDEVEAKFTGVDRKNRAISLSVRAKDEADEKDAIATVNKQEDANFSNNAMAEAFKAAKGE

SEQ ID NO: 20446 - protein, 342 aa, Unknown
  marine gamma proteobacterium HTCC2207
MTFIRNRWYIAAWDGEVANAPLSRKICGETIVLYRKLNGSVVALRDACPHRLLPLSLGTREGDNLRCKYHGMLIGPDGSPEEMPLTNQRVNKQISTQSYNVVEKYRYIWVWIGEQDKADPETVPDFWPCDSEGWVFDGGYMHVQCDYRLFIDNLMDLTHETYVHAGSIGQKELMESPLETSVNGNKVTLSRWIPNISPPPFWRDALQKDTPVDRWQICEFIEPCSVNIDVGVSPIENLDSLEDHNSGVRGFVIDSMTPETEESCHYFWGMARNFRIDDQGLTQRIRAGQAAIFHEDIEILERQQQSIADNPDMALRVLSIDSGGAHARRSISKLMEIENGKK

SEQ ID NO: 20447 - protein, 904 aa, Nicotiana benthamiana
MAASVENRQFSHLEAGLSRSFKPRSDSPVRGCNFPSPNSTNFQKKPNSTIYLDYSSSEDDDDDDEKNEYLQMIKKGNSELEPSVHDTRDEGTADNWIERNFSMIRLTGKHPFNSEPPLNRLMHHGFITPVPLHYVRNHGPVPKGTWDDWTVEVTGLVKRPMKFTMDQLVNEFPSRELPVTLVCAGNRRKEQNMVKQTIGFNWGAAAVSTTIWRGVPLRALLKRCGIFSKSKGALNVCFEGADVLPGGGGSKYGTSIKKEFAMDPARDVIVAYMQNGEKLTPDHGYPVRMIIPGFIGGRMVKWIKRIIVTTQESDSYYHFKDNRVLPPHVDAELANTEAWWYKPEYIINELNINSVITTPCHEEILPINAWTTQRPYTLRGYSYSGGGKKVTRVEVTLDGGETWQVSTLDHPEKPTKYGKYWCWCFWSLEVEVLDLLSAKEIAVRAWDETLNTQPEKLIWNVMGMMNNCWFRVKMNVCKPHKGEIGIVFEHPTLPGNQSGGWMAKERHLEISAEAPPTLKKSISTPFMNTASKMYSMSEVRKHSSADSAWIIVHGHIYDATRFLKDHPGGTDSILINAGTDCTEEFDAIHSDKAKKLLEDFRIGELITTGYTSDSPGNSVHGSSSFSSFLAPIKELVPAQRSVALIPREKIPCKLIDKQSISHDVRKFRFALPSEDQVLGLPVGKHIFLCAVIDDKLCMRAYTPTSTIDEVGYFELVVKIYFKGIHPKFPNGGQMSQYLDSMPLGSFLDVKGPLGHIEYQGKGNFLVHGKQKFAKKLAMLAGGTGITPIYQVMQAILKDPEDDTEMYVVYANRTEDDILLKEELDSWAEKIPERVKVWYVVQDSIKEGWKYSLGFITEAILREHIPEPSHTTLALACGPPPMIQFAINPNLEKMGYDIKESLLVF

SEQ ID NO: 20448 - protein, 412 aa, Rhodococcus erythropolis
MTSDIVVIGGGVAGVSAVQSLRSEGYDGRLFLIGKERELPYDRTSLSKAVLAGDLADPPPLAPADWYDELQVETVLDRTVLQVDVTRKEVLLDGGRSLEVDRVLLATGASARVPSFSGADLPGVTTLRTVDDAQRLRQDWEPGQRLVVVGGGLIGCEVATTARKLGLEVSILEASDELLQRVLGRRIGGWCRARLEELGISVMVNTGVAEFDGVDRITAVIGTDGRRFPADSAIVCVGAEPETAIAEQAGLACSRGIIVNDSGGTAAEGVFAAGDAASWPLRTGGRRSLETYINSQKEATAVASAMLGKAVHAPQLPLSWTEIAGHRIQMIGDIEGSGEYVMRGAPDDGPALLFRLTDGKLTAALSVDAPREFAMATRLVESGAQVGRDVLADTSVELRELNRAARERTTAA

SEQ ID NO: 20449 - protein, 257 aa, Unknown
  uncultured bacterium
MHDIDYGEVWLVGAGPGDPDLLTRKAERLMCAASVVFYDALVSEGVLALIPDHVRKVPVGKRSGRHSKDQGSINTLLVEAALGGERVVRLKGGDPSMFGRSMEEVAALAEVGVRARICPGVTAASAAAASAGISLSLRGLARRVQFVTAHARAGEPLDLDWGQLADPGATTAFYMGRSAASDISRNLIAHGLDPKTPVLIACDVSLASERCLRTRLDLLPLAVQAVTEGKPTLILVGEAVRQNDAAEIAQIAARAQG

SEQ ID NO: 20450 - protein, 281 aa, Pisum sativum
MELYAASHSLPNYPSSFLFKPKITTFHTTLFPTKFAPFKASFFSPNHLTLTTPMNPPTTSLSSAAFVEHNNGSTSTSLPFHPETRVGEVKRVTKETNVSVKINLDGSGVADSSTGIPFLDHMLDQLASHGLFDVHVKATGDVHIDDHHTNEDVALAIGTALLQALGDRKGINRFGDFSAPLDEALIHVSLDLSGRPHLSYNLDIPTQRVGTYDTQVVEHFLQSIVNTSGMTLHIRQLAGRNSHHIIEATFKAFARALRQATEYDPRRRGSVPSSKGVLSRS

SEQ ID NO: 20451 - protein, 409 aa, Corynebacterium glutamicum
MVKGVKGRPNVLAIVLAGGEGKRLFPLTEDRAKPAVPFGGTYRLIDFVLSNLVNSGFLKIAVLTQYKSHSLDRHISLSWNVSGPTGQYIASVPAQQRLGKRWFTGSADAILQSLNLISDEKPDYVIVFGADHVYRMDPSQMLDEHIASGRAVSVAGIRVPREEATAFGCIQSDVDGNITEFLEKPADPPGTPDDPDMTYASMGNYIFTTEALIQALKDDENNENSDHDMGGDIIPYFVSRNDAHVYDFSGNIVPGATERDKGYWRDVGTIDAFYECHMDLISVHPIFNLYNSEWPIHTTSEGNLPPAKFVRGGIAQSSMVSSGSIISAGTVRNSVLSNNVVVEEGATVEGAVLMPGVRIGKGAVVRHAILDKNVVVRDGELIGVDQVRDAQRFKVSAGGVVVVGKNQVV

SEQ ID NO: 20452 - protein, 305 aa, Aspergillus nidulans
MEDAHAAVLDLQAKQSGSNDQPTDPDRRLAFFGVYDGHGGDKVALFAGENVHKIVAKQETFLKGDIEQALKDGFLATDRAILEDPKYEEEVSGCTAAVSIISKKKIWVANAGDSRSVLGVKGRAKPLSFDHKPQNEGEKARISAAGGFVDFGRVNGNLALSRAIGDFEFKKSPELSPEQQIVTAYPDVTVHELTEDDEFLVIACDGIWDCQSSQAVVEFVRRGIAAKQDLYRICENMMDNCLASNSETGGVGCDNMTMVIIGLLNGKTKEEWYNQIAERVANGDGPCAPPEYGKSLEEPTASNPY

SEQ ID NO: 20453 - protein, 501 aa, Saccharophagus degradans
MNQTLQPRPRPELNFWQIWNMCFGFIGIQFGFALQTANVSRIFQTLGAEIDAIPILWIAGPITGLLVQPIIGYMSDRTWNRFGRRRPYFTIGAVAATACLFIMPHSPALWMAAGMLWIMDASFNIAMEPFRAFVGDMLPPKQRTQGFATQSFFIGVASVVASALPWMLTNWLGMENTAPEGEIPSTVVYAFYFGGAVLVTTVMWTVFRTKEYTPEEIAAFNQYEQHNDSQADTSDDHKNYVAGGIGFAAVAIASTIAIHYFELREELYILAGLAAMFGGLQLIAHILQSKGRIHNAIYQITHDLFNMPRTMVQLAIVQFFSWFALFALWIYTTPAVTAFHYGTSDTTSAMYNKGADWVGIMFAAYNAFAALAAFFIPIMARRWGQKTTHCINLMLGAAGYISMMLIKDPSWLWVSMIGIGFAWASILSLPYAMLSGALPSSKLGLYIGIFNFFIVIPQILAASVLGIAVSGLFDGQAIYALVLGGVFLIIAALATLKVNDQ

SEQ ID NO: 20454 - protein, 426 aa, Thermobifida fusca
MTYLLGLRLQGRDVLVVGGGQVAQRRVPVLLEAGARVTVVSPHVTTALQGLAESGRIHWEQRPYRRGDVTGLGRFWLVHAATDDPEVNAAVVAEAEEARIWSVHADDRHASSAWTPATGSASGVTVGVITGTDPRRAAGLRDAIVTGLADGTLDARRGRAPLRGVALVGGGPGDPGLITVRGRQLLAQADVVVVDRLAPTSLLDQLSGDVEIIDAAKIPYGRSMSQEGINAVIVDRARQGKFVVRLKGGDPFVFGRGGEELAACVAAGIPVTVVPGVTSALAAPASVGIPVTHRGVAQHFHVVSAHVAPGDERSTVNWETLARSGGTIVVLMGVERLGRIAEALIRYGRDPHTPIAVIQEATLPSQTTLVATLETVEKEAHAAGVHPPAVLVIGEVVNTAQELDILHRSQNAAETPIAPAGGNGRN

SEQ ID NO: 20455 - protein, 267 aa, Carya cathayensis
MAASTMALSSPSLAGQAIKLAPSSSDLLGEGRVTMRKTAGRPKPVSSGSPWYGPDRVKYLGPFSGEPPSYLTGEFPGDYGWDTAGLSADPETFAKNRELEVIHSRWAMLGALGCVFPELLARNGVKFGEAVWFKAGAQIFSEGGLDYLGNPSLVHAQSILAIWATQVILMGAVEGYRIAGGPLGEVTDPIYPGGSFDPLGLADDPEAFAELKVKELKNGRLAMFSMFGFFVQAIVTGKGPLENLADHLADPVNNNAWAYATNFVPGK

SEQ ID NO: 20456 - protein, 401 aa, Arabidopsis thaliana
MALQAAYSLLPSTISIQKEGKFNASLKETTFTGSSFSNHLRAEKISTLLTIKEQRRQKPRFSTGIRAQTVTATPPANEASPEQKKTERKGTAVITGASSGLGLATAKALADTGKWHVIMACRNFLKAEKAARSVGMSKEDYTVMHLDLASLESVKQFVENFRRTEQPLDVLVCNAAVYQPTAKEPSFTAEGFEISVGTNHLGHFLLSRLLLDDLKKSDYPSKRMIIVGSITGNTNTLAGNVPPKANLGDLRGLASGLNGQNSSMIDGGEFDGAKAYKDSKVCNMLTMQELHRRYHEETGVTFASLYPGCIATTGLFREHIPLFRLLFPPFQKYITKGYVSEEEAGKRLAQVVSDPSLGKSGVYWSWNNNSSSFENQLSKEASDAEKAKKLWEVSEKLVGLA

SEQ ID NO: 20457 - protein, 956 aa, Arabidopsis thaliana
MERARRLAYRGIVKRLVNDTKRHRNAETPHLVPHAPARYVSSLSPFISTPRSVNHTAAFGRHQQTRSISVDAVKPSDTFPRRHNSATPDEQTHMAKFCGFDHIDSLIDATVPKSIRLDSMKFSKFDAGLTESQMIQHMVDLASKNKVFKSFIGMGYYNTHVPTVILRNIMENPAWYTQYTPYQAEISQGRLESLLNFQTVITDLTGLPMSNASLLDEGTAAAEAMAMCNNILKGKKKTFVIASNCHPQTIDVCKTRADGFDLKVVTSDLKDIDYSSGDVCGVLVQYPGTEGEVLDYAEFVKNAHANGVKVVMATDLLALTVLKPPGEFGADIVVGSAQRFGVPMGYGGPHAAFLATSQEYKRMMPGRIIGISVDSSGKQALRMAMQTREQHIRRDKATSNICTAQALLANMAAMYAVYHGPAGLKSIAQRVHGLAGIFSLGLNKLGVAEVQELPFFDTVKIKCSDAHAIADAASKSEINLRVVDSTTITASFDETTTLDDVDKLFKVFASGKPVPFTAESLAPEVQNSIPSSLTRESPYLTHPIFNMYHTEHELLRYIHKLQSKDLSLCHSMIPLGSRTMKLNATTEMMPVTWPSFTDIHPFAPVEQAQGYQEMFENLGDLLCTITGFDSFSLQPNAGAAGEYAGLMVIRAYHMSRGDHHRNVCIIPVSAHGTNPASAAMCGMKIITVGTDAKGNINIEEVRKAAEANKDNLAALMVTYPSTHGVYEEGIDEICNIIHENGGQVYMDGANMNAQVGLTSPGFIGADVCHLNLHKTFCIPHGGGGPGMGPIGVKNHLAPFLPSHPVIPTGGIPQPEKTAPLGAISAAPWGSALILPISYTYIAMMGSGGLTDASKIAILNANYMAKRLEKHYPVLFRGVNGTVAHEFIIDLRGFKNTAGIEPEDVAKRLMDYGFHGPTMSWPVPGALMIEPTESESKAELDRCLRCSHFNQGRNCTD

SEQ ID NO: 20458 - protein, 227 aa, Rickettsia prowazekii
MTNNLSGYRNKIVRVKTSKKRPISSSNWLRRQLNDPYVAKARLEGFRSRAAYKLLEIHYKFRLFTPNMKIVDLGAAPGGWSQVASKLIKASDNNLNNKIISIDLLEIEPIVGVEFLQKDFFEKDTEELIIHNLEGKADIVMSDMASNTIGHKATDHMRTLLLCEQAFEFALKVLKPSCHFIAKIFRGGAETALLNKVKREFRTVKHFKPVSSRSESTEIYLVALNKK

SEQ ID NO: 20459 - protein, 173 aa, Zea mays
  misc_feature (28)..(28): Xaa can be any naturally occurring amino acid
  misc_feature (98)..(98): Xaa can be any naturally occurring amino acid
  misc_feature (132)..(132): Xaa can be any naturally occurring amino acid
LIPSFIRRRRLLSAGVTCSTTPARCYRXLKNTPYSMTCYCRAVPDPKIWIYPVGMNRNCACDIPYCEHLVSCENDNVSPEALDAHRIALPLYLTQSAXHHAFHLRVRLHPFHALRINKMTFVLLTTDRLPVXMRCGFGKTQGTCAREYIVHCLLSVRCLDNHAAHAIVALLQA

SEQ ID NO: 20460 - protein, 72 aa, Geobacillus kaustophilus
MAKDDVIEVEGTVIETLPNAMFRVELENGHTVLAHVSGKIRMHFIRILPGDRVTVELSPYDLTRGRITYRYK

SEQ ID NO: 20461 - protein, 680 aa, Brassica napus
MSNSCSGGGGCSIVWFRRDLRVEDNPALAAAVRAGPVIAVFVWAPEEEGHYQPGRVSRWWLKNSLAQLDSSLRSLGTCLITKRSTDSVASLLEVVKSTGASQIFFNHLYDPLSLVRDHRAKDALTAEGIAVKSFNADLLYEPWEVTDELGRPFSMFAAFWERCLSMPYDPESPLLPPKKIISGDVSKCVADTLIFEDESEKGSNALLARAWSPGWSNADKALTTFINGPLIEYSKNRRKADSATTSFLSPHLHFGEVSVRKVFHLLRIKQVAWANEGNQAGEESVNLFLKSIGLREYSRYISFNHPYSHERPLLGHLKFFPWAVDENYFKAWRQGRTGYPLVDAGMRELWATGWLHDRIRVVVSSFFVKVLQLPWRWGMKYFWDTLLDADLESDALGWQYITGTLPDSREFDRIDNPQFEGYKFDPNGEYVRRWLPELSRLPTEWIHHPWNAPESVLQAAGIELGSNYPRPIVGLDEAKARLHEALSQMWQLEAASRAAIENGSEEGLGDSTEFVEAPIEFPRDITMEETEPTRLNPVRRYEDQMVPSITTSLIRPEEDQESSLSLRNSGGDSRAEVPRNMVNTNQARQQEARADPVSNQVTAMIPEFNIRIVAENTEESTAESSSSGRRERDGGIVPEWSGYSEQFASEENGIGGGSTTSSYLQNHHEIVNWRRLSQTG

SEQ ID NO: 20462 - protein, 110 aa, Triticum aestivum
  misc_feature (92)..(92): Xaa can be any naturally occurring amino acid
ADFAADKAECADKLMGLATCLTYVQLTATARAPTPDCCTGFRQVLGTSKRCMCILVKDRDEPALGIKVNITRSMNSPLFATSAATFSDCPKXLNMSPDSQGTEIFNNYAP

SEQ ID NO: 20463 - protein, 325 aa, Pyrococcus horikoshii
MHPKIFALLAKFPRVELIPWETPIQYLPNISREIGADVYIKRDDLTGLGIGGNKIRKLEYLLGDALSKGADVVITVGAVHSNHAFVTGLAAKKLGLDAILVLRGKEELKGNYLLDKIMGIETRVYDAKDSFELMKYAEEIAEELKREGRKPYVIPPGGASPIGTLGYVRAVGEIATQSEVKFDSIVVAAGSGGTLAGLSLGLSILNEDIRPVGIAVGRFGEVMTSKLDNLIKEAAELLGVKVEVRPELYDYSFGEYGKITGEVAQIIRKVGTREGIILDPVYTGKAFYGLVDLARKGELGEKILFIHTGGISGTFHYGDKLLSLL

SEQ ID NO: 20464 - protein, 464 aa, Nocardia farcinica
MTTSSPPAPVDLAHTPYLSGVFAPQRREVEAVDLPVTGTIPPDLHGTYFRNGPNPRFDPIGTFVYPLDGDAMVHRIRIEDGRASYLNRFVRTPMVVAEERVGHALWAGITDPYTPGADLVGPELAGTSRHLPDINVVAHSGKLLAMAESDLPYRIDPADLATLGRDDCGGAMALGSTAHPKIDPGTGELVLFTYRLEPPYLAWSVVSRAGDVLRAPTPVDGVTEPIMIHDMALTERYLVLVLAPLVFDIPALLNGGSLLDWRPAAGTRIAMIPRDGGPVRWAETDTFWVWHFANAFDDDRGRIVLDYVQWNYPSGLARVSTPQRGGVVRAVVDPASGAVTRDEIAMHPVEFPRIDDRRIGCPHGVVATAGRRDGSGDRTALLFVDTERGTETWWDAGDHVVGEPIHLPGAEHAYWGTLATDRRDMSSWFHILAAADPAAGPLASVRMPIRVPAGLHGTWVPAAG

SEQ ID NO: 20465 - protein, 561 aa, Oryza sativa
MATSTSAATAPLTCHHLGLRLRPRLPSLPLKPLFRFPSLSLSRPTPLTPSPPPRHRALHASASAAPAAPPSQPPKPVLQGAAIKPLVATIGTGVLIWLPLPLGAVALLGLGAAVLTRTLTFAAAFSAFGDPIPWLIALAFFFARGFIKTGLGSRVAYAFVSAFGGSSLGLGYALVFAEALLAPAIPSVSARAGGIFLPLVKSLCEAVRLARRRRHGEEARVVADAHVLPDVGDLVGDVPHRHGSEPAGGEPDGGDDRAGDRVDAVGEGRHCAGLAVAGVCAVDSVPDLPAGGEDQPRRAAAGEGAVGEDGAYEQGGEDHGWNAVPHVSAAILGLSVLLISGVVTWKECLGEAVAWDTLTWFAALIAMAGYLNKYGLISWFSETVVKFVGGLGLSWQLSFGVLVLLYFYSHYFFASGAAHIGAMFTAFLSVSSALGTPPLIAAMVLSFLSNIMGGLTHYGIGSAPVFYGAGYVPLAQWWGYGFVISIVNIIIWLGAGGFWWKMLGLCAFTNLHLQIAELVVVLSQNTKFKFKMANFAQVLYLTFTGVACLNMGSLCLTFSGV

SEQ ID NO: 20466 - protein, 383 aa, Alkalilimnicola ehrlichei
MSKSDYYEALGVARNASDSEIKKAYRRMAMKYHPDRNPGDKEAEARFKEAKEAYEILSDPQKRAAYDQFGHAGVDPSAGMGGAGGPGGPGGPDFADIFSDVFGDIFGGGGRRGGGGRRVFRGADLRYNLELSLEDAVRGTEVQIRVPTQEVCDACDGKGTKEGSQPETCPTCKGHGDVRIQQGFFSVQQTCPRCGGSGSVITDPCRKCGGRGRVQSQKTLSVRVPAGVDTGDRIRLSGEGEPGENGGPPGDLYVQIMVREHEFFQRDGANLRCEVPISITKAALGGEVEVPTLDGRVNLRIPAGAQSGKVFRVRGKGVKPVRGGPQGDLLCRVHVETPVNLTKKQKELLEEFGRTMDDTGDKHTPRTSSWLDKARKFFEDWKL

SEQ ID NO: 20467 - protein, 359 aa, Unknown
  Rhodococcus sp. RHA1
MRIDTAPDAVILVGGMGTRLRPLTLSVPKPMLPTAGVPFLTHLLSRIKDAGLCHVVLGTSFKAEVFEQYFGTGEEFGLEIEYVTEDEPLGTGGAIRNVLPNLRADTVVVFNGDVLGGTDMRAVLQTHAEADADGTLHLVRVSDPRPFGCVRTDSNGRVTAFLEKAQDPPTDQINAGCYVFRREWIEKIPSDRPVSVEREVFPALVSGGTRVFGHVDSAYWRDMGTVNDFVAGSADLVRGIAPSSALSGTRGESLIHPSAIVAPGAVLIGGTVLGARVTVGAGARLDGAVVFDGAHVEAGAVIERSILGHDCRIGPRALVRDSVVGNGADVGARCELLRGARVWPDVTLPDGGVRFSTNV

SEQ ID NO: 20468 - protein, 904 aa, Methylobacillus flagellatus
MKRMLFNATQSEELRVAIVDGQKLIDLDIESAGKEQRKSNIYKGVITRIEPSLEAAFVNYGTDRHGFLPFKEIARSYFLNDSDAGRSPRIQDVLKEGQELIVQVDKDERGNKGAALTTFVSLAGRYLVLMPNNPRGGGVSRRIEGEERNELRDTMAQLQVPSGMSIIARTAGIGRSVEELQWDLNYLLQLWTAVESASTIQSGPFLIYQEGSLVIRAIRDYFQPDIGEILIDTPDIYEQAVQFMNHVMPNNVSRVKLYRDEIPLFSRFQIEHQIESAFAREVRLPSGGAIVIDHTEALVSVDVNSGRSTKGSDIEQTAFNTNLEAADEVARQLRLRDLGGLVVIDFIDMENQRNQREVENRLREALHHDRARVQTGKISRFGLLELSRQRLRPSLGESNHIPCPRCHGTGHIRGIESTALHILRITQEEAMKENSAIIQVQLPVEAATFLLNEKRSEIHKIEQRMGVQVVLIPNIHMETPNYNILRIRHDDVEETGRASYEMVELPSETLETALAQEPKPAKAEAAVKGITPASPAPAAAREKEKPSSTSLLHRFKSWLASVAAPKPEVKPQEETQQRDSNRNPRRNNRRNERSASERTGNDRQMQNEQRQEQRKEQRSQQERRPQQAEQRAAQGRQERAERPERNERQPKVQQPQPTPSLQSETPIEANSEQRGNRRGRNGRRERQPRSDNANRENRQQAAEELHAAAAAPIASVEAAERPVEAKTAPTTPEAAPITQVKENTETVHTATEAAPQKEAPAPAIRKDVVVTEESLPAIDATAVKETRTKEEKSAHLSEPLAESPADTKQEKPLEALADEAPTEAAKPEKKPRAPRRRKVEAEKPADLMDSGLQLVETKAEAIQAVIAVEEAPAPRAPRKPAAWQQKAAKEAAVSEELVMVETQK

SEQ ID NO: 20469 - protein, 253 aa, Prochlorococcus marinus
MLIQDTIFYRPDWRWHNFLKYLTNNLSKYNCLEKKIPSEYSYKDSTYGSKKLKKNVNLSTWGVTHKKRIQFARAVCINSPNYSVLNFLIIPNTIYNVPFFGVDFVSLPNSHLLVLDFQPSLKIQKQYNNELLEKLIKLKNHCHSSLPLAEKMSADVARFFSPGVIWSKLPKEERSDFLITNQLYTSFKEYLDLYLEILFESKEVNLELQKELINGQNEYLNYRRDNDPARPMLSSLFGKEFTESLIEEVLFTT

SEQ ID NO: 20470 - protein, 93 aa, Pinus taeda
CIATTGLFREHVPPFRLLFPPFQKYITKGFVSEEEAGKRLAQVVSNPSLTKSGVYWSWNNNSASFENQLSEEASDPEKAKKLWEISEKLVGLA

SEQ ID NO: 20471 - protein, 452 aa, Nostoc punctiforme
MQQLKSAEEIPGSYGLPILGETLEIFRDSELYLWRRFQQYGSVFKTSVLGRKRAYLIGPSANRLVLVEQAENMSSRIGWYFLESTFGNNILLQDGEEHRLTRRLMYPAFHGKAIATYFDTIQNIVQDFLKDWGERGTISLNSSFRQLTLMIATRLFLGSQNKSEVEQTSQWFTQLLDSSMAIFKWNVPFTLYGRGQNARGKLVAFLREAIAQRIEQGNLEESKDVLGLLLAAVDEDGNKLSETQVINEALLLLFAGHETTASLLTWVIFELGNHPEWRERLRQEQLAVVGNNPLSLSHLKQFPQLTNVLKEAERLYPPVYAYNRGVLKDIEYGGYRIPAGWFVTISPMLTHRLPELYTEPDRFDPDRFAPPREEDKKHPLALMGFGYGSHSCLGMEFAQMEMKIVLSTLLRHYDWTVKPDYSAIAPVRQPSKVKDILQAYIEPLLIKHPLDS

SEQ ID NO: 20472 - protein, 373 aa, Geobacter sulfurreducens
MAADKRDYYEVLGVHKNASDTEIKKAFRKLAIQYHPDKNPDDKEAEEKFKEITEAYEVLSDPQKRAQYDQFGHAGVGAGGFSGGGFGGFGAGTPFGDIFGDIFGDIFGGRPRGSRGRRGDDLQYNMELSFEEAAFGAEKEIQVPYGKRCGDCGGSGAKPGTEPKVCPTCRGAGQVRFQQGFFSVSKTCNHCNGEGRVVENPCTSCRGSGMIRDTKTLSVKVPAGVETGTRLKLSGEGGQGIKGGGNGDLYVAIAVREHPIFTREDNDVLCEIPVSFVQAALGCEIEVPTLDGKVSMKIPEGTQSGRIFRLRGKGVPQLQGYGRGDQLVIIKVETPSNLNKRQRELLEEFARISGEDVHPMKKSFFDKVMDFIS

SEQ ID NO: 20473 - protein, 857 aa, Rhodopirellula baltica
MRLVHGKDAVNALDVSWLSPILVRDPTSPSESAWDLFATFMRTRTMKSTATNMNQHPTTAQICRRFATRLFRGTVSIRPLTLTLGCLAASASASLVAQETATNAAASQADAISKCPVMGNPAGPNRHTVSGAMGNGDWWPNQLNLDMLHQNSVKSNPMGEDFDYAAAFNSLDLAAVKADIKELMNTSQDWWPSDYGHYGPLFIRMAWHSAGTYRVSDGRGGASDGTQRFAPLNSWPDNANLDKARRLLWPIKQKYGSKISWADLMVLTGNCALEDMGFETFGFAGGREDVWEPQKDVYWGPETEWLGDKRYSGDRDLQNPLAAVQMGLIYVNPEGPNGKPDPIAAAKDIRETFGRMAMNDEETVALIAGGHTFGKAHGAASPDGNMGVEPEGEGLAAQGLGWINTHGTGNAGDTITSGLEGAWTSTPAEWSHGYFENLFGYEWKLVKSPAGAWQWTPTDENAKGTVPDAHDASKSHAPMMFTTDLALRMDPEYGKISRRFHDNPEQFEKAFAKAWYKLTHRDMGPVSRLLGDSVPEPQLWQDPIPEATFDVIGSKEIEQLKQKILATNLTSSQLVSTAWASASTFRNSDMRGGANGARIRLAPQKDWEVNEPAELASVLTTLEGVQKEFNASRKDGKQVSMADLIVLGGCAGVEAAAMKAGHAIQVPFTPGRTDATQEMTDVESFEPLKPIADGFRNYQGHNADRPAEEMLVDKANLLSLTAPEMTVLVGGMRALDTNAGAGPLADLGKLTKRPGALTNDFFVNLLDMNTVWKQSPMCEHFFEGRDRESGNLKWTASRVDLVFGSNSQLRGIAEVYASEDAKEKFVKDFVNAWTKVMNLDRFDVNDSESTETQVAAK

SEQ ID NO: 20474 - protein, 828 aa, Unknown
  Frankia sp. CcI3
MAGGEGTRLRPLTANLPKPLLPVVNRPIMEHVLRLLKRHGFDETVVTVQFLASMIRTYFGSGDELGMHLSYATETTPLGTAGSVKNAEDALRDEAFLVISGDALTDIDLTDLVAFHRRQGALVTVALKSVPDPLEFGIVITGEDGRIQRFLEKPTWGQVFSDTVNTGIYVMEPEVLAQVPPGEAVDWSGDIFPRLVEAGAPVYGYVASGYWEDVGTIASFQRAQADVLNRQVDVEIGGFEVSPGVWIGEDAEVHPEAILKGPLVVGDYSKVEAGAELREFSVLGSNVLVKSGAFLHRAIVQDNALIGPQTNLRGCVIGKSTDVLRAARIEEGAVVGDECVVREEAFVSHDVKVYPFKTIEAGAVVNTSVIWESRGQRTLFGPRGVSGLVNAEITPELVVRLAGAYATTLKKGATVTTARDGSRAARALKRAVISALTAGAINVRDLEVAPMPVTRFDVRSSNAAGGIMLRTTPGDPERIDIIFLDADGDDLSPVAQRKLDRVFSRQEFRRAFPGEIGDLRFPARTMDLYIQDLLDRVDTAGVAEADLKIVVDSSGGSASLVLPTLLGRLGVDVLTVNGRVDETIPPRSALEDLRATDRLGALVASSGAAFGVRFDHVGERVTIVDERGDLIDDDRALLVFLDLVAAENPGAEVALPVTITRVADQVTRFHGLTVRRTSLSAAALTGVARDDGIVFAADGRGGFIVPEFAPAIDGIAAFVKLLALVARTRLTLSTIDARIPSVAILRRSVPTPWAVKGTVMRRVVESVDPDTGYVIDTTDGVRIVGPDGSWILVLPDPSEAVTHLWSEGADIEEAHVLLRRWVEVVEAR

SEQ ID NO: 20475 - protein, 426 aa, Cenarchaeum symbiosum
MALVENDPFENSRKQVHDACDLLDITDKGMREYLVMPNRVLRFKIPVMMDDGNLRIFTGFRSQHNNDKGPYKGGIRYFNPKGGVEYMEREVMALSSWMTWKCAILDLPLGGGKGAVYVNPKEEKISAGEKERITRRFAYMLSEVIGPEKDIPAPDVYTTGKEMIQIMDTFGKLNGNRYTPGVITGKPVPVGGSLARNVATGLGSAYCTREAAKTLKIPLKGAKVVLQGFGNASTYAGIYLEKMGCKVIGASDSKGSVLVPAGFKMDKMMEHKSKKGTVVGYPGSKKVTAAELLTAKCDILVPGALENQIDAKIAAKLQCKIITEAANGPTFPEADPIIFKKKILLIPDILANSGGVCISYLEWVQNNQGYYWSFDDVAGKMETTIVRGFKASYEFAKKHKVDMRKASMAIAVDRVVKAFEHRGLWP

SEQ ID NO: 20476 - protein, 540 aa, Saccharophagus degradans
MRSQPWWRGAVIYQIYPRSFMDTNADGVGDIPGIVQKLDYIASLGVDAIWISPFFKSPMHDFGYDISDYRDVDPLFGTLDDFDLLIDEAHKRGIKVMIDQVLSHTSAEHEWFKESRQSRDNPKADWYVWADPNEDGTPPNNWLAIFGGSAWEWDSRRGQYYLHNFLKSQPDLNFHCEDVQNQILQEVEFWLKRGVDGLRLDAINFCFHDKQLRNNPPKSASERKARGFSEDNPYAFQWHTYNNTQPENLAFLQRLRSLMDKYPNTVTLGEISSDDSLATMAEYTADNDKLHMAYSFELLADEFSAAYIRETVGTLESRLNDGWPCWSIGNHDVPRVASRWGKEDACDALSIVLNAMLLSLRGSVCCYQGEELGLKEAELTFEQLQDPYGITFWPKFKGRDGCRTPMPWDSQQHAGFSNGAPWLPVADDHKAKNVTVQQQADLSVLQAYKQFIAWRKTQPEILYGDIAFLSSHESTLAFTRSYEGSTLFAAFNLSNTEQVVNLPAGEWTALEGHGLSAAVSATQITLPPFGGFFAKQASNS

SEQ ID NO: 20477 - protein, 191 aa, Methanosarcina mazei
MRISKISRKTKETDIQLEINLDGKGTADVSTGIGFFDHMLSSFARHAEFDLKVRAEGDLYVDEHHLIEDTGIVLGKALAEALGDMAGIARFGEARIPMDEALAEVALDVGGRSYLVMKADFIAPQVGQFSTQLVKHFFETVASNAKITIHASVYGDNDHHKIEALFKAFAYAMKRAVKIEGKEVKSTKGTL

SEQ ID NO: 20478 - protein, 135 aa, Vibrio parahaemolyticus
MSELTKTLLNIRSLRAFSRELTLEQLEEALDKLTTVVEERREAEEAEREALAQQEAKLAEIAEKIAQDGIDVEALISALSGETKTKAKSKRAPRPAKYKYIDTNGQEKTWTGQGRTPSAIQEQLDAGKSLDDFLI

SEQ ID NO: 20479 - protein, 602 aa, Unknown
  Staphylococcus sp. RLH1
MLYPINTETRGVFDLNGVWNFKLDYGKGLEEKWYESKLTDTISMAVPSSYNDIGVTKEIRNHIGYVWYEREFTVPAYLKDQRIVLRFGSATHKAIVYVNGELVVEHKGGFLPFEAEINNSLRDGMNRVTVAVDNILDDSTLPVGLYSERHEEGLGKVIRNKPNFDFFNYAGLHRPVKIYTTPFTYVEDISVVTDFNGPTGTVTYTVDFQGKAETVKVSVVDEEGKVVASTEGLSGNVEIPNVILWEPLNTYLYQIKVELVNDGLTIDVYEEPFGVRTVEVNDGKFLINNKPFYFKGFGKHEDTPINGRGFNEASNVMDFNILKWIGANSFRTAHYPYSEELMRLADREGLVVIDETPAVGVHLNFMATTGLGEGSERVSTWEKIRTFEHHQDVLRELVSRDKNHPSVVMWSIANEAATEEEGAYEYFKPLVELTKELDPQKRPVTIVLFVMATPETDKVAELIDVIALNRYNGWYFDGGDLEAAKVHLRQEFHAWNKRCPGKPIMITEYGADTVAGFHDIDPVMFTEEYQVEYYQANHVVFDEFENFVGEQAWNFADFATSQGVMRVQGNKKGVFTRDRKPKLAAHVFRERWTNIPDFGYKN

SEQ ID NO: 20480 - protein, 112 aa, Zea mays
RAFFSFFLRLQKTTIPSLTTDSQNKGPLIKKIPLNQIRRPLKRTRPNDPVKVQKLMDSIRVIRLQVPINVLEVDEVYYSFSGCHLYEAHQRLGLPTIHCKVRRGTKETLMHH

SEQ ID NO: 20481 - protein, 267 aa, Chlorella vulgaris
MLQKVKLEDMIQSGMHFGHSTREWNPRMAPYIYGERNGRHILDLVQTYYLLNKVLAFLEEQAAQGKTFLFVGTKQQAAPLIAKTALACESFYVNQRWLGGMLTNWRTIQKSLRKLQEYRRAEERGDWNLLKKQEVARKRREKDRLEKYLSGVENMSRLPGVVILIGQTEEIHAVKECRQLGIPTVTLLDSNCDPNLADWFLPANDDSVSALRLILAWFQQAIQTGQLRSLEREAAKKQKIKKTGVKISGNRRTSSITKKRNPASSKI

SEQ ID NO: 20482 - protein, 713 aa, Gossypium hirsutum
MDCGSGGGGLGASGSGGDHDSSDLSRRKKPYHRHTAHQIQRLESMFKECPHPDEKQRLQLSRELGLAPRQIKFWFQNRRTQMKAQHERADNSALRAENDKIRCENIAIREALKNVICPSCGGPPANEDSYFDDQKMRMENAQLKEELDRVSSIAAKYIGRPISQLPPVQPVHISSLDFRMASFDGYGVGAGPSLDLDLLPGSSSSMPNLPFQPVVISDIDKSLMSDIAANAMEELLRLLQTNEPLWIKSTNDGKDALNLESYERIFPKPNNTHFKSPNIRVEASRDSGVVIMNGLALVDMFMDSNKWLELFPTIVSIAKTIEVISPGMLGTHRCSLQLMYEELQVLSPLVPTREFYTLRYCQQIEQGLWAIVNVSYDLPQFASQCRSHRLPSGCLIQDMPNGYSKVTWLERVEIEDKTPIHRLYRDLVHSGSAFGAERWLTTLQRMCEWFACLRVSSTSTRDLGGVIPSPEGRRSMMKLAQRMVNNFCTSVGTSNSHRSTTLSGSNEVGVRVTVHKSSDPGQPNGIVLSAATTFWLPVSPQNVFNFFKDERTRPQWDVLSNGNAVQEVAHIANGSHPGNCISVLRAFNTSHNNMLILQESCIDSSGSLVVYCPVDLPAINVAMSGEDPSYIPLLPSGFTITPDGHLEQGDGASTSSSTGHGRSSGGSLITVAFQILVSSLPSAKLNLDSVTIVNNLIANTVQQIKAALNCPSS

SEQ ID NO: 20483 - protein, 285 aa, Xanthomonas oryzae
MSTNDNWYIEHFQPTGSAIGFRISGKLDEVQSLFQKIEIYQTTDWGKLMLIDGAVMLTSRDNFFYHEMISHPALFTHPTPKRVVIIGGGDCGTLREVLKHPGVESATQCDIDEQVTRMSEKYFPELCDSNHDARAELLFDDGVAYMANCPAGSVDIVIVDSTDPVGPAEGLFNKAFYESCFKALKDDGLLVQQSESPLALLDLIKEMRTEMGKAGFQSFKTLPFPQPCYPTGWWSVTMASKQAKADFAFRQGAAQAKGFETLYYTAHLHTGVLVAPPFVAKALGE

SEQ ID NO: 20484 - protein, 198 aa, Gossypium arboreum
MAPKKDGVSKRVFNKGSWTAEEDRRLAKYIEIHGAKRWKTIAIKSGLNRCGKSCRLRWLNYLRPNIKRGNISDEEEDLIIRLHKLLGNRWSLIAGRLPGRTDNEIKNYWNSHLSKKIINHDVRTEQTSSSEQIVPHKAWETVQMEEEEVVKGSDEIENSEFSIDVDEFFDFTTEGCFSLDWVNKFLELDDQQDPLAMV

SEQ ID NO: 20485 - protein, 114 aa, Methanosarcina barkeri
MKYIIAMIRPERLDAVKRELQKLEVNRLTVSSVAGYGAQKGHLEIYRATEHEANLLEKVKIEIAVEDHFLKSVIEAIKTGAKGKDGYIGSGKIFVLPLENVIRIRTNETGPEAL

SEQ ID NO: 20486 - protein, 304 aa, Unknown
  Nostoc sp. PCC 7119
MTQAKAKHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETW

SEQ ID NO: 20487 - protein, 528 aa, Thermobifida fusca
MVDTTPAQPAEQKERLPLPPRIARFVVLFAVFVCAACGLVYELALVALGSYLLGDTITQASVVLAVMVFAMGVGSLASKQLTHRPAFWFAVVEGLLSLLGGLSVLILYAAFAWFSLYQPALVSLSFLIGVLIGAEIPLLMTLIQRIRRQEAASAVADLFAADYVGGLIGGLAFPFLLLPVFGLLEGVLLVGILNAVTGIAIVLWLFRHSLTRGGRIGLAAGLALVMAVSGSALALSERFEVDARQALYRDPVVYAERSDYQEIVLTENLARTDLRLFLNGDLQFSSLDEYRYHESLVHPVMNGPRRTVLVLGGGDGLALREILEYADVARVVLVDLDPAVVDLARTHPRITALNRDAFADERVTVVHDDAFTWLRTTTEQFDAIVVDLPDPDDVNTAKLYSVEFYGLVRQAMAEEARVVVQAGSPYFASRAYWSVGQSMEEAGLHTTPYHVDVPSFGDWGFFLAATDRAPALTLPDDLPDTDFLDAAVLHAAQVFPKDRRPGAQGESQPSTLLNPRIIDYHRTAWEGY

SEQ ID NO: 20488 - protein, 634 aa, Glycine max
TSIEVVLFDRHEDYRLKELQDKAQELYSASENALVLVEKLGKLVAICMGGSFPVEQGDLHKRWKLVSKRLRNFHQCVVLPVGSLSSGLCRHRAILFKRLADYIGLPCRIARGCRYCVSDHRSSCLVKIKDDRQLSREYVVDLVGEPGNIHGPDSSINGAYVSSIPSPFQISHLKESQSPYVDVAACSQSLGCVQVDCVQEDQQAEETDLQKNNNGSIYPAIDQTRGGAEPPLIPFGLKGNHKECAILGLLNFPPVYEGVSEDLHPATEASLHEYPRLSKDSVVVLEASNKEIEIIVKGSSGVKSNYKQSTVSLSSESKQEQEHVKNKVENQGAGNIPRYLNLEPSLAMDWLEIPWDDLRIKERVGAGSFGTVYRAEWHGSFNLQDVAVKVLTVQDFQDDQLKEFLREVAIMKRVRHPNVVLFMGAVTKRPHLSIVTEYLPRGSLFRLIHKPASGEILDPRRRLRMALDVAKGINYLHCLKPPIVHWDLKTPNLLVDRNWTVKVCDFGLSRFKANTFLSSKSVAGTPEWMAPEFLRGEPSNEKSDVYSFGVILWELVTLQQPWNGLSHAQVVGAVAFQNRRLAIPPNISPALASLMESCWADNPADRPSFGSIVESLKKLLKSPADAIKMGGAIT

SEQ ID NO: 20489 - protein, 218 aa, Desulfovibrio vulgaris
MSDEPKGAILQRDKLTYAIVPRTPCGLLTPDVLDAVSRVCRKYEVPIIKITSGQRLALVGMKKEAVEPMWEELRLDVGRAVELCVHYVQACPGTAVCRFGLQDSLGIGVAIEEEYVGHDFPAKVKFGISGCPFCCGETYLRDVGLVGTKKGWTLIVGGNSGGHPRIGDVLAEELSTDEAKGLIRKFMEFYRDNSGKRLRVSKFVEKTGIEAIRQAVLG

SEQ ID NO: 20490 - protein, 319 aa, Enterococcus faecalis
MNIHYYLIINEQASSGNGRKVARKVIQQLKQQELKYTALYTDYAGHEKELTKELAETTLLPWSEDLDVSTFPILVVLGGDGTLHNVINSLLPYDSTIPLSYIPCGSGNDFARGVGLSRNIDKALHQILRTRRPKEIQTIHYVEANQEEIGLATNNVGLGLDAAIVEKTNESSSKKALNKFKLGSLSYISSIIHVFFRQKGFPILVEMNGKQYTFNRAFLCTVTNHPYFGGGVSIMPTANPRKAVVDLVVVERINIFKILWLIFLLLRQKQGKSKHFHHFQSSKIRIVSTIPQTIHADGEILGKRSIDMVYTTQKRLFWF

SEQ ID NO: 20491 - protein, 175 aa, Glycine max
MAVSVSASSAIASLNSELSTRLPPSLASASSSAKQSFLQFPSCARLLRISTPRAPAPSRPRFPPLVQAKKQTYNSFDDLLANSEKPVLVDFYATWCGPCQFMVPILNEVSTRLKDKIQVVKIDTEKYPTIADKYRVEALPTFIMFKDGDPYDRFEGALTADQLIERIEAGLKVKQ

SEQ ID NO: 20492 - protein, 307 aa, Zea mays
  misc_feature (188)..(188): Xaa can be any naturally occurring amino acid
MAEHLASIFGTEKDRVNCPFYFKIGACRHGDRCSRLHNRPTISPTLVLANMYQRPDMITPGVDAQGQPIDPEKMQEHFEDFYEDIYEELGKFGEIENLNVCDNLADHMIGNVYVQFREEEQAAAAYNALQGRFYSGRPIIVEYSPVTDFREATCRQFEENSCNRGGYCNFMHVKQIGRDLRRKLYGAXASRRYHGRSRSRSPPPQRRGHRDRDDYHHRDRDDYRGGGGGGRGRGSRYDRYDDGAGRGGRHGRYDDGAGRGGRHDRYDDGGRRRHGSPSRRARSPVRESSEERRAKIEQWNREREGKQ

SEQ ID NO: 20493 - protein, 184 aa, Thermobifida fusca
MDAKDMGSALDKILVTEEQIRTRTRELAAEIDADYAGKDLLLVGVLKGAVMVMADLARELHHPCEMDWMAVSSYGAGTTSSGVVRILKDLDTDIQGRNVLIVEDVIDSGLTLSWLVGNLKSRHPASVEICTMVRKPMAFNVDLDVKYVGFDLPNEFIVGYGLDYAEKYRNLPFIATLAPHVYDD

SEQ ID NO: 20494 - protein, 1047 aa, Cryptococcus neoformans
MSVSILRRAARLPLSRQHQPLFARPLSISSIVLRPTSTSPTRSSTTATQPHPRSPSESFHPAPTSVFTPLDTFLPRHLGPREADIQAMLEVLGHKTLDEFVATTIPSEVRIDQLTNKEEKGKGLRALSELELRRRIEEIAAMNRPVKSYIGMGYHNAIVPPVIQRNVFENPAWYTAYTPYSPEQSQGRLESLINFQTVAISLTGLPIANASLLDEGTAAAEAMAMCLASVAKPKFNKGKKVFLVSPNVAPQTIEVLQTRASGFDIDLRIAESDANFLSEVESLGEAQLMGALVQYPDVNGEIGDWEEVATKVKATGAKMVVTTDLLALTMIKPPGEWGADIVCGNSQRFGVPAGYGGPHAAFFACTDDLKRKMPGRLVGLSKDSQGAPAYRLALQTREQHIRREKATSNVCTAQALLANMAAMYAVYHGPEGLRRIAGKVHSLTRVLSESLASLGFTTVNKAFFDTLTIDVSSAGVTAADVHTASVKAGINFRKIDDKTIGITLDESVGPLDLTDIINVFYAVKGQPAVEPEVLEALAQKLELSAESVTSPIATLARTTPFLTQPVFNKHHSETDMLRYMMHLQEKDYSLVHGMIPLGSCTMKLNSTSSMVPLSWKEFGGLHPFAPTDQAKGYEVIIKELENDLSLVTGYDATSVQPNSGASGEYAGLRVIQAYHESRGEGHRDVCLIPLSAHGTNPASAAMVGYKVVPIKALNDGSLDLADLKEKAEKHKDKLAAFMVTYPSTFGVFEEGIEEACQIVHDNGGQVYVDGANCNSLIGLTSLGRVGGDVSHTNLHKTFSIPHGGGGPGVGPISCKSHLAPFLPSHPIVPTGGSTPITAVSAAPYGSASINTISWAYIKMLGGEGLTTVSKIALLNANYIAERLKPYYNLRYSNKNGRVAHECLIDLAEFEKSAGLKVPDFSKRLQDYSFHPPTAQWPISTCWLIEPTESESKEEIDRFIEALISIRKEIDEIVSGEQSKDDNVFKNAPHPLSLLTADKWDRPYSREKAVFPVPGLKKSKFWPSVGRLDDAAGDLNLICECGSVEEYA

SEQ ID NO: 20495 - protein, 594 aa, Exiguobacterium sibiricum
MNKAAVFHRALSPYVYTYDQEAVHIRLMSAKGDLDRIELIHGDPYEWDAEKEEDRDWNFDPDKEKFWKTETTDMTFAGSDATHDFWFVAIRPPKKRVRYGFNVHANGESAVYTERGWYDEVPLDHPGYYFAVPYMNAVDVFDAPSWVKDTVWYQIFPDRFANGDLTNDRPGTIAWGAEAPAFDNHFGGDFQGVIDHIDYLKELGITGIYFCPVFVAPSNHKYDTLDYLRLDPAFGTEETFREMIHLLHQNGIRILLDAVFNHVSVDHPAFQDVIAHGNESQYANWFMMDSFPVQSTPVPNYEVFAFEGNMPKLNTAHPDVKEYLLKVGRYWVEEFHVDGWRLDVASEVDHAFWREFRREVRAANPEAYIVGECWTDSQPWLLGDQFDAVMNYGLTEAFLTFFATNESTASEFSHAIVRNLNSNTMNVNEVMFNLVDSHDTPRALTRANGDRDRMKLLMLSLLTFTGSPVIYYGDEIGMTGGQDPDNRKCMVWDQAEQDRDLLAYITKLVDLRKSHPALANASGYQFEQMDDETASFLVRRQSDEATYLIGFNNGSEEIRFDLDKAAVDLMDGQRYLGTVTVRPLSGKILRVETT

SEQ ID NO: 20496 - protein, 138 aa, Cryptococcus neoformans
MLGQLSRPVRLSVAPLRTILTQRAFHASPIARDHILDASNEVFEKRALDADNSKPVLVDFYASWCQPCRVLTPLLKRVTGPESNYDLLTINVDEYPEVAAKYKVSALPTVVAFKNGAVKNKFVGFRGQDDINKFLGML

SEQ ID NO: 20497 - protein, 954 aa, Pseudomonas syringae
MTDRIELTTANEFIARHIGPRAADELAMLHTLGFDSIEALSDSVIPESIKGTSVLNLPAGQSEADALASIKAIASKNQLFKTYIGQGYYNTHTPAPILRNLLENPAWYTAYTPYQPEISQGRLESLLNFQTLISDLTGLPIANASLLDEATAAAEAMTFCKRLSKNKGSQQFFASSHCHPQTLDVLRTRAEPLGITVVVADETELGDVSDYFGALLQYPASNGDVFDYRELAERFHGANALVAVAADLLALTLLTPPGEFGADVAIGSAQRFGVPLGFGGPHAAYFSTRDAFKRDMPGRLVGVSVDRHGKQALRLAMQTREQHIRREKATSNICTAQVLLANIASMYAVYHGPRGLTQIANRVHHLTAILAEGLSQLGLNAEQAYFFDSLTLHTGGRTAALHAAARARHINLREIDDQRLGLSLDETTSQSAVEVLWDIFASTGQTLPDFTALAASVKSRLPAALLRQSAILSHPVFNRYHSETELMRYLRKLADKDLALDRTMIPLGSCTMKLNAASEMIPVTWAEFGNLHPFAPAEQSAGYQQLTDELEAMLCAATGYDAISLQPNAGSQGEYAGLLAIRAYHQSRGDEHRDICLIPSSAHGTNPATANMAGMRVVVTACDARGNVDIEDLRAKALQHREQLAAIMITYPSTHGVFEEGIREICGIVHDNGGQVYIDGANMNAMVGLCAPGKFGGDVSHLNLHKTFCIPHGGGGPGVGPIGVKSHLAPFMPGHARMQRKEGAVCAAPFGSASILPITWMYIRMMGGEGLKRASQLAILNANYISRRLEEHYPVLYTGTNGLVAHECILDLRPIKDSSGISVDDVAKRLIDFGFHAPTMSFPVAGTLMIEPTESESREELDRFCDAMIKIREEIRAVEDGTLDKDDNPLKNAPHTAAEIVGQWSHPYSREQAVYPVDSLIENKYWPPVGRVDNVFGDRNLVCACPSIESYQEA

SEQ ID NO: 20498 - protein, 653 aa, Medicago truncatula
MACISIHNFMLLLLFLFHFTPTSAQVPIFLYSFCQNSTEKSLTASYKSNVNKLLLWINSDSAAGTEFNNNKIGSNNTTSDDVYGNYDCRADVTGSFCQFCINTAVKEIAQRCLNSDTAVIFYDVCIIRYSNKNFFGNVSITPSWNVTGSKKIKDSTELTKVEDYIGILIRKVTVETNQSWGASEFNSNETGKRYGFLQCARELDKEGCRQCLEAVLDLVPKCCGTKVAWEVVVPSCGIKFDDQKFFQLNDQSGSSSLKPNQAKQEGASNKKTLIIILVSVLMAVALLCCCVYYYWRKNGLCKGGFLLRKTLNIDDTLNGDLPTIPFSVIQHATNYFSSSSKLGEGGFGPVFKGTLPDGTEIAVKRLAETSGQGSEEFKNEVIFIAKLQHRNLVRLLGCCIEGNEKILVYEYMPNSSLDFHLFDEEQHKKLDWTLRLSIINGIARGLLYLHQDSRLRVIHRDLKASNVLLDDEMNPKISDFGLARKFEKGQSQTKTKRVIGTYGYMAPEYAMAGLFSVKSDVFSFGVLVLEIVYGKRNGEFILSEHRQSLLLYTWKLWCEGKSLELIDPIHKKSYIESEVMKCIHIGLLCVQQDAADRPTMSTVVAMLGSDTMPIPKPKQPAFSVGRMTEDDPTLKSYKDNYVDEVPITIVSPR

SEQ ID NO: 20499 - protein, 47 aa, Pinus strobus
PSLTKSGVYWSWNNNSASFENQLSEEASDPEKAKKLWEVSEKLVGLA

SEQ ID NO: 20500 - protein, 296 aa, Xylella fastidiosa
MQDLKKKVILVTGASDGIGKFTAATLAKQGHKLIIHGRNRQKTEAALAEIKRQSGNPDVAMFLADFLPLAGVKAFADAIKEKYDHIDVLINNAGAQFTEQREVTSEGHEKTMAINVFAPMLLTKLLMPLLVKSESARVVTVASDAHRMAGKPDLDDIELKQGYHMAKAYSLSKLYVIWVMHHFIGETKKAGIHNVTFNLVHPASTRTNLGREAVKSWKWKIIFFLWQIMLVSMDKAASSTLYAATAPELEGVSGRYFGPKGEEQPSAKYHSPENEQKVWDYALNAIRPYLPAGAQS

SEQ ID NO: 20501 - protein, 365 aa, Unknown
  marine gamma proteobacterium HTCC2080
LEAAGGPPAAPGPRTGPGDTVNTNVMRLGGRILALVEAGATPVELNSDLDTVAYTDFDGALTSPFTAHPHEDPLTGEWHAITYSPLMPDHVCHVAIDREGQVLRQLKIPVSDGPSIHECTLTKNFVVIFDLPVTLSLAAMAKGFKFPYRWDDERSARVGLLPRSGTADEVVWCEVDPCWLFHVANSFETDENTVVIDAAVYETMFAHGPDGPNGQPIGLERWEIDLSKRQVTRSTLDATPQEFPRIDERFFGQPYQHTWTVGLPSSPVSNFAQPNSLFHHNLSTGQRQEYPFGYEDIGGEFVFVPATDEAAEGEGWLLGYVINTESDTTELRILNAQAIADGPVACIHIPHRIPPGFHGNWIGDL

SEQ ID NO: 20502 - protein, 265 aa, Pinus strobus
RENYTVMHLDLASLESVRQFVDNFRQSGRPMDVLVCNAAVYLPTAKVPTFTAEGFELSVGTNHLGHFLLSRLLLEDLKKSDFKSKRVIIVGSITGNTNTLAGNIPPKANLGDLRGLSARLNGVNSSPMIDGGEFDGAKAYKDSKVCNMLTMQEFHRRYHEETGITFASLYPGCIATTGLFREHVPPFRLLFPPFQKYITKGFVSEEEAGKRLAQVVSDPSLTKSGVYWSWNNDSASFENQLSEEASDPGKARKVWEISEKLVGLA

SEQ ID NO: 20503 - protein, 464 aa, Solanum lycopersicum
MAFFLIFLSSFFGLCIFCTALLRWNQVKYNQKNLPPGTMGWPLFGETTEFLKLGPSFMKNQRARYGSFFKSHILGCPTIVSMDSELNRYILVNEAKGLVPGYPQSMIDILGKCNIAAVNGSAHKYMRGALLSLISPTMIRDQLLPKIDEFMRSHLTNWDNKVIDIQEKTNKMAFLSSLKQIAGIESTSLAQEFMSEFFNLVLGTLSLPINLPNTNYHRGFQARKIIVNLLRTLIEERRASKEIQHDMLGYLMNEEATRFKLTDDEMIDLIITILYSGYETVSTTSMMAVKYLHDHPKVLEELRKEHMAIREKKKPEDPIDYNDYRSMRFTRAVILETSRLATIVNGVLRKTTQDMEINGYIIPKGWRIYVYTRELNYDPRLYPDPYSFNPWRWMDKSLEHQNSFLVFGGGTRQCPGKELGVAEISTFLHYFVTKYRWEEIGGDKLMKFPRVEAPNGLRIRVSAH

SEQ ID NO: 20504 - protein, 143 aa, Oryza sativa
EFPAGKDAFHLRVRVHPFHVLRINKMLSCAGADRLQTGMRGAFGKPQGTCARVDIGQVLLSVRCKPNNAVHASEALRRAKFKFPGRQKIIESRKWGFTKFSRDEYVRLKSEGRIMPDGVNAKLLGCHGRLSARAPGKAFLSAA

SEQ ID NO: 20505 - protein, 100 aa, Unknown
  Malus x domestica
WMSSNMRMMRKMSNPDQTSSSSTSSDDKPISMKLSSHKFEEQKLQHPSSQLGADMISCSNNSSNNTNNIPIIRVCSDCNTTKTPLWRSGPRGPKSLCNAC

SEQ ID NO: 20506 - protein, 198 aa, Triticum aestivum
  misc_feature (69)..(69): Xaa can be any naturally occurring amino acid
GELGPTSHAPARHARGISVVAPRVSHCVHLVSWEKENVSSEALEAARIACNKYMTKHAGKDAFHLRVRXVHPFHVLRINKMLSCAGADRLQTGMRGAFGKPQGVCARVAIGQVLLSVRCKPNNAIHATEALHRAKFKFPGRQKIIESRKWGFTKFNRNDYLKFKSEGRILPDGVNAKLLGCHGRLANRAPGQAFLSAA

SEQ ID NO: 20507 - protein, 229 aa, Acidobacteria bacterium
MVTRLVGSCVVLGCAMFLAGCNAHATPSSRKAIPAANVDVALASASGKQTAVFAGGCFWGTQAVFERVKGVISTTAGYSGGSAATATYDQVTTETTGHAESLEVVFDPSKITYGQLLRIFFSVAHDPTQLNHQGPDVGASYRSAIFYVNDDQKRIANTYIAQLDTAKVFPAQIVTEVTPLKGFYRAEDYHQDYALHHPDNPYILVCDRPKIESLKRQFPELFVDYKGRH

SEQ ID NO: 20508 - protein, 244 aa, Glycine max
  misc_feature (199)..(199): Xaa can be any naturally occurring amino acid
  misc_feature (223)..(223): Xaa can be any naturally occurring amino acid
NFCVPVGLLPGYPGPLGLFCSPDGSVNFAIFSRRAESVVLCLYDENDMEKPALELDLDPYVNRTGDIWHVSFESAKGFMSYGYSCRGGVLKRNKDDGFAEHVVLDPYAKIVGNSYPDGVGFVKNLGWLGKEPDFDWGGDCHLDLSMEKLVVYRLNVKRFTQHESSQLPSGLAGTFTGLAKKVQHFKDLGVNAILLEPVXTFDEKKGPYFPSHFFSLMHIYGPXSGGPVSAIASMKEMVKTMHAN

SEQ ID NO: 20509 - protein, 357 aa, Vibrio parahaemolyticus
MSKQQKILFIDRDGTLIVEPPIDFQVDRLDKLKLEPFVIPSLLSLQDAGYRLVMVTNQDGLGTDSYPQEDFDAPHNMMMEIFESQGVKFDDVLICPHFEEDNCSCRKPKLGMVKEYLQGGKVDFQNSVVIGDRQTDLQLAENMAIRGIQYNPETMGWKQILKDLTVKARVAEVIRTTKETDIKVAVNLDEQGGNDISTGLGFFDHMLDQIATHGGFQMVCKVDGDLHIDDHHTIEDTALALGQALKEALGDKRGIGRFGFSLPMDECLAQCALDLSGRPYLKFDAKFSRDQVGDLSTEMVVHFFRSLTDTLACTLHLSSAGDNDHHIIESLFKAFGRTLRQAIKVEGTELPSSKGVL

SEQ ID NO: 20510 - protein, 305 aa, Desulfovibrio desulfuricans
METRQVDVLILGGGVAGMTAAVYAARAGLRVTLLEENACGGLVNWTRVVENMPSYISIPGMELADRMAEQVAALGVDVEEAACIEEISLAAGDKTVVADDVRYEARAVIAATGRRPVLLDCAGDCCQVHYCAICDGSAYKGRHVLVVGGGNSGFDEALALLDTGVARVTLIEAQDRFFAAAAAQRALAAREGAVMYTSTRVTQLHGTDALESVTLTRADGSEQQLPCDGIFVFMGQEPSTQLFRGQLELDAQGYIVTDGLMATSVPGVFAAGDVRPKRYRQITTALSDGTVAALEAERYIRRTAG

SEQ ID NO: 20511 - protein, 175 aa, Acidobacteria bacterium
MNILTERALIAGGCFWGMQQLLRRYPGVISTRVGYSGGDVSNATYRNHGTHAEAIEIIFDPEQLTYRTLLEFFFQIHDPTTLNRQGNDRGTSYRSAIFYTSDEQKRIAIDTIADVNASGIWPGKVVTEVEPAGAFWEAEPEHQDYLEYYPNGYNCHFIRPDWKLPRRSEKASFSS

SEQ ID NO: 20512 - protein, 538 aa, Medicago truncatula
MIIRSMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKILDKEGIPPDQQRLIFAGKQLEDGRTLSDYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGF

SEQ ID NO: 20513 - protein, 356 aa, Triticum aestivum
MENGHAGKHRVAVIGSGNWGSVASRLLASNTAKLPSFHDEVRMWVFEETLPTGEKLSESINQAHENCKYLPGIKLGTNVIADPDLESAVKDADMLVFVTPHQFVEGICKKLVGKLRPGVEAISLIKGMEVKMEGPCMISKLITDTLGINCCVLMGANIANEIAVEKFSEATIGYREDKEAANRWAKLFTTPYFLVAIVEDIEGVELCGTLKNVVAIAAGLVDGLDMGNNTKAAIMRIGLREMRAFSKLLFPSVRDNTFFESCGVADLITTCLGGRNRRVAEAFARNGGKRSFDELEAEMLHGQKLQGVSTAREVYEVLTYHGWQELFPLLSTVHEICIGQLPPTSIVEYRLAEGQS

SEQ ID NO: 20514 - protein, 149 aa, Brassica napus
  misc_feature (16)..(16): Xaa can be any naturally occurring amino acid
  misc_feature (34)..(34): Xaa can be any naturally occurring amino acid
EYLAPEIIKGEGHGSXVDWWTFGIFLYELLFGKXPFKGSGNRATLFNVVGQPLRFPDSPVVSFAARDLIRSLLVKEPQHRLAYKRGATEIKQHPFFEGVNWALVRCASPPEIPKPVEIEPVNCTPPAVPAAASTSVRSDQSNYLEFDFF

SEQ ID NO: 20515 - protein, 125 aa, Methanosarcina barkeri
MKEITAIIRMNKAQRTKDVLLECGFPSFTVRRVMGRGKQRGLCHEFNPPLPDPEKEAETCIRFIPKRMFTIVVDDENVSEVVQKIIEINQTGNAGDGKIFVSDVTEAIRIRTGESGEATVNKELV

SEQ ID NO: 20516 - protein, 225 aa, Oryza sativa
MDDSSFGSEPTTSSSGGEAPASPPSTASSSSDGAGGKKKRPRKDGHHPTYRGVRMRSWGKWVSEIREPRKKSRIWLGTFATAEMAARAHDVAALAIKGRAAHLNFPDLAHELPRPATAAPKDVQAAAALAAAADFPASSANAGASNNPDGSDDASAGSASPPPPPDAADDALFDLPDLLLDLRYGPPSSGLSCASSWEDEVGLISGAGAAAAGVFRLEEPLLWEY

SEQ ID NO: 20517 - protein, 120 aa, Navicula pelliculosa
FAGKQLEDGRTLSDYNIQKESTLHLVLRLRGGMQIFVKTLTGKTITLDVEPSDTIDNVKTKIQDKEGIPPDQQRLIFAGKQLEDGRTLSDYNIQKESTLHLVLRLRGGMQIFVKTLTGKT

SEQ ID NO: 20518 - protein, 339 aa, Rhizobium leguminosarum
MSLLEKFERYPLTFGPTPIEHLPRLTAALGGKVDIYAKRDDCNSGLAMGGNKLRKLEYIVPDAIASGADTLVSIGGVQSNHTRMVAATAAKIGMKCVVIQEKWVPHYDAVYDRVGNILMTKLMGADSRLVEDGFDIGIRKSWEDAIQSVEDAGGKPYAIPAGASVHKFGGLGYVGFAEEVAAQEKDLGFIFDYIIVCVVTGSTQGGMIVGFAALDRADRVIGIDASGTLQQTRDQVRKIVDATSELVNLGRSVREDEIVINPDYAYPAYGVPSEETNEAIRLAARTEAMITDPVYEGKSMQGMIDLARKGFFPEGSKVLYAHLGGAPALNGYSYYYKDG

SEQ ID NO: 20519 - protein, 1061 aa, Oryza sativa
MASCRRPAPLRLVVFLAIVLLRWSTNGNATAGGDDALRGDALALVRLRASLRCHAHALRDWSAGNVAAVCAWTGVRCAGGRVVSVDVANMNVSTGAPVSAAVAALDALANLSLAGNGIVGAVTASALPALRFVNVSGNQLGGGLDGWDFASLPSLEVFDAYDNNFSSPLPAGVVALRRLRYLDLGGNFFSGEIPAAYGGMAALEYLSLNGNNLQGAIPPELGNLTSLRELYLGYYNVFDGGIPPELGRLRNLTMLDISNCGLSGRIPPELGALAALDTLFLHTNQLSGAIPPELGNLTALTALDLSNNALTGEVPATLASLTSLRLLNLFLNRLHGPVPDFVAALPRLETVQLFMNNLTGRVPAGLGANAALRLVDISSNRLTGMVPEMLCASGELHTAILMNNFLFGPIPASLGSCSSLTRVRLGQNYLNGTIPAGLLYLPRLNLLELQNNLLSGDVPANPSPAMAAASQSSQLAQLNLSSNQLSGPLPSSIANLTALQTLLVSNNRLAGAVPPEVGELRRLVKLDLSGNALSGTIPAAIGRCGELTYLDLSKNNLSGAIPEAIAGVRVLNYLNLSRNQLEEAIPAAIGAMSSLTAADFSYNDLSGELPDAGQLGYLNATAFAGNPRLCGPLLGRPCGYGGGGAAAVGAGGSSSAPVVTTRQRAAGGDFKLVLALGLLVCSVVFAAAAVLRARSCRGGGGPDGGGAWRFTAFHKVDFGIAEVIESMKDGNVVGRGGAGVVYVGRTRSSGSIAVKRLNTSSSAAAAGGGEAARHDHGFRAEIRTLGSIRHRNIVRLLAFCSRRGGSGGGEAASSSNVLVYEYMANGSLGVHEDGKGGGFLSWDRRYRIAVEAARGLCYLHHDCSPMIVHRDVKSNNILLGDNFEAHVADFGLAKFLRSGGGATASSECMSAVAGSYGYIAPEYAYTLRVDEKSDVYSYGVVLLELITGRRPVGDFGEGVDIVQWTKRVTDGRRESVHRIVDRRISTVPMDEVAHIFFVSMLCVQENSVERPTMREVVQMLSEFPRHGSDQPSPSSSAPETGEESSPEKEPNCYKLFPDLLT

SEQ ID NO: 20520 - protein, 177 aa, Listeria innocua
MTKESLEKATFAGGCFWCMVKPFDTQPGIEKVVSGYTGGHTVNPTYKEVCSGTTGHTEAVEITFDPAVFPYEKLVEVYWQQTDPTDAAGQFVDRGDSYRPVIFYHNEEQRQIAEKSKAALDASGRFKKPVVTEIAKAETFYPAEEYHQDFYKKEKAHYEGYQVASGRAAFIDANWKG

SEQ ID NO: 20521 - protein, 104 aa, Brassica napus
RTHHFSFVLQLDDVIDLVIPRGSNKLVSQIKSTTKIPVLGHADGICHVYVDKACNVDMAKRIVSDSKLDYPAACNALETLLVHKDHEQNGVLNDLIFVLQNNGK

SEQ ID NO: 20522 - protein, 337 aa, Agrobacterium tumefaciens
MLEKFERYPLTFGATAIEYLPRLTEALGGDVEIWAKREDCNSGLAMGGNKLRKLEYIVPDAIASNADTLVSIGGVQSNHTRMVAAVAAKLGMKCRLVQESWVPHEDAVYDRVGNILMTRLMGADSRIVDDGFDIGIRQSWEDAIQSVIDEGGKPYAIPAGASVHKYGGLGYVAFAEEVARQEADLGFKFDYIIVCVVTGSTQAGMIVGFAAQDRADRVIGIDASGTPEQTRSQVRQIVDNTAELVELGRPVREDEIVILNDYAYPAYGVPSNETNEAIRLAARTEAMITDPVYEGKSMQGMIDLTRKGFFPKGSKVLYAHLGGAPALNGYSYTYRNG

SEQ ID NO: 20523 - protein, 251 aa, Unknown
  Azoarcus sp. EbN1
MTVTMRQMLEAGVHFGHQTRFWNPRMAPYIFGQRNKIHIVNLEKTMGKYNEAMNYVRKLAANRGTILLVGTKRQAREIVSEEASRAGMPFVDERWLGGMLTNFKTVKQSIKRLKEMEAMVEDGSIERLSKKEALMATREMDKLKKSIGGIKDMGGLPDAMFVIDVGYHKIAITEAQKLGIPIVAVVDTNHSPEGIDYVIPGNDDSSRAIRLYARGVADAVLEGRSQALQDVVAAGSDEFVEVQEDGSDEQA

SEQ ID NO: 20524 - protein, 370 aa, Rickettsia prowazekii
MSQDYYQVLGVSKTASQADIKKAYLKLAKQYHPDTTNANDAEKKFKEINAAYDVLKDEQKRAAYDRFGHDAFQSQQARGGGNNGSFHPDINDIFGDFFSDFMGSGRRKQTSSKIRGSDLKYDLTIKLEEAFHGIEKNISFSSEVKCDTCHGTGSEKGETITTCDACGGVGATRIQQGFFTLEQTCHKCQGNGQIIKNPCKKCHGMGRYHKQRNLSINIPAGVENGTRIRHTGEGEAGIRGGNNGDLYVDIAIKPHDIYKVDGANLHCKLPISFVHAALGGEIEVPVIEGGKVKLTIPAGTQNGDQLRLRSKGMSKVRSTIRGDMLTHIHVEVPKNLSKKQRELLEEFKKESINEKENDSSFFNKMKSMWS

SEQ ID NO: 20525 - protein, 220 aa, Glycine max
GAVHGVPSIEKITFHLLRLEDGEILDKKVFSNDFVNLTHNMGVFLYDDLLAIVSLRYQTIHILQIRDSGNLVDVRAIGEFCREDDELFLNSNAQLQLPGNHIENHMHQGQPNLGNSFLSGIKQRLLSFIFQGLWNEERDDTLRIQRLRKKFYFHFQDYVDLIIWKVQFLDRHHLLIKFGSVDGGVSRNADHHPAFVAVYNMDTTEIVSFYQNSADELYLL

SEQ ID NO: 20526 - protein, 158 aa, Clostridium perfringens
MEIYDISVKDINGENVSLERYRGKVLLIVNTASKCGFTKQFDGLEELYEKYKDEGFEVLGFPCNQFKEQDPGSNSEIMNFCKLNFGVTFPMFEKIDVNGENESLLYSYLKEQKSGMFGSKIKWNFTKFLVDREGNVIKRFSPQTTPKSIEKDIEELLD

SEQ ID NO: 20527 - protein, 458 aa, Bacillus anthracis
MSTKMTPPVEKNEFIDVVFEDLTHDGAGVAKVKGYPIFVKNGLPGEEAQIKIVKVKKNFAFGRLMKLHTESPYRKDAECPVYNQCGGCQLQHLTYEGQLQAKEKQVRDVMQRIGGLGDVPVHPVLGMKNPWVYRNKAQVPIGEREGGLVAGFYRQGTHDIINMESCLIQAEENDTLIQEVKRICEKHGISAYNEERNKGTLRHVMARYGQVTGEIMLVFITRTAELPNKKAIIEEIAAKFPEVKSIVQNVNPKRTNVIFGDKTTVLYGSEYIYDFIGDIKFAISARSFYQVNPEQTKVLYDKTLEYAKLDGNETVIDAYCGIGSISLFLAQKAKKVYGVEIVPEAIEDAKRNAALNNMTNAEFGVGEAEVVIPKWYKEGVIADTMVVDPPRKGCDEALLNTIIDMKPKRVVYVSCNPATLARDLKVLEEGGYKTQEVQLVDMFPHTTHVECVAWLKLV

SEQ ID NO: 20528 - protein, 209 aa, Arabidopsis thaliana
  misc_feature (15)..(15): Xaa can be any naturally occurring amino acid
  misc_feature (44)..(44): Xaa can be any naturally occurring amino acid
  misc_feature (173)..(173): Xaa can be any naturally occurring amino acid
MASSMLSSAAVVTSXPAQATMVAPFTGLKSSAAFPVTRKTNKDXTSIASNGGRVSCMKVWPPIGKKKFETLSYLPDLSDVELAKEVDYLLRNKRIPCVEFELEHGFVYREHGNTPGYYDGRYWTMWKLPLFGCTDSAQVLKEVEECKKEYPGAFIRIIGFDNTRQVQCISFIXYKPPSFTELNSFLNIYEYLCHSFLCWVFSLMILMQC

SEQ ID NO: 20529 - protein, 661 aa, Medicago truncatula
MSIMRFLLSFMLLLLFLFTPTNSQTPISLNTFCNNSTKKPLTTSYKTNVNKVLQWMNTISSTGQESNLTSIGSNKNDHNDTVYGNYDCRGDIPAHFCNFCVNSAVKEISQTCTNGTSAIIFYDMCILRYSNKNFFGKINLSPSFNLTGPKKIKDSRDFAKAEGLMKDLIRKTTDANRMWATSVFDWSDTEKRYGLVQCAGDLDNNGCKECLKELIDRVAECCGTSVMWGIVAPSCGVRFDDKMFFQVSSEQPGSSSSPNPAKQEGSSNKKTLTIILVSVLMAVALLICCVFYSWRRNNRLSQGESTLSTTPLAFHGHVLRDDSLNGDLPIIPLIVLQQSTDYFSESTKLGQGGFGSVYKGTLPDGTEIAAKRLSETSGQGLEEFKNEVIFIAKLQHRNLVKLLGCCFEQNEKILVYEYMQNSSLDFHLFNSGNHDKLDWSVRLNIINGIARGLLYLHEDSRLRVIHRDMKASNVLLDDEMNPKISDFGLARRFEKGQSQTETKRVMGTYGYMAPEYAMAGLFSVKSDVFSFGVLILEIVYGKRNGEFFLSEHRQTLLLYTWKLWGEGKSWEFVDPIQRKSYIESEVMKCVHIGLLCVQEDAADRPTMSTIVLMLGSDTMVLPKPKKPAFSVGRMFNDEDSTSKSYTDNSVNELTITSFIPR

SEQ ID NO: 20530 - protein, 500 aa, Panax ginseng
MFPLAYPLLFVLLGALSWWILPIISPLKRHHKLPPGPRGLPIIGSLHTLGALPHRTLQTLAKKYGPIMSMRLGSVPTIVVSSPQAAELFLKTHDNIFASRPKLQAAEYMSYGTKGMSFTAYGPHWRNIRKFVVLELLTPAKINSFVGMRREELGMVVKSIKEASAANEVVDLSAKVANIIENMTYRLLLGRTKDDRYDLKGIMNEALTLAGRFNIADFVPFLGPLDIQGLTRQFKDTGKRLDKILEFIIDEHEQNSSNGNASGDFIDDMLSLKNKPSNTHDELSKVIDRSVIKAIMIDIISAAIDTSDTSIEWILTELIKHPRAMKKCQEEIDAVVGVDRMVEETDLPNLEYVYMVVKEGLRLHPVAPLLGPHESMEDITINGYFIPKQSRVIVNSWALGRDPNVWSEDADEFLPERFEGSNIDVRGRDFQLLPFGSGRRGCPGMQLGLITVQLVVARLVHCFDWNLPNGITPDNLDMTEKFGLTTPRVKHLLAVPKYRL

SEQ ID NO: 20531 - protein, 72 aa, Mycoplasma penetrans
MSKEGKITLKGKVVTALQGGQFKVLLENNVEIIANVSGKIRVYKIQILKGDTVEVELSPYDLTRGRIIYRIS

SEQ ID NO: 20532 - protein, 652 aa, Medicago truncatula
MTCTRLVSFMALFLLLFVLITSISAQTPIYMYNFCNSTQKSLSTSYQSNVNNLLLWFNSDSATGKESNHTTLGNNDDAVYGSYDCRGDIADQFCRFCINSAINEISQRCPNGVSAVIWYDICIIRYSNQNYFGKVVVTPSWNITGSNSVKDSTEIGKAVDLMRSLMRKMTEANQSWATSELNWSDTEKRYGLVQCSGDLNNDGCTECLETLFDKIHLCCGTKVTWALVAPSCGIRFDDQLFYQLTENTGSSSPVPNPAKNEGASKSKTLIITLSSVLVAVALVCFCVFVRLRKGGLIFKNIPNAIHDHVQRDDSLDGDLPIIPLTVIHQSTNYFSESSKLGEGGFGPVYKGTLPDGTEIAVKRLAEASNQGLEEFKNEVIFIAKLQHRNLVKLLGCCIEENEKILVYEYMPNSSLDFHLFNEEKHKQLDWKLQLSIVNGIARGLQYLHEDSRLRVIHRDLKASNVLLDSEMNPKISDFGLARKFESGRIETKTKRVVGTYGYMAPEYAMVGVFSVKSDVYSFGVLILEIIYGKRNGEFFLSDHRQSLLLHTWRLWCEGKCLEKIHPIHKESYIESEVMKCIHIGLLCVQEDAADRPTMSTVVVMLGSDTITLPNPKPPAFSVTRVSDEEGTTSKSSKDNYVNEVPITIVSPR

SEQ ID NO: 20533 - protein, 284 aa, Alkalilimnicola ehrlichei
MTAALPRPGEVFLVGAGPGDPDLLTLRAARIMQSVDVVLYDRLVAPEILALVSPDAERIPVGKSAGHHSLSQSAICARLVELASAGQRVLRLKGGDPFIFGRGGEEAAELAAAGVPFQVVPGITAAQGCAAYAGIPLTHRDLAHSCRFLTGHPATDADETDWADLARPGQTLVFYMALGPLADVCARLRQHGLPSSHPAAVVEQGTTRAQRVITGSLETLPRQVAAAAVQSPALLIIGETVRLQSELNWFRPGVNAGAPVFRDLPATTDAGAGVRPLRKAGGTA

SEQ ID NO: 20534 - protein, 382 aa, Bacillus cereus
MVEKMNEEVMDSKELQVGDVVTGSVTKVEEKQVLVNVGYKTDGVIPISELANVHIEKASDVVELDQTLELKVIKLEENDLVLSKRAVDAEKAWVELQEKFNSGHVFDVTVKDIVNGGLVVDLGVRGFIPASLVEVHYVEDFTDYKGKTLAVKIVELDREKNRVILSHKAVVELELDSKKKEAISSLKEGDVVEGTVQRLTDFGAFVNVGGVDGLVHISQISHERVEQPSEVLEQGQKVKVKVLSVDADTQRISLSIKAAQPGPWENIGGEIKAGDIREGVVKRLVTFGAFVEILPGVEGLVHVSQIANRHVKNPNEVLEMGQEVKVKVLEVHVAEKRISLSIKEALEENNVTEDYSQYEPNADSATFQLSDIIGEQLKKLKK

SEQ ID NO: 20535 - protein, 241 aa, Physcomitrella patens
MYNSSLLVIQKLLSTNAYLGHRIPTSDFQGYLYGFRNEMAIINLEKTLICLRRACNLIESIIRAKGHFLLVNTDPEYNKIVQQMAKKTNQSYINHKWIGGFLTNRKHMKNVQKHFQNFSAHSKLKDASTSSPFDFFPHFRKMQKCFEGIMTHDIPDCLVIINANKNSMAILEANQLQIPIVSLVDSNISNRLQKLITYPIPVNDDSIQFVYLFCNLITKTVILSQSAWPLSRKPLSRGRRP

SEQ ID NO: 20536 - protein, 202 aa, Brassica napus
PTRPAFARAVANLCNKITVHNADTLMTLVRSRPPGVPLITVSNHMSTLDDPVMWGGFKGLLSLDPELARWVLAAEDICFKNPVFSYIFRTGKCIPITRGGGIYQEHMSEALERLKEGYWLHTFPEGKVFQEDVPIRRLKWGTASLIARCPVTPIVLPIIHRGFDEMMPEKYIYGRRPPLPLWNKNLRVVVGEPIEFDVPMMV

SEQ ID NO: 20537 - protein, 460 aa, Candida glabrata
MSSQVNEPEFQQAYHEVVSSLKDSSLFEKHPKYAKVLPVVSVPERIIQFRVTWENDNHEQEVATGYRVQFNSAKGPYKGGLRFHPSVNLSILKFLGFEQIFKNALTGLDMGGAKGGLCVDLKGRSDNEIRRICYAFMRELHRHIGADTDVPAGDIGVGGREIGYLFGAYRHYTNSWEGVLTGKGLNWGGSLIRPEATGYGLVYYTQSMIDYATKGKESFSGKRVAISGSGNVAQFAALKVIELGGIVVSLSDSKGCIISETGITTEQIASIAEAKIKFKSLEQIVGEYSAFAENKVEYVAGARPWTLVGKVDIALPCATQNEVSGDEAKALVAAGVKFVAEGSNMGCTPEAIDVFESSRATASAPGEAVWYAMGKNSNLGGVLTSGLEMAQNSQRMSWTSEEVDQELKKGMVNCFNDCIEAAEKYSNESNKNALPSLVKGGNIASFIKVADAMFDQGDVF

SEQ ID NO: 20538 - protein, 512 aa, Prochlorococcus marinus
MSEIKEARLQKASSLVSKGFASYAQSFRVSHTTSFLIQKFDYLENGQEENFSVSLAGRVMAKRVMGKIAFFTISDQDGQIQLYLEKRIINLNLEKQKLLSFEDIKEIVDIGDWIGVYGTIKKTNKGELSIKVEKWEMLSKSLQPLPDKWHGLTDIEKRYRQRYLDLIVNPHSKNVFKTRAKCISFIRKWLDNRNFLEIETPILQSEAGGAEARPFITHHNTLDIPLYLRIATELHLKRMVVGGFEKVYELGRIFRNEGISTRHNPEFTSVEIYEAYSDYVDMMNLTEELIKDILADACGSLTINYQNKEIDFSKPWLRISMKDIVKKYTGIDFHSFNGDFLAAKKAVKNINVDFSNKVNTIGRLLNEVFEQKVESKLIEPTFVIDYPVEISPLARPHFDNKEIVQRFELFIVGRELANAFSELIDPVDQRERMQLQQSLRDKGDLEAHCIDEDFLNALEIGMPPTGGLGIGIDRLIMLITNSASIRDVIPFPLLKPEISSKKSEKLPLNEVK

SEQ ID NO: 20539 - protein, 491 aa, Vibrio vulnificus
MHMSAELLLNVTPSETRVAMIEGGVLQEVHIEREARRGIVGNIYKGKVSRVLPGMQAAFVDIGLDKAAFLHASDIVPHTECVAENEKQQFQVRDISELVRQGQDIVVQVVKDPLGTKGARLTTDITLPSRYLVFMPGASHVGVSQRIESESERERLKKIVSHYCDEHGGFIIRTAAEGADGKELSQDAAFLKRLWLKVMERRSKYKTRSTLYGELGLAQRILRDFVGTELDKILVDSRQEFENLKEFTSEYVPELTDKLELYEGDKPIFDMYDTENEIQRSLERKVELKSGGYLIIDQTEAMTTVDINTGAFVGRRNLEETIFNTNIEATQAIARQLRLRNLGGIIIIDFIDMSSEEHRKRVLTSLENALSKDRVKTNINGFTQLGLVEMTRKRTRESIEHILCSSCPTCEGRGSVKTVETVCYEILREITRVNRAYDADKFVVYASPAVADALHGDESHALAELEVFIGKQVRIQAEPLYIQEQFDVVMM

SEQ ID NO: 20540 - protein, 581 aa, Desulfovibrio desulfuricans
MAGLAAAFGSGAMTNSIDELESMGAGDVIFAVGTNTTECHPVIGANMLQAVRQGARLVVADPRAVTLAAHAAVWLRLRPGTDVALLNGIAHVIISEGLADEAFIAQRTEGYAAFRETVLRCTPQKASAITGVPADDIRSAARILGCAANVSTYYTMGITQHTSGVDNVRAVANIALLTGNAGRPGTGVNPLRGQNNVQGACDMGALPDVLPAYQRVTDPAVRERFAAAWGREVPGKPGLRIPDVLHGLEHGTVRALYVFGENPMRSDPDVGHVEHCLDAAEFLVVQDIFLTETAAKAHVVLPGASFAEKDGTFSSTERRVQRIRRAVPPAGGSRPDWQILSELLTRMGAGPEYGSPEEIFDEMRALTPSYAGITYARLEKGGLQWPCPDVDHPGTPVLHRNAFMRGRGAFLAVEHREPAELPDDAYPLMLTTGRVVAHYHTGTMTRRCWGLNGVAPEEQVELHPDDAAPLGIADGDMVRLTSRRGSMTARVHVTEKTMRGLVFVTFHYSESCGNVLTNSAADPETGTAELKICSVRVEKADRQGPCPADTAGRRPEAAAQKHYSEPAVHPAGTPEKICNPS

SEQ ID NO: 20541 - protein, 668 aa, Bacteroides thetaiotaomicron
MKMGTNYLAILGVTTVTTVMSCTTAKKEYMSYELYPVRTGSLIEMEYTPEATKFTLWSPTADEVRLMLYEAGEGGHAYETVKMQSGEEGTWTAVVSKDLIGKFYTFNVKIDDKWQGDTPGINARAVGVNGKRAAIIDWQSTNPDGWESDTRPPLKSPADMIIYEMHHRDFSVDSTSGVKNKGKYLALTEHGTMNSDKLLTGIDHLIELGVTHVHLLPSFDYASVDETRLNENSYNWGYDPQNYNVPDGSYATDPYQPATRVKEFKQMVQALHKAGIRVIMDVVYNHTFNTDESNFERTVPGYFYRQKEDKTLANGSGCGNETASERLMMRKFMVESVLYWIKEYHVDGFRFDLMGIHDIETMNEIRKAVNAVDPTICIYGEGWAAEAPQYPADSLAMKGNIAQIPGVAVFSDELRDGLCGPVGDKRKGAFLAGIPGGEMSVKFGIAGAIEHPQVQCDSVNYTQKPWAKQPVQMISYVSCHDGLCLVDRLKASMPDITPEQLIRLDKLAQTVVFTSQGIPFIYAGEEIMRDKQGVDNSYKSPDAVNAIDWRRKTTSADVFMYYKRLIDLRKSHPAFRMGDAGQVRKHLEFLPVEGSNLIAFRLKDHANGDHWEDIIVAFNSRPTPARLTIPVGKYTVVCKDGVIDVRGLGIQNGPEVIIPSQSALILYK

SEQ ID NO: 20542 - protein, 72 aa, Oceanicola granulosus
MAKEELLEFPGVVKELLPNATFRVELENGHEIIAHTAGKMRKNRIRVLAGDRVQVEMTPYDLTKGRINYRFR

SEQ ID NO: 20543 - protein, 698 aa, Ostreococcus tauri
MNRRVARAGAEAFGIARVDSTNRAFVDGVTARRLTARGANAYSLRYDWLGNAKEKEKPEKTMDDAIALGIDVIRTWAFMDGDERSFDGRAMQPRRGEFVEKNFVALDEILARARGKVRFILTLTNHWEDYGGIDRYVRWAKESGDAPEIHRREDFYSSPTCRKYFEDFIRKIVDRVNTATGEHYRDDPSIFSYQLINEPRISGDAKGDIFHAWSTHFVQFIKDFDRGNHLVSVGTEGFFIEGDGSDLNPFNGAERQGVDMTRLLGSSVDFACVHVWADDWMDSDDESKFRFLDRWVREHLQRATRANKPVIFEEFGKKRPIAVRDMFFNRVFELLRVEDTDRSSGALFWLFAPDEVPDYDGFTVRSPSDSSTLDIVRREIASMREFVENRSSRDDSGMVSPPLAPPPPSPMSMPSPRDPDGEDDDDFVDFESDGGDDDDPSNESWSTQDDVAVRTSGVVLSYQCRMISSNALEGHATYGDHVSIELAIESTRELDVRVQFIDDARDKMTLTSLKTTSSSSFTTPETISTTHVVTRRLGDGGVYVKEGPMKFRVFLSVADSATEVFVLDAVTMGTTIVFDSAAPFVVDAFLRPYRSTVDGTLSFTVNYGDVAVLYVSFSEPVTPPEVVMNGRLAFISVASSLGDAYYAYVEITRGVDAPGTELTFEIVSALDRAGNRCFTCENAPVRTTDASSLRVVDG

SEQ ID NO: 20544 - protein, 398 aa, Solanum tuberosum
MATEEDAVRRRTALADYRKKLLQHKELDARVRTVRENLRATKKEYAKTEDDLKSLQSVGQIIGEVLRPLDNERLIVKASSGPRYVVGCRSKVDKEKLTSGTRVVLDMTTLTIMRALPREVDPVVYNMLHEDPGNISYSAVGGLSDQIRELRESIELPLMNPELFLRVGIKPPKGVLLYGPPGTGKTLLARAIASNIDANFLKVVSSAIIDKYIGESARLIREMFNYARDHQPCIIFMDEIDAIGGRRFSEGTSADREIQRTLMELLNQLDGFDQLGKVKMIMATNRPDVLDPALLRPGRLDRKIEIPLPNEQSRMEILKIHAAGIAKHGEIDYEAAIKLAEGFNGADMRNVCTEAGMFAIRAERDYVIHEDFMKAVRKLNEAKKLESSAHYSADFGKE

SEQ ID NO: 20545 - protein, 464 aa, Cytophaga hutchinsonii
MKRIKIKELLSNSSQYIDQQVVLKGWVRTKRGNKHVAFVALNDGSTIHTIQIVLDVAKFNEEQLKDVTTGACISISGKVVTSQGAGQSIEVQGDTLEVIGVADPETYPLQKKGHSLEFLREIAHLRPRTNTFSCVLRLRHAMAFAVHSFFNEKGFVYVHTPIITGSDAEGAGAMFQVTTLDLKNPSKTKEGEVDFTKDFFGKATNLTVSGQLEGELAAMALGEVYTFGPTFRAENSNTTRHLAEFWMIEPEMAFYEIQDNMDLAEEFLKYLVKYALDNCIDDLNFLNEMYDKELIERLKSVVETPFVRLNYTEAVDILIATKQKFEYKVEWGIDLQSEHERYLVEKHFKKPVILTNYPKAIKAFYMKANEDGKTVRAMDVLFPGIGEIIGGSQREDNLEKLQERCKEVGIHENDIWWYLETRKFGSAPHSGFGLGFERLMLFVTGMGNIRDVIPFPRTPQSAEF

SEQ ID NO: 20546 - protein, 260 aa, Desulfovibrio desulfuricans
MAYVTMKGMLETGVHFGHQTRRWNPKMGTYIFGARNGIHIIDLQQTVKLFRTAHDKVVDTVARGGKVIFIGTKRQAQEAVQTEAGRAGQYYVTNRWMGGTLTNFQTIRKSIDRLKKLEVMFEDGTVNRYQKKEVLRLRREMDKLNLVLGGIKDMENLPQLAFIIDPNREDIAVKECRRLGIPIVAVTDTNCDPDLIDYVIPGNDDAIRAIKLFVGHIADACLEGEAMRKETKAENAEEAMKQAAEAEAEAAAPAAEESAE

SEQ ID NO: 20547 - protein, 183 aa, Leptospira interrogans
MKKINSDILHPRFSREDISQKVKSLALQISEDYKKLNPIFICVLKGGVYFFTDLTREIPFSVEINFVQARSYSGTVSTGKIELLKDIDIDLSDRHVIIVEDILDTGFTLQYLVRHIFTRNPASLEIVTLLLKERKDTLEFPVKYIGWRIPDEFLVGYGLDFDGRYRNLPDIHVLEPGEPQFPV

SEQ ID NO: 20548 - protein, 688 aa, Craterostigma plantagineum
MEQDNQMLELSSAMNTIIGGDGDGENRELWLDGEDDDQDNLLLGVNEDSIFYTDFPSLPDFPCMSSSSSSSSNPKPIVSATTSSSAASSSWAAAMKSETAAAISSTASMEVQAPATLSDLDCCIDAMENFGYMDLIDVNEIWGGDDDPSDPVFAGDAEQTPAVIPAVDAPHQQLTFDSSPPPQENQRVITMAAQQSQENDGLTTLLQENSELAVIFFEWLKQNKDNISAEDMRSIKLRRSTIDNASKRLGSSKEGKIKLLKLILGWVEQCQLQKKKTNKVGGENSSQEISNSDPNQNPSHNFPYNPDCCFSTPPPPTPWLPPPPQETPAPASFPASYPQPPPMPMYPYDPYVNTVHHQIPPIPYPPPFVEYPPPPPMMEAQPWAAVAAPPYAVAAQPQFGAFPEPNFYACNPYQMCDLSGERFVKLGASATKEARKKRMARQRRLYSSHHRHGHHHHGHQIAPADANSMENHQNGGGDRSSPGNSSWMYNNVGASSNVVIQNVDSTQPSSGDKMAAQAQSSNQRLGSNDRRQQQQQQGLKTEKNLKFLLQKVLKQSDVGSLGRIVLPKKEAEIHLPELETRDGISVAMEDIGTSRVWNMRYRFWPNNKSRMYLLENTGDFVRLNGLQEGDFIVIYSDTKCGKYMIRGVKVRPGTKLESKKPAKKNARSPSIVGNNESSSPVQIKQAVL

SEQ ID NO: 20549 - protein, 336 aa, Debaryomyces hansenii
MTSFDPESISYFNPNVDRRVALITGGNSGVGWYTVLHLYLHGYIVYIAARSKTRVNTSINELKEEAMVIRLKYTSQQSSNERFLGELYFLDIDLLSLSSVLNAVKTFKSREKHLNILINNASVMALPYSITKDGFEIQMQTNYISPFLLTTKLLPLLESSSELFPKSGPPKIIYLSSIGHQLAFKYFNLNSTFNYRPNIVFTWFRYGLAKTCGIHFMKMLALRNPKILCMSVHPGFVMNTNLFSYWTRLPIIGILFWCLFQIFGFLFGVSSEQGSYATVRCCLDPKLSLEEDNGKYFATNGAEAEPSKIARNMNFAARTWIWTVQELSERKISIPN

SEQ ID NO: 20550 - protein, 165 aa, Leptospira interrogans
MRFNMNETLYDLTATLNNGKEQKLENYKGKVLLIVNTASECAFTPQYAGLQNLYSKYKTEGLEILGFPCDQFKHQEPGSDETIKNFCQKNYGVEFPIFKKIEVNGDNAHPVFRFLRNKASGFFGNSIKWNFTKFLVDKQGNVIKRYSPITTPENIEKEIQNLLKR

SEQ ID NO: 20551 - protein, 211 aa, Solanum tuberosum
LGLRYSPFSHRVEWALKIKGVKYEFIEEDLQNKSPLLLQSNPIHKKIPVLIHNGKCICESMVILEYIDEAFEGPSILPKDPYDRALARFWAKYVEDKGAAVWKSFFSKGEEQEKAKEEAYEMLKILDNEFKDKKCFVGDKFGFADIVANGAALYLGILEEVSGVVLVTSEKFPNFCAWRDEYCTQNEEYFPSRDELLIRYRAYIQPVDASK

SEQ ID NO: 20552 - protein, 619 aa, Populus tremuloides
MYGRDPWGGPLEINAADSATDDDRSRNLNDLDRAALSRPLDETQQSWLLGPAEQKKKKIYVDLGCIIVSRKICVWTVGSIVAAGLLVGLITLIVKTVPRHHHSHAPADNYTLALHKALMFFNGQRSGKLPKHNNVSWRGSSCLSDGKGKQGSFYKDLVGGYYDAGDAIKFHFPASFSMTMLSWSVIEYNAKYEAAGELNHVKELIKWGADYFLKTFNSSADTIDRIVAQVGSGDTSGGSTTPNDHYCWMRPEDIDYDRPVTECSSCSDLAAEMAAALASASIVFKDNKAYSQKLVHGAKTLFKFARDQRGRYSAGGSEAATFYNSTSYWDEFIWGGAWLYYATGNNSYLQLATMPGLAKHAGAFWGGPDYGVLSWDNKLAGAQLLLSRLRLFLSPGYPYEEILSTFHNQTSIIMCSYLPIFTKFNRTKGGLIELNHGRPQPLQYVVNAAFLATLFSDYLEAADTPGWYCGPNFYSTDVLRDFAKTQIDYILGKNPRKMSYIVGFGNHYPKHLHHRGASIPKNKIRYNCKGGWKWRDTSKPNPNTLVGAMVAGPDRHDGFHDVRTNYNYTEPTIAGNAGLVAALVALSGDKTTGIDKNTIFSAVPPMFPTPPPPPAPWKP

SEQ ID NO: 20553 - protein, 359 aa, Helicobacter pylori
MKILSYLKKFYLFLLIGAIMQANESMGAKLPKTDERVIYLAGGCFWGLEAYMERIYGVIDASSGYANGKTSSTNYEKLHESDHAESVKVIYDPKKISLDKLLRYYFKVIDPVSVNKQGNDVGRQYRTGIYYVNSADKEVIDNALKALQKEVKGKIAIEVEPLKNYVRAEEYHQDYLKKHPGGYCHIDLKKADEVIVDDDKYTKPSDEVLKKKLTKLQYEVTQNKHTEKPFENEYYNKEEEGIYVDITTGEPLFSSADKYDSGCGWPSFSKPINKDVVKYEDDESLNRKRIEVLSRIGKAHLGHVFNDGPKELGGLRYCINSAALRFIPLKDMEKEGYGEFIPYIKKGELKKYIQDKKSH

SEQ ID NO: 20554 - protein, 444 aa, Desulfovibrio vulgaris
MPGTRFEKDGLVIDTTIPHLGPAKIPSPLVYCHHTNDTGVPLYLDSEFIEELAGESTALNFEAAGPRRNLYFDPSKAKCAIVTCGGLCPGINDVIRAIVMEARHAYDVPAVLGIRYGLEGFIPKYRHDVVELTPDVVSDIHQFGGTILGSSRGPQSPEEIVDALERMNISALFMIGGDGTLKAASNIVQEVMRRNLKISVIGVPKTIDNDINFISQSFGFETAVYKATEAIQCAHTEAIGAMNGIGLVKLMGRESGFIAAHATLSLKEVNFVLIPEAPFTLHGEGGLLPTLERRLRARAHAVIVVAEGAGQNLLADTGKKDASGNPILGDIAQLLRAEIKAYCDERGLPHTLKYIDPSYIIRSVPANANDRVYCGFLGQHAVHAAMAGRTGMVVAKLMDRYVHLPLELVTLRRRKLNIRSDYWRAVLESTGQAELAGMVPGLDE

SEQ ID NO: 20555 - protein, 269 aa, Oryza sativa
MAGGGEELKLLGMWASPFALRAKLALSFKGLSYDYVEEDFKNKSDVLLSSNPVHKKVPVLIHKGKPICESQVIVQYIDEVFPDAGVTLLPADPHDRAVARFWAAYIDEKLFSAWILVFRSKTEEEKAEAVKQTFAVVEKLEGALSECSKGKPFFGGDTVGYVDVVLGGFVAWVHAIEEVFGLNQFDAAKTPLLAAWLERFDELDAVKEVMPDIGRLVELAKMRQAQAAGAAAAAAVRIAAPCIFAMYRRSCQVGSGYSTKMMYDVLRLY

SEQ ID NO: 20556 - protein, 508 aa, Bacillus anthracis
MILDADIKTQLSQYLQLMENDILLKVSAGNDDVSKDMLALVDELATMSSKITVEKVELERTPSFSVNRPGEDTGVVFAGIPLGHEFTSLVLALLQVSGRAPKVEQKLIDQIKNIQGEYHFESYISLSCHNCPDVVQALNVMSVLNSGITHTMIDGAAFKEEVESKDIMAVPTVFLNGESFGSGRMTLEEILAKMGNGPDASELSDKDPYDVLVVGGGPAGASAAIYAARKGIRTGIVAERFGGQVMDTMGIENFISVKRTEGPKLVASLEEHVKEYDIDVMNLQRAKRLEKKELIEVELENGAILKSKSVIVSTGARWRNVGVPGEAEFKNKGVAYCPHCDGPLFTGKDVAVIGGGNSGIEAAIDLAGIVKHVTVLEFMPELKADAVLQERLNSLPNVTVLKNVQTKEITGTDKVNGISYIDRETEEVHHVELQGVFVQIGLVPNTDWLGETVERVRGEIVTDKHGATNVPGVFAAGDCTNNPYKQIIISMGSGANAALGAFDYLIRN

SEQ ID NO: 20557 - protein, 271 aa, Glycine max
MDKSEQTQQQQQQHQHGMGVATGASQMAYSSHYPTAPMVASGTPAVAVPSPTQAPAAFSSSAHQLAYQQAQHFHHQQQQHQQQQLQMFWSNQMQEIEQTIDFKNHSLPLARIKKIMKADEDVRMISAEAPVIFAKACEMFILELTLRSWIHTEENKRRTLQKNDIAAAISRNDVFDFLVDIIPRDELKEEGLGITKATIPLVNSPADMPYYYVPPQHPVVGPPGMIMGKPVGAEQATLYSTQQPRPPMAFMPWPHTQPQQQQPPQHQQTDS

SEQ ID NO: 20558 - protein, 738 aa, Ostreococcus tauri
MASHRISEGGAHAPSLDPIVARAFGAFDHTFTVCDATKPDCPIVYASDGFLRMTGYAAAEVIGYNCRFLQGEKTNKNDVRELREAIKNGDRWSVRLLNYKKDGTPFWNYLVVAPVKLADGTVVKYIGVQTDVTEVKDADTGERGIEFDEKGQPVPSRYDARAAAATLGRVSEVEQAVRTAEGLGNQAQRRTGMDLASTLERIEQSFVITDPSLPDHPIVFASDGFMEFTGYSVDEILGRNCRFLQGPKTDRAAVAKIREAIENGEECTVRLLNYTKTGEEFWNMFTLAPVRDEQGIVRFFAGVQVDITAHDPQTEHETVAEITFKEEDNDANVQVSKSAAQLVAGAAAKDKEFEPPWKHMSGHMLQPKPHQLENRRHWEALWRVTNYNDRPLTIDDFVPIRRIGQGDVGTVHLVALAKEKDVRFALKILTKQEIIDRNKLHRLQTESTILNQIDHPFVATLFASFQTSTHVYFLMEYCEGGELYDFLQKAPGKRLSEEATKFYAAEVLVSLQYLHLLGFVYRDLKPENVLLRRNGHIMITDFDLSFCASCQPHIKVRPGNPTWYPGQRATAHAKKKKLKPPRLPKSGSNPTIVAEPFTFTNSFVGTEEYLSPEVLNGTGHSGAVDWWELGIFMYEMAYGTTPFKAATRDETFSNITNAKLTFPDNIPMSEDFKDCVRKLLQRDSTSRLGTLGGAEEIKSHPFFSCVNWGLLRWEEPPYVPKPRRAAPVRDEEIFEMEI

SEQ ID NO: 20559 - protein, 466 aa, Unknown
  Rhodococcus sp. RHA1
MSAPVSRRPGPVDIAHHSHLVGVFAPQREEVDVRGLEVIGELPADLHGAYLRNGPNPRFDPIGTYVYPLDGDGMVHRIELADGTARYTNRFVRTPMVQAEEKAGHVIWPGVTDLYTPTEDEVGPELAGTSRELPDINIVRHGGRLLAMAETTLPFRLDPADLSTLGRESCDGAMGVGSTAHPKIDPVTGQMVLFNYMLEAPYLTWSVVNPDGSVARTPTVVEGADTPLMIHDMALTERYIVLMLCPLVFDIAAVLTGGSVLDWRPEDGTRIALVPRDGGPVRWSTHDAYWVWHFANAFDLPDGKVSVDYVEWTYPGGFAKAPSPSLGSLVRAVVDPDSGRVTREVVCDRDVEFPRVDDRELTRGHRAVATVGKLDRSQGRQDSLWFFDTARGTEAHWDPGSVSVGEPIFMPGAEHEYWGMIGTDRRDMSSWFFVLPADDPGAGPIGKVRLPIRVPAGLHGAWLPAE

SEQ ID NO: 20560 - protein, 449 aa, Wolinella succinogenes
MPYIQQTLEQLQKTFPAQKEFHQAVHEVLDSLRPLLAKESKYERYNILQRIVIPERQIGFRVTWMDDAGRIQVNQGYRIQYNSTLGPYKGGIRLHPSVNEGIIKFLGFEQIFKNALTGLAMGGAKGGSDFDPKGKSEAEVMRFAQAFMSELYRHIGPLTDVPAGDIGTGAREIGYLFGQYKKLVNRYEGVLTGKSLLWGGSLARKEATGFGSVYFAEEMLRERGESLEGKTCLVSGSGNVAIYTVQKLLELGAKPITVSDSTGMIHDASGIDLDLLKEIKENRRESLTSYAKEHPGSRFISVGEYPKDHNPLWAIPCFAAFPSATQNELNEKDAKHLLQNGCICVSEGANMPSTPSAVEKFLAAKICYGPGKAANAGGVATSGLEMSQNASMTSWSFEEVDMKLHGIMRGIYRAAKETAKEFGEPHNLVLGANIAGFRKVADAMIEQGI

SEQ ID NO: 20561 - protein, 160 aa, Pseudomonas fluorescens
MSAFHDLKLKALDGQELPLAPFKGHVVLVVNVASKCGLTPQYAALENLYQQYKAQGFSVLGLPCNQFAGQEPGTEQEIQEFCSLNYGVTFPLSSKLDVNGPERHQLYRLLAGEGAEFPGDITWNFEKFLLGKDGRVLARFSPRTAPDDPTVVQAIEKALS

SEQ ID NO: 20562 - protein, 755 aa, Desulfovibrio desulfuricans
MSTSRRDFLKYFAMSAAVAAASGAGFGSLALAADNRPEKWVKGVCRYCGTGCGVLVGVKDGKAVAIQGDPNNHNAGLLCLKGSLLIPVLNSKERVTQPLVRRHKGGKLEPVSWDEALDLMASRFRSSIDMYGPNSVAWYGSGQCLTEESYVANKIFKGGFGTNNVDGNPRLCMASAVGGYVTSFGKDEPMGTYADIDQATCFFIIGSNTSEAHPVLFRRIARRKQVEPGVKIIVADPRRTNTSRIADMHVAFRPGTDLAFMHSMAWVIINEELDNPRFWQRYVNFMDAEGKPSDFEGYKAFLENYRPEKVAEICRVPVEQIYGAARAFAESAATMSLWCMGINQRVQGVFANNLIHNLHLITGQICRPGATSFSLTGQPNACGGVRDGGALSHLLPAGRAIPNAKHRAEMEKLWGLPEGRIAPEPGYHTVALFEALGRGDVKCMIICETNPAHTLPNLNKVHKAMSHPESFIVCIEAFPDAVTLEYADLVLPPAFWCERDGVYGCGERRYSLTEKAVDPPGQCRPTVNTLVEFARRAGVDPQLVNFRNAEDVWNEWRMVSKGTTYDFWGMTRERLRKESGLIWPCPSEDHPGTSLRYVRGQDPCVPADHPDRFFFYGKPDGRAVIWMRPAKGAAEEPDAEYPLYLTSMRVIDHWHTATMTGKVPELQKANPIAFVEINEEDAARTGIKHGDSVIVETRRDAMELPARVSDVCRPGLIAVPFFDPKKLVNKLFLDATDPVSREPEYKICAARVRKA

SEQ ID NO: 20563 - protein, 320 aa, Pseudomonas fluorescens
MSEVRHSRVIILGSGPAGYSAAVYAARANLKPLLITGMQAGGQLTTTTEVDNWPGDVHGLTGPALMERMREHAERFETEIVFDHINAVDFAAKPYTLTGDSATYTCDALIIATGASARYLGLPSEEAFMGKGVSACATCDGFFYRNKPVAVVGGGNTAVEEALYLANIASTVTLIHRRETFRAEKILIDKLNARVAEGKIILKLNANLDEVLGDNMGVTGARLKNNDGSFDELKVDGVFIAIGHTPNTSLFEGQLTLKDGYLVVQGGRDGNATATSVEGIFAAGDVADHVYRQAITSAGAGCMAALDTERYLDGLQNASF

SEQ ID NO: 20564 - protein, 543 aa, Aspergillus oryzae
MSLSTSSGDFVRLAFVQYTVFLVSINAPAWDYNLVALDYLPKCDLHWVGNCNELNAGYAADGYARINGMSALVTTFGVGELSALNAIAGAYSEFVPIVHIVGQPHTKSQKDGMLLHHTLGNGDFNVFTRMSADISCTLGCLNSTHEVATLIDNAIRECWIRSRPVYISLPTDMVTKKIEGERLDTPLDLSLPPNDPEKEDYVVDVVLKYLHAAKKPVILVDACAIRHRVLDEVHEFVEKSGLPTFVAPMGKGAVDETHKNYGGVYAGTGSNPGVREQVESSDLILSIGAIKSDFNTTGFSYRIGQLNTIDFHSTYVRVRYSEYPDINMKGVLQKIVQRMGNLNVGPVSPPSNLLPDNEKASTEQAITHAWLWPTVGQWLKEKDVVITETGTANFGIWDTRFPAGVTAISQVLWGSIGYSVGACQGAALAAKEQGRRTVLFVGDGSFQLTLQEVSTMIRNNLNPIIFVICNEGYTIERYIHGWEAVYNDIQPWDFLNIPVAFGAKDKYKGYKVTTRDELRELFANEEFASAPCLQFEIDSRIGR

SEQ ID NO: 20565 - protein, 160 aa, Caulobacter crescentus
MAMSIYDYSAKTLDGQDVSLADYRGQVLLIVNTASKCGFTPQYEGLEALYKAHKDRGFTVLAFPCNQFGAQEPGNAEEIANFCSLTYDVSFPVMSKIDVNGADAHPLYKFLKKEQKGVLGTEAIKWNFTKFLIGKDGQVVDRFAPTVKPEDLKVAVEALL

SEQ ID NO: 20566 - protein, 685 aa, Rhodopirellula baltica
MLRELPVSRSHAACLSMQGAPQLAAPSVVDVPSAKRLVIVGGGMAAHGFCKRVIGSTQRSRFAISVYGEEPRPAYDRVNLSSLLSGRPESDLLLSPREWYEANDIDLHTGRRITRIDLQRQQIHDDQGGVQSYDHLVLATGSYPWVPPISGSDSPGVFVYRTIDDLEAIQRYVREHGAKTSAVIGGGLLGLEAAKVITDLGLATTILEVAPGLMPRQLDAQAAKVLREKVESLGVDVHVTRRTKAIEPRDGRLTLQFENAEPSQVDIVLVAAGIRPRDELARDAGLELGPRGGIAVNRRLETSDPHVFAIGECAAVDGHIHGLVAPCYRMADVLAARLAGEQTEFVDSEEAVELKLLGVPVITLGKAIGESTSGVVVTHDGKNGYRKLILEQGRVVGAASVGEWDDVNLIRMSVAQHKRLWPTQRVRFQRTGMPYAGGTGLQIHQWPGHATVCSCMGITRHQLGMAIADGHGTAAQLSAATGAGTACGTCTNLLCELVGEGPEQVNVRGSKVVLVTSVLAACLALALFLTPPLPFATSVQDSWRKIDLFWRDGFIKQVTGFSLLFLMLAALVFSLRKRVKRISFGEYGWWRAAHAAIGTAMLFGLIVHTGVRMGSNLNFVLSLTFMLLALVGGLAGIASSLESKLSGDSAMFMRAWRPKLTWIHIALFVPLPALLAGHVFSVYWY

SEQ ID NO: 20567 - protein, 637 aa, Ostreococcus tauri
  misc_feature (491)..(497): Xaa can be any naturally occurring amino acid
MPDADAEDGGPREGAERATRASTSSRPSEHEHLSNAILDDFTRGAVPSRSSTPPIPPLAPRQYEAMLRQQRASGVSPHGIDDDAERRSAARENEPSARRAANERVELDAGASAVRDLLGFTGYESSTATHTPAASIAGLEDVRGANGEADLEQVVVGKPATGVGNYDKPPGDELEPVKPAATTGRAKVGWVRINAQGNVNKLSMEKTKIATLLRGKTTHQTTSSAKTSPEKSISQATAAEEFPFEFIALEVALEMVCNSLEVEANKVELDSKPALEALRKRVDNVNLERVRRMKTRLVRVSGRVSKVREEIQRYLDDDSDMRDMYLTRKAKQEQETLTREESTDTPTGNASTQQRSTGGRPPLEHALSMSSGGGPVPRSPLGIPTTAEGVHPYFDHFDDDKDLQELEDLLETYFTHIDSTHRSLNGLNEYIDDLEDLIEIELDSQRNRLIQLELILTTATLCLTCFSVVVGIFGMNIKNNIENRHDMFLVXXXXXXXPTHRLFQLHTALFHNRRRHLRRFLNRYESRGGITPHSDGAVYAEDVSILTLRGTALIEFWPSEGEITGRPIASVLLEPRSVLTYKGTAYRLRHGIRETDADVVTEETANARALGLNPGARVERNPRGRVSVVFVRKRTVV

SEQ ID NO: 20568 - protein, 434 aa, Enterobacter cloacae
MSLWLTYPLLLPSLIVGVTIVLWATSLLPEFITALLFFTAAMTARIAPPEVIFGGFASSAFWLVFSGFVLGVAIRKTGLADRAARALSAKLTDSWVLMVASVVLLSYALAFVMPSNMGRIALLMPIVAAMAKRAGIADGSRAWFGLALAVGFGTFQLSATILPANVPNLVMSGAAEGSYGIHLNYVPYLLLHTPVLGILKGLILIGLICWLFPGSPKPPKEQAPSDPMGRDEKRLAWLLAVVLGMWVTESWHGVGPAWTGLAASIVVMLPRVGFITGEEFSAGVNMRTCIYVAGILGLAIVVTQTGIGTAVGEALLRIMPLDADRPFTSFLALTGITTALNFIMTANGVPALYTTLAQSFSDATGFPLLSVIMIQVLGYSTPLLPYQASPIVVAMGLGKVPARAGMVLCLALAIATYLILLPLDYLWFSLLGKV

SEQ ID NO: 20569 - protein, 577 aa, Gibberella zeae
MFGGSSNNSAGNKSESDSKSDKSPSPEPGTGLSAPSPIKTTDQAASGEKRSGNGSPPTRQDVGGPSDKKRRSSSVSSRASSLLASAKNSLNFSSQSSRGGGSEVNSQTSLQKLGKQDPALAVPQGQHNNSAGDSMPGPKSTFRVGVWEDRNKKCRRTMEDTHAFLYNFVQTPALNDASAKDKPEGDDLVTSDMVESDNGYFAIFDGHAGTFAADWCGKKLHIILEDIIRKNPNALIPEVLDQAFTAADAQLEKLPLKNSGCTAAVAVLRWEDRASNDRSAIKPVKPEEPIEMDKANDGSSNEEATKATNSKGKGSGRQRVLYTANVGDARIILCRGGKALRLSYDHKGSDEVEGKRIAAAGGLILNNRVNGVLAVTRALGDAYMKKLVTGHPYTTETVIQPDSDEFIIIACDGIWDVCSDQEAVDLVRNVNDPISASKQLVDYALNRFSTDNLSCMVVRLDQNKEAAVEVEGAASQVSEADKIVSETKQKIAEGIAPAVGVSATSNAPQSQPPIAVQEGDFVPTSLDDIVTEEPPHVADPKSDDVPILNKAAVLEARKDKPAEEKPVEEQETPPGQE

SEQ ID NO: 20570 - protein, 484 aa, Saccharophagus degradans
MKALSDIGLVGLAVMGENLVLNMESKGFTVTAYNRSAEKVEKFLSGRAAGKNIRGASDVKDLVASLEKPRKVMLMVKAGQPVDDMIEQLVPHLEDGDIIIDGGNTHFPDTIRRAKALEPKGIHFVGSGVSGGEEGALKGPSIMPGGSQHAWQAVKPIFQAISAKVDDGSPCCDYVGQDGAGHFVKMVHNGIEYGDMQLICEAYQVMKELLGLSADEMHQVFAEWNNTELDSYLVEITRDILAYKDEDGAPLVDKILDTAGQKGTGKWTGVSALELGVPLTLIGEAVFARCLSAQKAERVEASQVLNGPAVSFDGDKKQLIEDLRQALLGAKIVSYAQGYVLMREAAKEYNWDLNYGGIALMWRGGCIIRSAFLGDIKAAYDANPELTNLMVAPYFKEKLEAAQAGWRRVVAAAVTNGVPAPALTSALSYFDGYRSARLPANLLQAQRDYFGAHTYERTDRERGEFFHTNWTGRGGDTASTTYNV

SEQ ID NO: 20571 - protein, 228 aa, Bradyrhizobium japonicum
MAKDTTGRLHVQVKTGGKRKLSSKLWLERQLNDPYVAKAKAAGYRSRAAFKLLEIDDKFRLLKHGMAVVDLGAAPGGWSQIAAKRVGSVDGKGKVVAIDLLEMPEIAGVEFAQLDFMDNDAPAKLTAMLGGGADVVMSDMAANTTGHRKTDQLRIVGLIETAAAFACDVLKPGGTFLAKTFQSGADADLLAQLKRDFATVRHVKPAASRQDSSERYVLATGFRGGAKA

SEQ ID NO: 20572 - protein, 458 aa, Streptococcus agalactiae
MENHRYEDEGKFQRKMTSRHLFMLSLGGVIGTGLFLSSGYTIAQAGPLGAVLSYLIGAVVVYLVMLSLGELAVAMPVTGSFHTYATKFISPGTGFTVAWLYWICWTVALGTEFLGAAMLMQRWFPDVPAWAFASFFALVIFGLNALSVRFFAEAESFFSSIKVIAIIIFIILGLGAMFGLVSFEGQHKAILFTHLTANGDFPNGIVAVVSVMLAVNYAFSGTELIGIAAGETDNPKEAVPRAIKTTIGRLVVFFVLTIVVLASLLPMKEAGVSTAPFVDVFDKMGVPFAADIMNFVILTAILSAGNSGLYASSRMLWSLANEGMLSKSVVKINKYGVPMRALLLSMAGAVLSLFSSIYAADTVYLALVSIPGFAVVVVWLAIPVAQINFRKEFLKENRLEDLSYKTPFTPVLPYITIVLLLISIVGIAWDSSQRAGLYFGVPFIILCYIYHKLRYKTW

SEQ ID NO: 20573 - protein, 411 aa, Arabidopsis thaliana
MSLTLEFLLLLIVLFLSHHAHSGSIVKFLPGFEGPLSFELETGYIGIGEEEEVQLFYYFIKSEKNPEEDPLLLWLSGGPGCSSLTGLLFENGPVALKFEVYNGSVPSLVSTAYSWTKMANIIFLDQPVGAGFSYSRTPLVDKTSDTGEVKRIYEFLQKWLSKHQQFFSNPFYVGGDSYSGMIVPPLVQEIAKGNYQINLQGYILGNPITDTESEQNYQIPYAHGMALISDELYKSMERICKGNYVNVDSLNTKCYKLIKDYQKCLHKLNKYHILLPDCDITSPDCFLYRYTLMTFWANNKSVREALQVNKGSIGEWVQCNYKNISYNYDIKSSVAYHMKNSIDGYRSLIYNGDHDMMVPFLATQAWIRSLNYSITDDWRPWMINDQIAGYTRSYSNKMTFATIKASLLVST

SEQ ID NO: 20574 - protein, 378 aa, Colwellia psychrerythraea
MSKRDYYETLGVSQDASEKEVKKAYKKLAMKYHPDRTQGDKSKEETFKEVKEAYEILNDDQKRAAYDQYGHAAFEQGGNGGGGGGHGGGFGQDFGDIFGDIFGGGGGGRGRQRQQRGSDLRYNVDLSLEDAVKGKSLEIKVPTYVSCEPCDGSGAKKGTSAKTCSTCHGHGQVQMRQGLFAVQQTCPTCSGKGKVIADKCTSCRGQGRVEKTKTLSVKIPAGVDTGDRIRLSGEGEAGEHGAPAGDLYVQVNVRDHEIFVRDENHLYCEVPISFVTAALGGDIEVPTLGGKVKLKVPKETQTGKMFRLRGKGVKSVRSSTTGDLMCKVVIETPVNLSGDQADLLRQLEEKMASSSKKHSPKETGFFDGVKKFFDDLKS

SEQ ID NO: 20575 - protein, 653 aa, Unknown
  Magnetococcus sp. MC-1
MCGISGFYQPAASEQELAHNITRMTATLQRRGPDDGGFWLEPSCGLALGHRRLAIQDLSPLGHQPMADASGRYQIVFNGEIYNFLELKQNLERHYGPQPWRGHSDTEVLLALIGHSGLEAALAQCRGMFALALWDRQQRILTLARDRLGEKPLYYGRQGDSLLFASELKALRAHPHWQGGVDRHALTLFMRHSTVPAPYTIHPGIHKLQAGCYQRFQWHPEQGMQDLGMIHYWSMSQVVAHANAHPFDGDETAALQAVEQQLMAIIGRQMVADVPLGAFLSGGIDSSLITAMMQAQSSRPVQSFTIGFAEASHDESAYAQAIARHLGTQHTTLQVTPQDALALVPSLPLIYDEPFSDASQLPTTLLAGLTRQHVTVALSGDGGDELFGGYDRYGESMALWRLRGRVPSPLRRPLARAGRALPSGVWSALLRPVAACLPAKARDNPGDIVHKMMDLLVQPDFAHLYRHMLSHWSDPGNLVVGGHEPPTNLTRGWTQPWRQDPVAQMMYWDTLLYLPDDILVKVDRAAMWSSLECRIPLLDHRLVELVWSMPMHFKRRDGVPKWLLQRLLGKRVPEALFERPKMGFGVPLERWLRGPLKGWAQDLLAPALLQRQGYLNPEPIARIWRQHQQGSHNWHHLLWDLLMWQAWLAEHEG

SEQ ID NO: 20576 - protein, 358 aa, Sinorhizobium meliloti
MARFYPLQITEVRRDTRDAVVVTLEPREEDRAAFDFTQGQYLTFRRLFGGEELRRSYSICAGLDEGALKVGIKRVDDGCFSSWANEELEPGDTLEAMPPMGAFFTPIEPEAAKHYLGFAGGSGITPVLSLIKTVLAREPRSAFTLVYANRHFSSIMFREELDDLKNLYLGRLSVLHVLESEAQEIDLFSGRLDREKCTALFRSWIDVTSADTAFICGPEPMMLGVAAALRAHGLGDDRIKFELFAASQPGRARRKVETAAGADSRARCEATVTLDGATRSFTFPKEGMSLLEAALENRMDAPFACKAGVCSSCRAKVLEGEVEMESNNALEDYEVEQGYVLTCQSYPLSDRIVVSYDQ

SEQ ID NO: 20577 - protein, 503 aa, Streptomyces fradiae
MRLLLVHPSALMYSEIFLRLEPLGLERVAAAARDAGHQVRVVDLQVLPRSVLDAELRSFAPEALCVSLNYLANIPEAIEIARQAKEASPGCFVFFGGHSVSFIAEHVLRQAEGAVDAVVRGEGEPAVAPLLEAARDGGLDTVPGVVTAEGRGPAPRLLDSLDSPRPARDLMRRRNRYFIGELDPCASIEFTRGCPWDCSFCSAWTFYGRSYRKVSAEAAAEEMASIREPNVFIVDDVAFIRPEHGDGIAAALERRRIRKQYYLETRSDVLLRNPEVFERWTRLGLRYMFLGMEAIDAEGLDLYRKRVSPDDNFRALEAARRMGIMVAINLIVDPAWDEERFRVVREFALSVPEIVHLTVMTPYPGTEIWHTEARQLTTRDYRLFDIQHAVVPTKLPLEVFYRELVRTQAVLNRKHLGLRNAVGAMGVLGRNLLRGQTNFARMLWKFGRVYNADRQLADHRRPVRYELPVPEHRAAPPGRQELFIHTRSATPVHRRPAPEADGV

SEQ ID NO: 20578 - protein, 484 aa, Pasteurella multocida
MSVKGDIGVIGLAVMGQNLILNMNDHGFKVVAFNRTTSKVDEFLQGAAKGTNIIGAYSLEDLANKLEKPRKVMLMVRAGEVVDQFIEALLPHLEEGDIIIDGGNTNYPDTNRRVAYLREKGIRFIGTGVSGGEEGARFGPSIMPGGDESAWEHVKPILQAISAKTDKGEACCDWVGRDGAGHFVKMVHNGIEYGDMQLICEAYQFLKEGVGLSDDELEATFKAWRNTELDSYLIDITADILGYKDEDGSRLVDKILDTAGQKGTGKWTGINALDFGIPLTLITESVFARCVSSFKEQRVQASRLFNKVVGKVEGDKAAWVEAVRKALLASKIISYAQGFMLIREASENFGWHINYGGTALLWREGCIIRSRFLGNIRDAYEANPDLIFLGSDAYFKGILENSLGEWRKVVAKSIEVGIPMPCMASAITFLDSYTSERLPANLLQAQRDYFGAHTYERTDKPRGEFFHTNWTGRGGDAASTTYDV

SEQ ID NO: 20579 - protein, 286 aa, Unknown
  delta proteobacterium MLMS-1
MILSDSQVDTVETSPAGWPRWAICLQFRVVFDDPAANLALVRQRLAELAPAAGSLVVLPELWAAGFAYPSLARQAARTPELLAALAAEAADRGITVAGSLPEAAVATDGGYLYYNTLYLVEPAGVAGKYRKQRLFAPLGEDRYFRAGTDDHGAGEPRGPLPAAWGPVAALVCFDLRFPELATAQVDRGAELLLVSAQWPRARRQHWRVLLQARAIENQIFVVACNTCGRVGESDFAGTSMIIAPDGEVLAEAGGTPQALGAPLDFSRLAAARRLFRTRSPGPTTCG

SEQ ID NO: 20580 - protein, 140 aa, Glycine max
  misc_feature (6)..(8): Xaa can be any naturally occurring amino acid
VFHETXXXHSPAPMVPPRYVHEDTQLGGYHIPAGSEIAINIYGCNMDSNRWENPYEWMPERFLDEKYDPVDLYKTMAFGAGKRVCAGSLQAMLIACTAIGRLVQEFEWELGQGEEENVNTQCFTTRKLHPLLVKLKPRIK

SEQ ID NO: 20581 - protein, 416 aa, Neisseria gonorrhoeae
MFSKSVTLAQYDPDLAAAIAQEDRRQQDHVELIASENYVSCAVMEAQGSQLTNKYAEGYPAKRYYGGCEYVDIVEQLAIDRVKELFGAAYANVQPHSGSQANQAVYASVLKPGDTILGMSLAHGGHLTHGASVNISGKLYNAVTYGLDENEVLDYAEVERLALEHKPKMIVAGASAYALQIDWAKFREIADKVGAYLFVDMAHYAGLVAGGEYPNPVPFCDFVTTTTHKTLRGPRGGVILCRDNTHEKALNSSIFPSLQGGPLMHVIAAKAVAFKEALQPEFKQYAKQVKINAAVMAEELVKRGLRIVSGRTESHVFLVDLQPMKITGKAAEAALGKAHITVNKNAIPNDPEKPFVTSGIRIGSAAMTTRGFNETDARVLSNLVADVLANPEDEANLAKVCGQVTALCDKYPVYGN

SEQ ID NO: 20582 - protein, 408 aa, Triticum aestivum
  misc_feature (335)..(335): Xaa can be any naturally occurring amino acid
  misc_feature (369)..(369): Xaa can be any naturally occurring amino acid
  misc_feature (378)..(378): Xaa can be any naturally occurring amino acid
  misc_feature (391)..(391): Xaa can be any naturally occurring amino acid
GIVAVSHGCRGVAARACGLVNLQPTKIVEILKDRPSWFRDCRSLEFFTMLPAGNGGTIELVYMQMYAPTTLVPARDFWTLRYTTTMEDGSLVVCERSLSGSGGGPSTASAQQFVRAEMLPSGYLVRPCDGGGSIVHIVDHLDLEAWSVPEVLRPLYESSRVVAQKMTTAALRHIRQIAQETSGEVVYALGRQPAVLRTFSQRLSRGFNDAISGFNDDGWSVMAGDGIEDVIIACNSKKIRSNNTAPNAFIAPGGVICAKASMLLQSVPPAVLVRFLREHRSEWADYNFDAYSASALKSSSCSLPGLRPMRFSGSQIIMPLAHTVENEEILEVVRXLEGQALDEGLLSRDIHLLQFCTGIDEKSMGSCFXQLVFAPIDXELFPDDAPLISSXGFRVIPLDMKTDGGPRP

SEQ ID NO: 20583 - protein, 909 aa, Oryza sativa
MSAAAEGRPPAAAAAGEMVREATAWCALHGLVVGDRADPRSGTVPGVGLVHAPFSLLPTHLPESHWRQACELAPIFNELVDRVSLDGDFLQDSLSKTKQVDDFTSRLLEIHRKMMEINKEENIRLGLHRSDYMLDSETNSLLQIELNTISASFPGLGSLVSELHRTLIDQYGHLFCLDSKRVPGNEASSQFAKALARAWDEFNVDSAVIMMIVQPEERNMYDQYWLAKHLKESYPFMLFLSSTWSKHKIYTPLTIHYTWHNDYQENFVRDGKTVSVVYFRAGYTPNDYPSEAEWAARLLLEQSSAVKCPSISYHLVGTKKIQQELARPNVLERFLENKEEITKIRKCFAGLWSLDDEEIVKSAIQKPELFVLKPQREGGGNNIYGIDVRETLIRLQKEGGDALAAYILMQRIFPKASLSNLVRGGVCHEALTISELGIYGAYLRNNDKVVMNEQSGYLMRTKVSSSDEELNFWDRGWDKMDCLHGIIGRLSSVELVLGESKTGKSIEGAVRVHSAEGAAPGGEQDQRCGGAAPAAEADVEGADTSKATGQEPRALSSSSSSSPLLSSPLLSGIQEPSRVPAMPPPDLELNKRSASASAPEHDQTAGPYGTALGSSFQLMATNRMDLDQAGHLNRHKKARTFYSYDLYIDKKLGLEVEDETVPIMQFKAKNKLVFLAKQSSKRQNSAKLSFGQHPLSTYEVVGSWSNVSLPFCTEVCKKLILSVIEGVKANLEDGNCFEKFDENNLVVGPSGKRGWCFTKMYEHIKFKITAAQKNLILMRVPYHEKWRIIANQNAVLHETINFIYSNYGCLPKFNEKGVLYTEIEIQLHEAEMFLDFIRHGTAHRLQRNISLTPHQHELILLVMYPLLLPLLQEAILDVLGEPEFRKILLRSVLEVTMKDMKLLEMYDGD

SEQ ID NO: 20584 - protein, 423 aa, Aeropyrum pernix
MEVLALQPTDPLEEARAQLRRAVDLLGYDDYVYEVLANPDRVLQVRVTIKMDDGTVKTFLGWRSQHNSALGPYKGGVRYHPNVTMNEVIALSMWMTWKNSLAGLPYGGGKGGVRVNPKILSPRELELLSRKYFESISDIVGVDQDIPAPDVYTDPQVMSWFLDEYNRVKRGQFFGVVTGKPVELGGLNARIVSTGYGVAVSTRVAAEKFLGGLEGRTVAVQGYGNVGYYAAKFLAEMGAKIVAVSDSRGGIYDPEGIDPEEALKVKRSTGTVANYQRGKKISTMEILELPVDILVPAAIEEVITDENADRIKAKIISEGANGPTTTAAEKILVKKGVLVLPDILANAGGVIMSHIEWVNNRMGGWITDEEALKKLEQKMVENTKTVITYWEKNLKPEENSLRDAAYMIAVERVFRAMKLRGWI

SEQ ID NO: 20585 - protein, 364 aa, Ipomoea batatas
MVTTISATVPSRVERLAGSGIERIPKEYIRPEEERPSIGDIFAEEKMGGGPQVPTVDLKRINSEDLEVREKCREELRKAAVDWGVMHLVNHGIPEELTGRVKAAGEGFFGQPIEEKEKYANDQAAGNVQGYGSKLANNASGQLEWEDYFFHCVFPEDKTDLSIWPKTPSDYIDATREYAKQLRALTTTVLAVLSQGLGLEEGRLEKEVGGMEELLLQMKINYYPKCPQPELALGVEAHTDVSALTFILHNMVPGLQLFYEGKWVTAKCVPNSIIMHVGDTVEILSNGKYKSILHRGVVNREKVRVSWAVFCEPPKEKIILQPLPETVSEADPPRFPPRTFAQHIKHKLFRQTDQEGADTPKPDE

SEQ ID NO: 20586 - protein, 577 aa, Legionella pneumophila
MNSEVDTLFAQAYKLQYEGHLPQAISLYEQILAQSPKHTETLHFLGLTYAQLGDMENAILYFLQAKKINPNDVGILNNLANAYKKAGQLDEAIKYYQQAIEIKPEYVQAHNNLAATYALLNNYQKALHHYVIAVNTEPDFSAAHFNLGLLLLKNQQLSAAKTQFNNVIALNPKHREAQFYLGILHLEDNLLSEAEQAFHKVLEQDHEHVQSLINLGVIALKREQNQLAVDYFTKALALDNEDIDARNNLAATFMHHDRFENALMHYDVLLKKEPNNLEYLYNSGVAQMALGHLNEATLLFDQILTLQSDHTPSLNNLAAIYLKMDMRETAREYLERALVINPDDVVSRHMLNAITGATSVNTTEKYAQNLFNNYALYYDQHMQGELHYKIPHHIGRLIHQLQLLQTSHSLDLGCGTGLTGIVLREISKHLTGVDIAEKMIARAKEKNIYDLLVCSELIDFLRKNKNDYDLAVAADVLPYFGNLDDIFNYINQHLKQEGYFIFTTEISTTTPWKLESSARFSHQPEYIESLINKYQFHLIKQEKIPGRTQNKQVLEVMLYCVKKSTSRFVSNRTYENP

SEQ ID NO: 20587 - protein, 242 aa, Glycine max
  misc_feature (235)..(235): Xaa can be any naturally occurring amino acid
MRICGAAAISSSYTTTSNSLLVFASSSLSSPAKTKFLPSLSRFSVKRLCFLSQTRPHISVNKPSMNLLNRLGFGSARAPENMDSSIPQGPDDDIPAPGQQFAEFGAGCFWGVELAFQRVPGVTKTEVGYTQGLVHNPTYEDVCTGTTNHSEVVRVQYDPKICSYETLLDVFWARHDPTTLNRQGNDVGTQYRSGIYYYTPEQEKAAKESLEQQQKQLNRKIVTEILPAQEFYRAXEYHQQYL

SEQ ID NO: 20588 - protein, 85 aa, Glycine max
  misc_feature (5)..(5): Xaa can be any naturally occurring amino acid
  misc_feature (7)..(7): Xaa can be any naturally occurring amino acid
  misc_feature (9)..(9): Xaa can be any naturally occurring amino acid
  misc_feature (12)..(12): Xaa can be any naturally occurring amino acid
  misc_feature (15)..(15): Xaa can be any naturally occurring amino acid
  misc_feature (27)..(27): Xaa can be any naturally occurring amino acid
  misc_feature (31)..(31): Xaa can be any naturally occurring amino acid
  misc_feature (44)..(44): Xaa can be any naturally occurring amino acid
  misc_feature (49)..(49): Xaa can be any naturally occurring amino acid
  misc_feature (51)..(51): Xaa can be any naturally occurring amino acid
  misc_feature (55)..(55): Xaa can be any naturally occurring amino acid
  misc_feature (72)..(72): Xaa can be any naturally occurring amino acid
  misc_feature (75)..(75): Xaa can be any naturally occurring amino acid
  misc_feature (81)..(81): Xaa can be any naturally occurring amino acid
RRPAXCXRXIKXKPXPQSERFCRSVPXPKIXIYDVGMKKKGVDXFPFCXHXVSWXKENVSSEALEAARIACXKYXATFAGXVVST

SEQ ID NO: 20589 - protein, 362 aa, Ipomoea batatas
MVTTITVPSRVERLAGSGIERIPKEYIRPEEERPSIGDIFAEEKMGGGPQVPTVDLKGINSEDLEVREKCREELRKAAVDWGVMHLVNHGIPEELTGRVKAAGEGFFGQPIEEKEKYANDQAAGNVQGYGSKLANNASGQLEWEDYFFHCVFPEDKTDLSIWPKTPSDYIDATREYAKQLRALTTTVLAVLSQGLGLEEGRLEKEVGGMEELLLQMKINYYPKCPEPELALGVEAHTDVSALTFILHNMVPGLQLFYEGKWVTAKCVPNSIIMHVGDTVEILSNGKYKSILHRGVVNREKVRVSWAVFCEPPKEKIILQPLPETVSEADPPRFPPRTFAQHIKHKLFRLTDQEGADTPKPDE

SEQ ID NO: 20590 - protein, 720 aa, Alkalilimnicola ehrlichei
MRRVSRRGGAPRQSFQEQPDIIVKSVKKSFQYGNHTVTLETGGVARQADGAVLVNMSDTVVLVTAVGRKEADPGKGFFPLTVNYQERTYAAGKIPGGFFKREGRPSEKETLTCRLIDRPIRPLFPEGFYNEVQVVATVLSMNPEVDADIPALIGASAALSISGIPFDGPIGAARVGYKDGEYLLNPTFEETAASDLDLVVAGTENAVLMVESEANQLPEEAMLGAVLYGHEQMQVAIQAINELTAEAGKPRWDWHPPQGDAALETAIKDLVGDDLAAAYQIPEKQERQNRIGELRQRAVEALGENREEEGGWPEKDVGDAFKGLEKDIVRGRILAGERRIDGRDTRTVRPIDIEVGSLPRTHGSAIFTRGETQAVVVTTLGTGRDAQIIDAIEGERKEQFMLHYNFPPYCVGETGFMGTPKRREIGHGKLAKRGIEAVMPAADDCPYVIRVVSEITESNGSSSMATVCGTSLSLMDAGVPVKAPVAGIAMGLIKEDEQFAVLSDILGDEDHLGDMDFKVAGTESGVTALQMDIKIQGITREIMEQALEQAREGRLHILGEMNNAISGPRSEMSEYAPRLLTIRIDPDKIRDVIGKGGATIRALTEETGTTIDISDDGKVTIASADKAAADEARRRIELLTADVEVGTVYEGKVSKLMDFGAFVNILPGRDGLVHISQISNERVERVGDYLKEGDTVRVKVLEVDRQGRIRLSMKAVQDGE

SEQ ID NO: 20591 - protein, 368 aa, Ipomoea batatas
MATTLSTLTALAGETALQSSFVRDEDERPKVGYNEFSDEIPVISLKGIDDVNGRRVQIRNDIVKACEDWGIFQVVDHGVDAGLIGEMTRLSKDFFALPPEEKLRFDMSGGKKGGFIVSSHLQGEAVKDWREIVTYFSYPVRARDYSRWPDKPEGWRAVTEKYSEKFMDLACKLLEVLSEAMGLEKEALTKACVDMDQKVVVNFYPKCPQPDLTLGLKRHTDPGTITLLLQDQVGGLQATKDGGKTWITVQPIDGAFVVNLGDHGHFLSNGRFKNADHQAVVNSERSRVSIATFQNPAPEAKVYPLKVREGEKPILEEPITFAEMYRRKMSKDLELARLKKFAKEQQQIINAATADKNLETKPIDQILA

SEQ ID NO: 20592 - protein, 371 aa, Bdellovibrio bacteriovorus
MAGKRDYYEILGVEKGADQDTIKKAYRKLAMQFHPDKNPGNKEAEEKFKEAAGAYEVLSDAQKRAQYDRFGHDAFTRGGGGGGFTDAEDIFSHFGDIFGDFFGGGMGGQQRQRRNRNEPRRGSDLRYVTEITLKDVITGIEKEIEFDTDKNCDECKGTGAEKGSQVSTCGTCGGSGQVVRQQGFFAMASTCPTCHGQGTVIKNPCKPCKGKGRVAEHRKIRLNIPAGVDTGTRLRVATEGEGGYMGGPPGDLYVEIRVKQHNNFERRNEDLFAELSLPYVQMLLGAEIEVPTVTGKAKLEVPKGTHHGDNVKLVGEGLPSLRGNRRGDIYFTVNVQFPEKLHKDEEKLLREIAKARGLNVTSEGGFFGKKK

SEQ ID NO: 20593 - protein, 479 aa, Cytophaga hutchinsonii
MLERGQILESVAIEELGAEGKCVSRYNNIVIFSERTVPGDVVDLKVTHFKKKKFGEANVYKIITPSEHRVEAKCQHFGLCGGCKLQHIDYSTQLHFKQKQVKDNLERLGKIEIPEIMPIVGSGKTYEYRNKLDFTFSNKRWLLEEEMSLEHDTLYGLGFHLPGKFDRVIDISTCHLQPEPSNSIRLEVKAYALKHGLTFYNVRAHEGLMRNLIIRTTNTHEVMVLVQFGEDNKPAIQGLLSHLITTFPQITSLVYFINTKKNDTYSDLDVHVFHGPGYIQEEMEGLIFRVGPKSFYQTNSDQAYELYKVTRDFAGLTGNEVVYDLYTGTGTIANFVAKKAKQVIGIEYVADAIEDAKVNSKINNIDNTLFYAGDMKDVLNKEFIAQHQRPDVIITDPPRAGMHEDVINTLLFIGAPKIVYVSCNPATQARDLSMLDSDYEVSRIQPVDMFPHTAHVENVVLLTKRAVKKIIQKPVSEPA

SEQ ID NO: 20594 - protein, 618 aa, Nostoc punctiforme
MKLLDLDNPEVKLASKTDSNFVDLTATHPRPLLKRSRWQSLNGLWKFSFDDQGKCVEPSDFSQWSNYIEVPYAPESTKSGINDRGFHPNCWYEREFETPPGDGRLLLHFGAVDYRARVWVNDKYIAEHEGGHTSFTLDITHALNDSGTTKVTVWAQDDPHDLAKPRGKQDWHLKPHSIWYPRTSGIWQTVWLERVGETYIGNLRWIPDCERWEIGFEAGLAGNLLTSGVQIKIKLSAGGRVLASDTYEIFNGEITRRIVLSDPGIDDCRNELLWSPEKPTLIDAQIQLWDKDCLLDEVQSYTAMRTVSIQRDRFMLNGRPYYLRLVLDQGYWPETLMTPPSDEALRHDVELVKAMGFNGVRKHQKIEDPRFLYWADVLGLLVWEEMPSAYRFTPKAVERMTHEWTEIIKRDVSHPCIVAWVPFNESWGVPNLVETAAHRNYVLAMYHLTKTLDPTRPVIGNDGWESTDTDILAIHDYERQPERLAHRYRADIQISDLFERSRPGGRILTLDNYPHQGQPVMLTEFGGIAYAPIDQPNADQAWGYEHCSNISELEMKYAALLKTVNDIELFSGFCYTQLTDTFQEANGLLYGDRTPKFPIEAIRAATLSGQGLCTPTSC

SEQ ID NO: 20595 - protein, 241 aa, Oryza sativa
MAAAAPSRVSVRAAAPGQTGGFAKIRPQVVVAAAARSAGVSGRRAKELSGLRCSRPKPATPKDARPAKVQEMFVYEINERDRESPAYLRLSAKQTENALGDLVPFTNKLYSGSLDKRLGISAGICILIQHVPERNGDRYEAIYSFYFGDYGHISVQGPYLTYEESYLAVTGGSGVFEGAYGQVKLNQIVFPFKIFYTFYLKGIPDLPRELLCTPVPPSPTVEPTPAAKATEPHACLNNFTN

SEQ ID NO: 20596 - protein, 242 aa, Saccharomyces cerevisiae
MQKHNIKLNQNQDISQLFHDEVPLFDNSITSKDKEVIETLSEIYSIVITLDHVEKAYLKDSIDDTQYTNTVDKLLKQFKVYLNSQNKEEINKHFQSIEAFCDTYNITASNAITRLERGIPITAEHAISTTTSAPSGDNKQSSSSDKKFNAKYVAEATGNFITVMDALKLNYNAKDQLHPLLAELLISINRVTKDDFENRSKLIDWIVRINKLSIGDTLTETQIRELLFDLELAYKSFYALLD

SEQ ID NO: 20597 - protein, 72 aa, Campylobacter upsaliensis
MAKDDVIEIDGNVIEALPNANFKVELDNKHIILCHIAGKMRMHYIRIMPGDRVKVELTPYSLDKGRITFRYK

SEQ ID NO: 20598 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQGNYFYRSGGIIRLQ

SEQ ID NO: 20599 - protein, 1042 aa, Ralstonia eutropha
MKRMLFNATQQEELRVAIVDGQKLIDIDIETAGREQRKGNIYKGVITRIEPSLEACFVNYGEERHGFLPFKEVARAFFKEGIDVRNARIQDALHEGQELIVQVEKEERGNKGAALTTFISLAGRYLVLMPNNPRGGGVSRRIEGEDRQELRETMSQLQVPDGMSIIARTAGIGRSAEELQWDLNYLLQLWKAIDGAAGDNKAPLLIYLESSLVIRAIRDYFQPDIGEILIDTDEIYEQARAFMSVVMPDNMNRVKKYRDDVPLFSRFQIEHQIESAYSRMVMLPSGGAIVIDHTEALVSVDVNSARATKGADIEETALRTNLEAADEIARQLRLRDLGGLIVIDFIDMESGKAQKDVETRLKDALRHDRARVQMGKISRFGLMELSRQRLRPSLSEGSHITCPRCNGTGHIRDTESSALQVLRIIQEEAMKENTAAIHCQVPVEVAAFLLNEKRQEINLIELRFKVNVLLIPNKHLETPHYKLERLRHDDPRLEEGMASYRMAEAAAKELEADTSYSARKKEDAKPRQEAAVKGITPEQPAPVSVPRPERAPRQEAAPAAPPVPATKPVESGGFIAWLKGLFGARPAAPVVVEPAKPAASEARSADGRRERGQRGEGRGQGQRGDRAERGERTERGERGERGERQRGDRGPRGERVERQGGERAEQREQREPREQREPRGERQGRQPRQGEQATPALARQPEAAQGERAEARQEGRRDRNQERRERQRERQRDRGDARETEAGEAAPAEAVAAIQAAASLPEAAFEDTQPAGQRAELPEGAEAVTEGGEGEERRRRNRRGRNRYRRERDDSVQGTQDDAEDTTSAEVVADAAQAVAVEASAAPAVAAPVADEREVEPVALAAEKPAQAVEAVAAPVVTVTEVAAQPAMTQVAAPVVAEAPAVETAPAVIPAVTMAEPAPAPQAAPVEPAAPAVQPAAAEPVAVEVAIAAPAVPVAAPVTTVAAAAASPSTQSLEGLQPMLATAGLEWVSTDSEKLRAAQEAAARIVPAPRVPRERKPLPPLPEGPMVLVETSAREVEKAEQH

SEQ ID NO: 20600 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQIDDYNRSKDNINLQ

SEQ ID NO: 20601 - protein, 297 aa, Bordetella bronchiseptica
MTTASLRFGLAANRLHHETPDAALFTWLRACSATIREMGIQLHTVGRTHDAIVREGMLQGYSGLVRYPYGREGGLMKLVARVTEGRDGDAPFDGAIYLIDPVDPSSIFPEALALKRQCITHGRPFISTLAGAIEWIEVERVLAGLAPDATAARLFDFTGQTLALISHDALKEEMVAFAAEHFDLLSQFARRVATGTTGGLLNDLAWSRGWPKDRPWVHRYLSGPLGGDAQIAELVLEHQCQRVIFFEDPHVARQHEADIQLLERAVRVVTASATCATSPSVARRWAQAVQRRQAGRA

SEQ ID NO: 20602 - protein, 908 aa, Ustilago maydis
MSYPPSQPRKAVQPLTSDANTPDHWIARDERMIRLTGKHPFNSEAPLSELFSKGFLTPQNLFYVRSQGDTPRVTREQAENWKLKVHGLVEQEVELSIKDLKEKFSYSHPQTITLVCAGNRRKEQNMVAKGLGFNWGAAGVSTGLFTGVYLADILDYCKPKNPLLSSFPSYDVAVLDRARHVVFEGADELPKGKYGTSQRLNWALDRCKGMLIAWGLNGEDLSPDHGYPLRLVVPGQISGRMVKWLERIEVSDRESQHHLHFHDNQVLPTEVTADQARSEMHWWYDPKYIINDLNVNSAICSPDHDQVVMLPNHLRPVEMLPLEGYAYTGGGRVSTRVEISLDDGRSWKCASIHYPEDLYRMYPIQGHEYFGTLDLSATEMSFSWCFWRLDVDVEADIIAKDVKVISVRALDEVLATQPRDMYWNATSMMNSWWFRVCIAKARTATKIRFEHPTSPQCPGGWMQRMNEAGLNPRYPQFVEAKAVESCKTDANTLPRPRKPSGSPKAIMIDPSKADTIITAPILAAHGDGEGPEPWFVVHGHLYDGTGFLKDHPGGDQSIVLSPGEDDATEDFMAIHSMDAKKMLRDFHLGRLEKQDAAPPAATEREVLDLSKPFLDPKKWRATRLGEQANHSPDARIFRFALGSEDQELGLPWPAALRLSLEKRRTGEAEMVQRAYTPYSGNTQRGFLDILIKVYFPSDAAATSAPAFEGGKMTMLLEKIDVSSPSDDLTIELKGPLGSFTYLGQQQIRWKPASACSLRKLAMIAGGSGITPIWSTLKAIADEVLDASNPSSPALDPIQIWIVYGNRTEQDILIREELDALSRLKGNLKVWHVLSNCTPENEANWSMGRGISLPMSLGAPATNHRQSCFGGDELEDTLALVCGPPPMEKAVSDGLNELGWDLQRCVVFF

SEQ ID NO: 20603 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQFSTPPRSIVNNGLQ

SEQ ID NO: 20604 - protein, 93 aa, Methanosarcina acetivorans
MAGDFMKPMLLDFSATWCGPCRMQKPILEELEKKYGDKVEFKVVDVDENQELASKYGIHAVPTLIIQKDGTEVKRFMGVTQGSILAAELDKLL

SEQ ID NO: 20605 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQLVSFNRSSIINRLQ

SEQ ID NO: 20606 - protein, 130 aa, Arabidopsis thaliana
  misc_feature (15)..(15): Xaa can be any naturally occurring amino acid
  misc_feature (36)..(36): Xaa can be any naturally occurring amino acid
VRCISINHVDSYVLXSESSILVYHYKGFTKTCGYTXRRRSITGPRELAGELALTDQSVMYNRGSFLCPGCQPFPQSTIPEKLPSTDRQLIQLGINTVTHLIGKGDEIKKLHVSAASAQDSMICHDCVYTL

SEQ ID NO: 20607 - protein, 812 aa, Aspergillus nidulans
MSGRTPVTIVVEHLDPELGTWSALEYGCIARESHAAGSRFLLSSVPKSLQMPDDLAATKGLEVEHRSVEEVFSDRQSKICLLDPSAKVELSPADGDTFEVFLFGGILDRTSELRKKGYEGRRLGPVQMTTDTAVRVTRMVVHDRVPLEEIQYIDNPEIVINEHERTEMPFRYVKDSKGKPIMPEGMVELIKKDAEKTSSLLSLKCGKPTDPDIPFLAQSAADYYVESLPGAPEGPLLKMHAGHIEVDPEHNGHLFFWHYQNRHIANRQRTIIWLNGGPGCSSMDGALMEIGPYRLKDNETLEYNEGSWDEFANLLFVDQPVGTGFSFANTNSYLHELDEMAAQFITFLEKWFAVFPEYERDDIYIAGESYAGQYIPYIAKAIQDRNKDIHEKQSSSARWNLRGLLIGNGWISPAEQYPAYLSFAYEEGLVEEGSKLGKELETLLSICKSKMETGPKISITDCEAVLNKLLDKTVDSNNQCINMYDIRLRDGSCGTTWPPDLVDVKPYLHTYEVIQALNISPEKESGWDECDGNVGAAFRPQKSEPSVKLLPGLLESGIEILLFSGDKDLICNHVGTEQLISNMKWAGGTGFETSPGVWAPRHDWTFEDEPAGYYQYARNLTYVLLYNASHMAPFDLPRRTRDMVDRFMHVDIASIGGAPADSRIDGEPLPQTSVGGQPNSTVHQEEEQQKIKETEWNAYAKSGEAVLVVVIIGVLVWGFLIWRSRRRHNGYSGIAIKSPSRTSIMGRFHNNHSNGADVEAGDFDEAELDDLHSPGLDRENYAVGEDSDDEAHRQDLPRAQESSSKSENNLVT

SEQ ID NO: 20608 - protein, 752 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQTNRINRSNNGTVLSK

SEQ ID NO: 20609 - protein, 456 aa, Enterococcus faecalis
MTQQLVKKGQQISLKIKRLGINGEGIGYYKKLIIFVPGALPKEEVTATITNVTPKFAEGTLQSVKKAAKDRVVPPCPVYETCGGCQLQHLAYKAQLDFKKDLLKQALNKFKPANYQNYELRKTIGMDNPWNYRNKAQFQLRQIDGQVEAGLYQADSHQLVPIDNCLVQQPATTKVMNTLVDLLNDFQLPIYDERKNSGIFRTLMVRVGIQTGEVQVVFITQSQKFPQKEKMVRAINEQLPEVVSIMQNVQNKKTSLVMGDDTLHLWGKESIEEHINDVVFDLSPRAFFQLNPEQTEVLYNEGIKALDLQPNETVVDAYCGVGTIGLSLAKQAHQVRGMDTIPAAIDDARFNAKRLGVTNTHYAVGTAEDLLPKWFKEGFKPDAIVVDPPRTGLDRKLLTALLKQPPKKMVYISCNVSTLARDLVQLAKVYQVDYLQSVDMFPQTARCEVVVKLTRK

SEQ ID NO: 20610 - protein, 386 aa, Unknown
  Azoarcus sp. EbN1
MTPPIVIIGSGLAGYTLAREFRKLDRDTPLVILSRDAAGFYSKPMLSNAFSANRSAASLVMKPAEKMAAELAATIRSHVEVAALHPARRIVELAGGEEIPYRNLVLAPGADPIRLPLGGDAAADVLSVNDLDDFARFAARLDGAKRVAVLGGGLIGCEFANDLLARGITPTVIDIARWPLGRLLPEDAGQWFRQRLEAAGVSFRLGVSAASVSRHAGGYRLALSDGSTLDADVVLSAVGLRPRTALAAAAGLAVNRGVLTDRRLASSDPHIHALGDCVEVEGLTLPYVMPIMHQARALAATLAGTPTAVNYPAMPVVVKTPACPAVVCPPAINAQGSWQVVASDEAGGGIEAQYLDANEKLLGFVLLGSATARKQMLAGRAPATLD

SEQ ID NO: 20611 - protein, 430 aa, Listeria innocua
MKITINQASEFVGKEVTIGAWLANKRSSGKIAFLQLRDGTGFMQGVVVKAEVGDDMFATAKALTQETSLFVTGTINEDTRSPFGYEMAVSGVEVISESHDYPITPKEHGTEFLMDHRHLWLRSNRQHAIMKIRNEIIRASYEFFNKEGFLKIDPPILTGSAPEGTTELFHTKYFDEDAFLSQSGQLYMEAAAMAFGKVFSFGPTFRAEKSKTRRHLIEFWMIEPEMAFYKLEDSLQVQENYVAFLVKAVLDNCRLELDRLGRDVSHLEKMVAPFPRITYTEAIERLHELGFDDIVWGDDFGAPHETAIADSFEKPVFITHYPKAIKPFYMPEDPENDQVVLCADMIAPEGYGEIIGGSERIHDLETLQARMEDFDLDQEAYSWYLDLARYGSVPHSGFGLGLERTVAWISGTEHVRETIPFPRLLNRLYP

SEQ ID NO: 20612 - protein, 368 aa, Ipomoea batatas
MAATLSTLTALAGEKALQSSFVRDEDERPKVGYNEFSDEIPVISLKGIDDVNGRRVQIRNDIVKACEDWGIFQVVDHGVDAGLIGEMTRLSKDFFALPPEEKLRFDMSGGKKGGFIVSSHLQGEAVKDWREIVTYFSYPVRARDYSRWPDKPEGWRAVTEKYSEKLMDLACKLLEVLSEAMGLEKEALTKACVDMDQKVVVNFYPKCPQPDLTLGLKRHTDPGTITLLLQDQVGGLQATKDGGKTWITVQPVDGAFVVNLGDHGHFLSNGRFKNADHQAVVNSERSRVSIATFQNPAPEATVYPLTVREGDKPIMEEPITFAEMYRRKMSKDLELARLKKFAKEQQQIVKAAAADKNLETKPIDQILA

SEQ ID NO: 20613 - protein, 962 aa, Alkalilimnicola ehrlichei
MKLEKRKGSSAATAVGGFLGRAVDRRTFLRGSGLAVGGTAAAAAMLEPRMMRKAKASERARFDPNADIKEVKTVCTHCSVGCGVIAEVQNGVWVGQEPNFDSPINLGAHCAKGASLRNHGHSGRRTKYPMKLVNGRWERIGWEQAIEEIGDKLLQIREESGPDALWFAGSSKASNEGAYLQRKFAAFWGSNNCDHQARICHSTTVAGVANTWGYGAMTNSYNDITKSNCIVMCGSNAAEAHPVAMQMILRGKENGAKLIVMDPRFTRTAAHSDIFVRPRSGTDVALIYGILWHIFENGWEDSTYIRQRVWGMDRVREEVAHWTPEEVERVAGVGEEALRDVAKTIVDNSPMTFIWCMGGTQHTIGNNYVRAYNHLLLATGNVGVSGGGANIFRGHDNVQGATDVGPNAHILPGYFPHSEGGWRHWARVWDVDYEYLQGRFDPAEYDDGSGGQAKPMHMPGIPVSRWIDGVLEDADNLSQKDNIRAVMFWGHAPNSQTRLPEMKEAMEKLDLLVIADPYPTVSAVLHDRQNDTYLLPACTQFETRGSATASNRSLQWRDKVIEPLFEGKPDHEIAYLLARKLGFADEMFKNIRIEGTEPVVEDVLREINRGTWTIGYTGQSPERLKKHMENQATFDVVSLKAEGGPCDGEYYGLPWPCWGTAEMGHPGTPNLYDTSKHVAEGGLTFRARFGTEYEGENLLAEGSYSKGSAIRDGYPEITADMIKQLGWWDDLTDEEKAQAEGRDWKTDLSGGLQRVAIKHGLAPFGNAKARCYVWNFPDPVPVHREPLYTPRYDLVSDYPTYEDRKAFYRLPTRWASVQAQDYSGDYPLIHTSGRLVEYEGGGEETRSNPWLAELKQEMFVEINPRDANNAGVRNNEWVWLEGPEGGRIRIKALVTRRVAAGTVFTPFHFGGHFQGEDLLAKYPEGASPYVRGESNNTATTYGYDSVTMMQETKTTLCRVVPA

SEQ ID NO: 20614 - protein, 533 aa, Burkholderia vietnamiensis
MNARTLPFGPPGHDGHDGHDGPDETTDIAIIGTGFAGLGMAIRLRQTGATDFVVLEKAASVGGTWRDNHYPGCACDVQSHVYSFSFAPNPRWTRMFAPQPEIRAYLEDCVQRFGIGPHLRMNHELQRAEYDEAAQRWRLTFANGKRLSARVLVSGMGGLSRAALPAIAGIETFEGRAFHSQQWDHAYPLEGKRVAVIGTGASAIQFVPQIAPRVKSLALFQRTPPWIMPKPDRNLTRVEKWLFRTLPFTQKLVRSGIYWMLESRVLGFAIHPSLMKNVQKLALRHIRKQIPDPELRRTVTPNYTLGCKRVLISNDYYPALSRKNVDVITTGIDHIEADAVVTTDGKRHEVDCLIYGTGFQVADPYPRGAIIGRGGLDIVDAWRDGAHAYLGTTLPGYPNFFMIVGPNTGLGHNSMVFMIESQIEYILGALRAMQRERADAIEVRPLVEAQYNSALQGKLKKAIWSTGGCKSWYLDPRTGKNTTLWPGFTWRFRQATAHFSIADYHAYRAPQHAASARPAAAPAASTSTSADAA

SEQ ID NO: 20615 - protein, 362 aa, Perilla frutescens
MVTSAMGPSPRVEELARSGLDTIPKDYVRPEEELKSIIGNILAEEKSSEGPQLPTIDLEEMDSRDEEGRKKCHEELKKAATDWGVMHLINHGIPEELIDRVKAAGKEFFELPVEEKEAYANDQAAGNVQGYGSKLANNASGQLEWEDYFFHCVYPEHKTDLSIWPTKPPDYIPATSEYAKQLRALATKILSVLSIGLGLEKGRLEKEVGGAEDLIVQMKINFYPKCPQPELALGWEAHTDVSALTFILHNMVPGLQLFYEDKWVTAKCVPNSIIMHIGDTLEILSNGKYKSILHRGLVNKEKVRISWAVFCEPPKEKIVLQPLPETVSEVEPPRFPPRTFAQHLKHKLFRKTDGDLDEKPTY

SEQ ID NO: 20616 - protein, 120 aa, Streptomyces noursei
MTMSGTTAPHGAAEISEITDDTFAAEVLTAELPVLVEFTADWCPPCRQLAPVLAAIADEERGRLKVVQLDVDRNPRTMIAYGVRSAPTLIVFRDGEPVRSMVGARSKRRLLQELAPVLEA

SEQ ID NO: 20617 - protein, 368 aa, Ipomoea batatas
MAATLSTLTALAGEKSLQSSFVRDEDERPKVGYNEFSDEIPVISLKGIDDVNGRRVQIRNDIVKACEDWGIFQVVDHGVDAGLIGEMTRLSKDFFALPPEEKLRFDMSGGKKGGFIVSSHLQGEAVKDWREIVTYFSYPVRARDYSRWPDKPEGWRAVTEKYSEKLMDLACKLLEVLSEAMGLEKEALTKACVDMDQKVVVNFYPKCPQPDLTLGLKRHTDPGTITLLLQDQVGGLQATKDGGKTWITVQPVDGAFVVNLGDHGHFLSNGRFKNADHQAVVNSERSRVSIATFQNPAPEATVYPLTVREGDKPIMEEPITFAEMYRRKMSKDLELARLKKFAKEQQQIVKAAAADKNLETKPIDQILA

SEQ ID NO: 20618 - protein, 177 aa, Mycoplasma penetrans
MDHRVEKILLTTEEIQKGIIEAAKWVDKTYQNKELVLVGLLKGCLPFFGQMISHITIDCLVDFMTVSSFQGKTYGVTEPQISHNISENITNKHVLLVDEIIDSALTLKYVKEYLMNNFNPASVEIITLLDKPAGRKVDLKPAYRCFEIENKFVVGYGCDYEGKLRNLPYVGVFKQDK

SEQ ID NO: 20619 - protein, 415 aa, Bdellovibrio bacteriovorus
MHSTSLSLAQVDPEILAAINKESERQQFGLEMIASENYTSKAVMEAQGSILTNKYAEGYPGKRYYGGCVNVDTVESLAIERAKKLFGVQYANVQPHSGSQANMGVYLAACKAGETILGMDLSHGGHLTHGSPVNFSGMLFKAASYKLDPETGRLNYDTIRATAKEVQPKLIIAGYSAYPRTLDFAKFKEIADEVGAQLLVDMAHFAGLVATGHHPSPVPYADYITTTTHKTLRGPRGGMILTNSEEKAKTMNSRIFPGIQGGPLEHVIAGKAVAFGEALKPEFKDYSGKVVSNAKVLAEELLSAGFKLVTGGTDNHLILVDLSDREITGKLAENSLDEAGITVNKNTVPNEKRSPFVTSGVRIGTPALTTRGMGPAEMKQIAKWIGQVLNNAEDAGVKNRVHEEVKELCKQFPIY

SEQ ID NO: 20620 - protein, 411 aa, Oryza sativa
MNALAATSRNFRQAARLLGLDSKLEKSLLIPFREIKVECTIPKDDGTLASFIGFRVQHDNARGPMKGGIRYHPEVDPDEVNALAQLMTWKTAVAAIPYGGAKGGIGCAPGELSTSELERLTRVFTQKIHDLIGAHTDVPAPDMGTNSQTMAWILDEYSKFHGHSPAVVTGKPIDLGGSLGRDAATGRGVMYATEALLAEHGKSISGSTFVIQGFGNVGSWAARIIHEKGGKVIALGDVTGSIRNKNGLDIPALMKHRNEGGALKDFHDAEVMDSSELLVHECDVLIPCALGGVLNRENAPDVKAKFIIEAANHPTDPEADEILAKKGVTILPDIYANSGGVIVSYFEWVQNIQGFMWDEEKVNMELHKYMNNSFQHIKAMCKSHDCNLRMGAFTLGVNRVARATLLRGWEA

SEQ ID NO: 20621 - protein, 841 aa, Oryza sativa
MGIPEVVVPPRAAGPRRYKGLVPWRFQPGFVRPPPVKPPAAAAAVAGGGVAGTPGGKGRGLGASGEGVGSSGGRGDPQSRRCTRSASAKGSGDARSVEEGGPRVAGDDGGSGKSGVAAEGSGFEGLRNGRGGGVGTAAAEDCGLEKSNPDGIVGDADVHLESGSDARDGECVSEGLKKPCVNNSNGSSAADCAPKVKKGNDSGNGGADECNAAAKSSNLACPGNNGDETNRKGRKVVLPWRFQVGFKRSFSKAFCSDSESSGPSGTQFYRAQDSSTPCTPATRSSVRCYASAHSGVRVSAMRDFSVKGEKETSTPYKKSKTGMDGPSQGMPKNGVVLARENIMGSLQNFRLIYRDLLDEEEEKSTEAVIRPDLQAYRIFRERFITDCDEKKYIGNVPGIKVGDIFHLRVELCVVGLHRPHRVGVDHIKQEDGTCIAVSIVSYAQSSDIKNNLDVLVYSGAMTAIANQKIEGTNLALKKSMDTNTPVRVIHGFVTHLNGNCQRKKIPTYIYGGLYIVEKYWREKEGNDRYVYMFRLRRMAGQKHIDIQDILNSGQAESYGGIIIKDISRGLEKIPVSVVNSISDEYPMPYRYIAHLQYPRNYQPAPPAGCGCVGGCSDSKRCACAVKNGGEIPFNDKGRILEAKPLVYECGPSCKCPPTCHNRVGQHGLRFRLQVFKTKLMGWGVRTLDFIPSGSFVCEYIGEVLEDEEAQKRSTDEYLFAIGHNYYDEALWEGLSRSIPSLQKGPDKDEEAGFAVDASKMGNFAKFINHSCTPNLYAQNVLYDHDDKSVPHIMFFACEDIPPRQELSYHYNYTIDQVHDANGNIKKKKCLCGSIECDGWLY

SEQ ID NO: 20622 - protein, 568 aa, Zymomonas mobilis
MSYTVGTYLAERLVQIGLKHHFAVAGDYNLVLLDNLLLNKNMEQVYCCNELNCGFSAEGYARAKGAAAAVVTYSVGALSAFDAIGGAYAENLPVILISGAPNNNDHAAGHVLHHALGKTDYHYQLEMAKNITAAAEAIYTPEEAPAKIDHVIKTALREKKPVYLEIACNIASMPCAAPGPASALFNDEASDEASLNAAVEETLKFIANRDKVAVLVGSKLRAAGAEEAAVKFADALGGAVATMAAAKSFFPEENPHYIGTSWGEVSYPGVEKTMKEADAVIALAPVFNDYSTTGWTDIPDPKKLVLAEPRSVVVNGIRFPSVHLKDYLTRLAQKVSKKTGALDFFKSLNAGELKKAAPADPSAPLVNAEIARQVEALLTPNTTVIAETGDSWFNAQRMKLPNGARVEYEMQWGHIGWSVPAAFGYAVGAPERRNILMVGDGSFQLTAQEVAQMVRLKLPVIIFLINNYGYTIEVMIHDGPYNNIKNWDYAGLMEVFNGNGGYDSGAGKGLKAKTGGELAEAIKVALANTDGPTLIECFIGREDCTEELVKWGKRVAAANSRKPVNKLL

SEQ ID NO: 20623 - protein, 148 aa, Alkaliphilus metalliredigenes
MDLTMKICYNDIRIKKERGYFMKYKMLHTCIRVMDLEKSLRFYEDALGLVEKRRKDFPEHEFTLVFLSDEAGHYDLELTYNYNQDQSYEIGNGFSHIAVSVDDLEASQERHRKMGYKVTKLTGLPGSPPRYYFVTDPDGYDVEVIRAD

SEQ ID NO: 20624 - protein, 198 aa, Clostridium thermocellum
MANNCFEKSNLKLAAFAGGCFWCMVPPFKELEGVCEVIAGYTGGHVENPTYEQVCSGKTGHYEAVQITYDPETIQYEKLLDVFWSQIDPTDPEGQFADKGPQYQTAIFYYDEEQKVLAEESKKRLESEGYFDKPIVTKIIKASAFYPAEEYHQDYYLKNPEHYKRYKTGSGREAYIQKVCGIRAMNKNNSKTNDMQSK

SEQ ID NO: 20625 - protein, 178 aa, Glycine max
MASSMISSPAVTTVNRAGAGMVAPFTGLKSMAGFPTRKTNNDTISIASNGGRVQCMQVWPPVGKKKFETLSYLPDLDDAQLAKEVEYLLRKGWIPCLEFELEHGFVYREHNRSPGYYDGRYWTMWKLPMFGCTDASQVLKELQEAKTAYPNGFIRIIGFDNVRQVQCISFIAYKPPGF

SEQ ID NO: 20626 - protein, 444 aa, Vibrio vulnificus
MSVYYTLCFLSAAAMLIAFVNSKIGKMQTTIAITAGSMVLSLLILIAGQNNWFHLTEIATQTMSSIDFEDFLLKGILGFLLFAGGLGIKLPNLKDQKWEITVLALGATLFSTFFIGFALYGICQLIGIQFDLIYCLLFGALISPTDPIAVLAIVKKLKAPRRISTQIEGESLFNDGFGLVIFVTLFTIAFGHETPTVGSVTMLFIQEAIGGILYGFALGLLFHYLICATDDHSMELLLTIGIPTAGYAFAEVLHVSGPLAMVVSGIMIGNWTRFIGFSKESEDHLDHFWELVDEFLNGVLFLLIGMSMLLFKFHQEDWILMAIAIPLVLIARYLSVFLSYIGFKRFRQYNPWSIKILTWGGLRGGLALAMALSIPSGIWVIPDKLIDVKEIILVMTYAVVVFSILVQGSTITPMIEKAKQSEAEFEAKQSSVTAPEGKTESISS

SEQ ID NO: 20627 - protein, 216 aa, Brassica napus
  misc_feature (135)..(136): Xaa can be any naturally occurring amino acid
MGRRPARCYRQIKGKPYPKSRYCRGVPDPKIRIYDVGMKKKGVDEFPFCVHLVSWEKENVSSEALEAARIACNKYMVKSAGKDAFHLRIRVHPFHVLRINKMLSCAGADRLQTGMRGAFGKALGTCARVAIGQVXXSVRCKDGHGHHAQEALRRAKFKFPGRQKIIVSRKWGFTKFNRADFTKLRQEKRVVPDGVNAKFFSCHGPWANRQPGTAFL

SEQ ID NO: 20628 - protein, 178 aa, Glycine max
  misc_feature (178)..(178): Xaa can be any naturally occurring amino acid
MASSMISSPAVTTVNRAGAGMVAPFTGLKSMAGFPTRKTNNDITSIASNGGRVQCMQVWPPVGKKKFETLSYLPDLDDAQLAKEVEYLLRKGWIPCLEFELEHGFVYREHNRSPGYYDGRYWTMWKLPMFGCTDASQVLKELQEAKTAYPNGFIRIIGFDNVRQVQCISFIAYKPPGX

SEQ ID NO: 20629 - protein, 1027 aa, Unknown
  Magnetococcus sp. MC-1
MKSLLSINHIFGLFTLAGMLLLSLFFGGLMLSGFNEVFDHHVERTMDARLTGFAQQLTDYVSLHDAMLHDLASNPLLVQGVMQQESGKANAVDFLERYRIMGAQRRLTLYGFDGHLLHDTAKQPRRPPLSENLVQILLRGHNKHIWRFQAQDKDQSSLWMAVPISWNAVPEGVLAMEIPSLEMPQLKRHYGQGEEDDIELFKDGERIFGVDGHLNGRQAQLYMPTLGITLRYTAHLGEIYSHRDRLLARIKMIGLAALLLAGSGVFWMGRVLFVRPLQRLKERTTHLANGEVRDLLNEVRRRVMVRELQELTDQFDVMALQVSSARTSLEEKVHERTAQLEWELEERHKTEHRLRQVLTLQTAILDSANSSIISTDRTGIVQTFNKGAERMLGYKAVAVVGQYTLDMFYNSNELRQHSLQLSATLDKRVDPGIESLFVLAREGKVDEREWMILHQDGHQVPVLMTVTPIYNSSGLLVGYLNMGTEISERKRLAAELKETNWRLQRALDSAQAGTFYYAVVHDHMQWNRRALEMFGLNDATFNGHLQDWLQRVVAVDRHRIDTLFAEVLATPNVETLDISYTILRQGDEAQRVIRTQGWIHRDPHGKATHLSGLFLDITEQMQAQQVLEEARQAAEEASQAKSDFLASMSHEIRTPMNAVIGLSDVLAETPLNPEQQHYVTTLQRASHTLLDLINAILDLSKIESGRFELIERPFDLSDMAHGVCSVLRVQAEQKGLSLALEMDETLPPFVVGDSPRLRQILINLIGNAIKFTEQGFVKVSVQARDQQRTLWFGIADSGVGIAPTQVEQIFEKFTQVDSSVVRRFAGSGLGLAISKQLVGLMGGHIGVESRLGEGSLFYFSLPLRPGETLFEAPLRAPIYQESPAESVPIRLLVVEDSVDNRMLVRTYFKKYHCELRFAVDGQEGVEMFQEGGCDLVFMDVQMPRMDGYTATRLIRNWERSHGMQPTPILALTAHALESDVKKSRQAGCNEHLTKPVSKRTLVDAVERQLNIKLMLRSLPAVSLPQTV

SEQ ID NO: 20630 - protein, 582 aa, Candida albicans
MTTNESIDITELRTHLYHSACKLNNLSLYQASKWCAEALNGLKDKQQPVTYPPLALDSDDLLDQDILILAKSYFDCKEFDRAAHVLKDCKGGDAKFLRLYSMLISVDKRSTEETDGSLNIGMINETNEDTGTTSKESALNSLNSQLSKIILESENYLKQKQNAFLLYLNGIIYNKKKKYQLARQSLHDSLQIFPYNWSCWQELIASFSSFEEAHNYINKCKNTNNPLANNVMFQFFEVVILQEFYHQSNTLFDNLSNLAALFPGFVFLKIQQFLISYHNLDYFQAEATFDQILVEDPLRLDDLDTFSNMLYVMEKRSKLSYLAQYASQIDKFRPETCCILANYYSMKCEHEKAIMYYKRALTLNKNCLSAWTLMGHEFVELKNSHAAIESYRRAVDTNPKDFRAWYGLGQAYEVLDMHLYALYYYQRATNLQPLDKRMWQAIGNCYEKIDQLEEAFKSFAKALSIGKVMHGDSAFDNKDFDECDFSVEPHICYRLATISEKLGNHKDTYKYMRLCFAQEFEWGVGDETSKARLWLARDALNNWKFEEAYELAKDLNYSNAHDIEEARAIARDARNRMKNQMH

SEQ ID NO: 20631 - protein, 310 aa, Bradyrhizobium japonicum
MRIVNVAAAQMGPIQKADSREAVVKRMIALMDEAKAKGADLIVYPELALTTFFPRWYVEDRAEFDNWFEREMPSAATKPLFERAAQHQMAMNFGYAELTPDGHHFNTAILTDKSGRIVGKYRKIHLPGHVEYDTKRSHQHLEKRYFEPGDLGFKVWRELGGIIGMAICNDRRWPETYRVMGLQGVEMVLIGYNTPSVNAEKSEEGVEKRLFHNRLSVQAGAYQNATWVVAVAKAGNEDGHPLFGGSLIVDPNGEIVAEAKTDDDEVLVHACDLDATTFGKTTIFDFARHRRIEHYGLITSQTGAVPPPEK

SEQ ID NO: 20632 - protein, 364 aa, Hyphomonas neptunium
MTSPQDYRQTPPEPDHRGGGLSRRSLLGMAAIGTTIAAVGIGGTRLWTGSSEIPDWTYKDIPPQNGRRVLVTGANGYPEEDRSGLGYHIALGLARAGADVIIASRNQTRGEEAIRRIGAESPAGRVRFETLDLADLKSVKDFTARMQASGNGLDLLVNNAGTMGTLERQESIDGFERVFATNAIGPFALTAGLLPLLRNGNAPRIVWMCSGRSAFGALDLDDLQQENAYEYASAYNDSKQAHLIAALECERRSRAHGWGVVSIAAHPGVARTSLILDGPGLDSAEGWRRRNMPFMFQDAAQGALPALYAAVSSQAAGGAYYGPKGLMGIRGLPGVSQVPDNSRDPQLATTVWETLEQLGTVSLR

SEQ ID NO: 20633 - protein, 574 aa, Desulfovibrio desulfuricans
MTTETIDTSLDAEMSFESALENYLSSDFGDLEEGSIVKGEVVRVDGDYVLVDVNFKSEGQIAASEFKDAEGNLAIKVGDTVDVFVARKNEMEGTITLSFEKAKRMQVFDKLEEVQESEGTTCGRIIRRIKGGYTVDLGGVEAFLPGSHVDLRPVPDMDALVNQEFDFRVLKINRRRSNVIVSRRVLLEEERDSKRQDLLKTLEEGQIVTGKAKNITEYGVFVDLGGLDGLLHITDMSWKRIRHPKELVSLGQELELKILSFDRDSQKVSLGMKQLVNDPWADITSKYPENARLNGKVTNLVDYGAFVELEPGVEGLVHISEMSWTRKLRHPSQMVRVGDEVEVVILGVDPDKKRISLGMKQVKPNPWEVVAEKYPEGTILEGVIKNITEFGMFIGIEDGIDGLIHVSDISWTKKIRHPNELYNVGDTVQAKVLTVDQESEKFTLGVKQLTEDPWSKVPANYPVGTLVNGVVTNITDFGLFVEVEEGIEGLVHVSEISQKKVKSPSEMFKEGVTIQAKVIHVSAEERRLGLSIKQIKDDEERRRPKEFRSGPAEAGGQTLGDILKLKLEEDAADN

SEQ ID NO: 20634 - protein, 340 aa, Paraboea crassifolia
MGRAPCCDKTGLLMKKGPWSQEEDQKLLDYIQKYGYGNWRTLPTNAGLQRCGKSCRLRWTNYLRPDIKRGRFSFEEEETIIRLHSILGNKWSLIAARLPGRTDNEIKNYWNTNIRKRLLRMGIDPVTHSPRLQLLDLSTILNSSLCNNSPTQMNFSRLQPRFNPELLRFAASLFSSNCQSQDFPMQNQITSNNQIPPPFMQTSVQDVAVLPDLCADTNLGTSFSVHDEVQEFQQNPAGYGMPSALTGEYVPVLNDGYYGSGDQPFVDPTPSSVTSNFQSYCSNSLGFQSIFSTPPSSPTPLNSNSTYVNSCSSTEDETESYYNSMWKFEIPDNLRINDFM

SEQ ID NO: 20635 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQINLLHRSERGNELQ

SEQ ID NO: 20636 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQHFCHPRSVNGIELQ

SEQ ID NO: 20637 - protein, 754 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQSYTTPFLDLRLVLNCSK

SEQ ID NO: 20638 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQCFCNFRSVGINTLQ

SEQ ID NO: 20639 - protein, 1683 aa, Colwellia psychrerythraea
MIKLNKSSFIVFFFLQSFFLQNGMAENLPTDLVTWAHANPVVHIGVDGTFPPFDYIDEQGVTAGAGKLIRQQLSAILPVDLQETSVSDFRLEYDDMLRGNIDAISVCGNIEQRRDEVLFTKPFLQMTPIVVVNKNSDIKSEMDITSELKIASIAGYADANFAKQLSVNSKGLSSNLQGYQSIESGKYDVFITYLYLYKYMLKKHDFKNIKPIAISQFESLPIGFCVNKNKPQLVGLLNWGIDQLGDDFILAMQSKWAESSLDEGQNSRAHIDKSISLTSVFIYAVIFVLLALFFARKFASTIAIKLDTLAFRTTYFTVLILIISLSTGGIYLFLNDFKDQLLIDQKETFNVTRDVTKKTLAGWYRERELLAHNIAKSKSFKRLVNQLVIASEIDDTIKLAQAKKALRVYFSKRPYTTQGGRAYTITDVQGRYLLNLVQSAEGKKSPIISQRPELFNEVLMGRTEFIPPVWANVNIDGNRNAEDKDAEVFIATPVRNEQQEIIAVLGFRFDPDREFSQLFIDGRLGKSFESFAVDSRGYMISSSRFTSELQQKGIVPAGESTVLNVRLQNPETNPIVQAAKFKLNGQNLHGYTNYRGKTVVGQWISLKNSNITVVSEIELSEMLAEYYDVRNLLLIGLIISSAFILSISIFMITISNRANDISRRSQQELAEQVTIRTKELAASEQKSKLINSSVADGILGVDKLGHFIFANESATKITGYSEEQILSSDLISLFAGDNKENLTFEDTEVYKAIQSKEVIRISNEYVLMSGARELPLEYSISPVEDDESELACVIALQDITLRVQETERLEKMLEHLPVCMVIMNQNDEVEQINQTGIELLGFERDEIVGNPVDLFIPQEQVESHKALLKKFFQEETVIDTRSLERDFKVKHKSGKLIEIQAVYTPVHFHNGLYAAVMVRDITLDRQAEFALLEAKRISDDASKAKSDFLANMSHEIRTPMNAIMGMSHLALGCELDRKPKNYVTKVYKAAESLLGIINDILDFSKIEAGKLDIEVIEFSLHDTFADLANIIGLKAGEKNLELLFDISPDVPVNLKGDPLRLNQILINLAGNAVKFTEQGQVVISVNVVTNVSTSHCDDINLEFSVKDSGIGMDDEQQKKLFQSFSQADSSTTRKYGGTGLGLTISKKLVELMNGQIWLESKAGEGSCFSFTTTLQVSDVIDNRLVEQQKSFLADKRILIVDDNLLALDVLSSILKSFHCHVVAANSGEEAIELVKQATLTFDFIMLDWNMPDLDGIETYHIIKSQNNYQDNQFILVTSNANDNEAVDQLKKRINSVLVKPVTSSSIFDEMMRLNGDEAYSNTREMKRDDELIQNQQHLSGAKILLVEDNELNQELALELLKQSNIDVELAENGAIAVEKFSSRHFDGILMDLQMPVMDGFTATKIIRESDSSIPIIAMTANAMVSDKEKVLASGMNDHITKPINVNTMFATIAKWVSPSIKLDHDIDKAKLSVYTLPEKVISIPDFNTINTSAGLAVANGNKSLYVKLLGRFVSGQDDFVERFKVAMLKQDKEEVTRFAHTLKGSAGNIGANALQGYADQLELVCANDANTDELVNLLDQVTEELTLVLNELTEYLAKENSVESTAPINDFNFNEEFTVQLAQLLELIENFETESIELAEDILNQLKGTKQEALFEKIYQQIESYEFTEAETALNEFIDVLNN

SEQ ID NO: 20640 - protein, 88 aa, Zea mays
VDKSLCEHFAYTRQELYALVRVEGILTFDELLAKHGRGHTGCDVCKPAVGSILASCWNQPIMDASLVPLQDTNDTFMANMQKNGTYSV

SEQ ID NO: 20641 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQDDCLGRSIIEIMLQ

SEQ ID NO: 20642 - protein, 180 aa, Rhizobium etli
EFDVFPTLEQLPLWGFDGSSTMQAEGRSSDCVLKPVAIYPDPARTNGALVMCEVMMPDGVTPHPSNARATILDDEDAWFGFEQEYFFYQNGRPLGFPEQGYPAPQGPYYTGVGYSNVGDVAREIVEEHLDLCLAAGINHEGINAEVAKGQWEFQIFGKGSKKAADQIWMARYLLQRLTEK

SEQ ID NO: 20643 - protein, 449 aa, Streptococcus agalactiae
MTSGKTYVASVLEKVKKQNEHEEEFLQAVEEVFESLVPVFDKYPQYIEENLLERLVEPERVISFRVPWVDDKGQVQVNRGYRVQFSSAIGPYKGGLRFHPTVTQSIVKFLGFEQIFKNSLTGLPIGGGKGGSNFDPKGKSDNEVMRFTQSFMTELQKYIGPDLDVPAGDIGVGGREIGYLYGQYKRLNGYQNGVLTGKGLTYGGSLVRTEATGYGAVYFAKEMLAARGQDLTGKVALVSGSGNVAIYATEKLQELGATVVAVSDSSGYVYDPDGIDLETLKQIKEVERARIVKYTEKHPKANFTPADQGSIWSIKADLAFPCATQNELDEEDAKLLVENGVLAVTEGANMPSTLGAIKVFQKAGVAFGPAKAANAGGVAVSALEMAQNSSRRAWTFEEVDQELQRIMKTIFVNASEATDEFGDSGNLVLGANIAGFLKVAQAMSAQGIV

SEQ ID NO: 20644 - protein, 180 aa, Rhizobium etli
EFDVFPTLEQLPLWGFDGSSTMQAEGRSSDCVLKPVAIYPDPARTNGALVMCEVMMPDGVTPHPSNARATILDDEDAWFGFEQEYFFYQNGRPLGFPEQGYPAPQGPYYTGVGYSNVGDVAREIVEEHLDLCLAAGINHEGINAEVAKGQWEFQIFGKGSKKAADQIWMARYLLQRLNEK

SEQ ID NO: 20645 - protein, 1519 aa, Unknown
  Azoarcus sp. EbN1
MPFRILRSPRSVRCVPRAGSGRQTGSDSFDSALMTAIADIPAEQTASASTVGPVALSSRIVVLAAMYIAVGLFARALTQSSGYSSPVWPAAGFALAALLVWGARCWPGVWLGAFVIVLLPDRTTSGALVAALGASGMTLQALLGVCLARRCLRSSSFPARNRDIARLVLLTGPLASLVASSIAVAALLAFERIAPAAGPSEWLTWWAGDTLGVLLFAPLVLLAWPGPLRGWIRRSGGGRISILLVLAAALFSAGSFTVDRLWKERERTEIAQRMDEVFEIGFLLLPEVIASLEGVERFVSASSAVTRDEFETFTVWITRHPAVVSIDWAPRVLAEERESFERAVRAEGGRDFRIFEPGDDGNTRPATGRPEYFPVLYSAPREAGRSILGLDHGYDPHRRVAMEQARQSREAHTVRGVPLLRTKRLSLLVFQPVHDVARASWDAAARAGPRDLLGHVVGVFDVEKLFIPLAEAAHTRSIGFRVSDVTSGEPAQILLDEMPAGVAPTLRKEIGFGGRTWSLELAAKAPTGYVDTHGEEEIYLAFSVLAAVLVAYIALSNAGHTAAIQREVAEQTAELTRALDARLAAEDERDRIFEQSVDLLGIVGIDGYFKRVNPAFARTLGWSNEEFLSRPYLDFVHPDDVEGTRADAARVAAGHTTVGFENRYRCKDGNWRWLEWKAVPRTGGLMFVTAIDTTQRRENARHLRTLNAELVHRVDEREAALEALGAKKDEIRAVLDNLIECVVTINAQGIVQGANAAVEAVFGYPLGEVIGRNVSLLMPSPERERHDDYLARYLDTGARHVIGSTREVEGQHKLGHRIPMELSVAEYRVRDEQFFVGTLRDISERKAFIAALTRAREDAEQASRAKSAFLAAMSHEIRTPMNGVMGLIEVLARTSLSEHQADLVATICGSSSTLLRIIDDILDFSKIEAGRLKLDVRPVSIGDLVESLAGSLLPLAARLDVDLSVFVSPEVPERVEADEVRLRQVLYNLVGNAVKFSAGRQNVRGRVAVRVAVADVVPLQLAVSIVDNGIGIDPEKVEELFNPFTQAEASTTRRFGGTGLGLAICRRLVDLMEGGIKVRSEPGQGSTFTVTIPFVLSDEQPAPILPEVRGINCVVIDSPEINSEDLRVYLEDAGASVFRVDDEAAAGVKAASLAAPVVLIDFAREGKNTETDGTVPASGAARVRITRGRRRRPRIKDRQVVMLNGNALRRQSLLRAVAVAAGRASPEIIHAGTAERAVLPSTTAPTIDEAREHGRLILVAEDDPINKKVILEQLALLGHAAEIAGDGAEALEMWRRGTYALILTDLHMPKMDGYRLTEAIRQAEGEAARIPIVALTANALQSESRRAREAGMDEYLTKPVRLEVLGAHLDRWLPRQETALAETAQVPPDAAPDAVACTLPILDVSVLNGLIGDDPQVIREFLGDYLASTRSLAAETRTAFSDGDRGAVAASSHKLKSSSRAVGALALGDLCNRIESAVITGDRVAFEQEMSRYDDVVRTTETHVIKLLNEPISAAGGTQ

SEQ ID NO: 20646 - protein, 134 aa, Listeria innocua
MHIALIAHDEKKDLMVGFATAYKHLLEPHQLYATGTTGLRIIEATGLTVHRFKSGPLGGDQQIGARISENKMDLVIFLRDPLTAQPHEPDVSALIRLCDVYEIPLATNIGTAEILIRGLGAGFLDWRDLRRNDE

SEQ ID NO: 20647 - protein, 321 aa, Prochlorococcus marinus
MEPKKAIVSETEAPKTEAPKVVKKKHADVPVNIYRPKTPYEGTVIENYSLLKEGAIGRVNHITFDLKDSDPFLNYVEGQSIGIMPAGEDANGKPHKLRLYSIASTRHGDDFNGNTVSLCVRQLQYEKDGETINGVCSTYLCDIKPGDKVKITGPVGKEMLLPEEEDANIVMLATGTGIAPMRAYLRRMFEPTEKEKNKWNFKGKAWLFMGAPKSANLLYEEDLQRYLSDYPDNFKYTKAISREQQNTKGGRMYIQDRVLESANELFNMIEDEKTHIYLCGLKGMEPGIDEAMTKAAEEKGLNWSELRPQLKKAGRWHVETY

SEQ ID NO: 20648 - protein, 425 aa, Alkalilimnicola ehrlichei
MEHVIVGAGPAGVVAAERLRKLDPQADIRLLTGEPEPPYSRMAIPYYLVDQIPESGTWLRKQQDHFERQRIEVRQAMVTGLDPDQRRLSLADGQSLGFDRLLLATGSSPVIPPLPGMEREGVHTCWTLADARAILQRARQDARVVLIGAGFIGSIILEALVKRGTQLTVVEQGDRMVPRMMDAEAGDLIRRWCEQRGVSVRTSTTVTGVDDGPGDHPLAVVLDGGEQLPADLVIVSAGVRSNTAFLEGSGLEIDQGIRVDHRLCTNRAGIYAAGDVAQGPDFSTGGWSVHAVQPTSVDHGQVAASNMAGRDRRYHGSLLMNVLDTLGLISTSFGQWEGVDGGDSVALLDRERYRYLRLQFQDDLLVGANSLGLTEHVGVLRGLIEGQVRLGPWKKRLQTDPTRLMEAYLGSTQAIGRPNPRRAPA

SEQ ID NO: 20649 - protein, 561 aa, Burkholderia thailandensis
MKTRIALAQLNVTVGDFAGNVAKIVAAAQAAHDAGAHFLIAPELALSGYPPEDLLLRPAFYAASDAALAELAAQLKPFAGLAVLVGHPLRAPSADGNANRAIERGVPPVDTYNAASLIVGGEVAGTYRKQDLPNTEVFDEKRYFATDAAPYVFELNGVKFGVVICEDVWHASAAQLAKAAGAQVLIVPNGSPYHMNKDAVRIDILRARIRETGLPMVYVNLVGGQDELVFDGGSFVLDGAGELVAKMPQFEEGNAIVEFDGARALPAAIAPALSVEAQVYRALVLGVRDYIGKNGFPGAIIGLSGGVDSALVLAVAVDALGAERVRAVMMPSRYTAGISTTDAADMARRVGVRYDEIAIAPMFDAFRASLAAEFAGLAEDATEENIQARIRGTLLMALSNKFGSIVLTTGNKSEMAVGYCTLYGDMAGGFAVIKDIAKTLVYRLCRYRNAAAEYGQPDIVPERILTRAPSAELRENQTDQDSLPPYDVLDAIMRMYMEEDRPLAEIVAAGYSEADVKRVTRLIKINEYKRRQAPVGIRVTHRAFGRDWRYPITSRFVESID

SEQ ID NO: 20650 - protein, 559 aa, Oryza sativa
MAEDAAAAAMAAASLSDDLEPATDRTRIRSILADGAARAGERVVVGGWVKTGREQGKGTFAFLELNDGSCASNLQVLVDAAVHPLAPLTATGTSVLVEGELKKPPEGAKQRVELRVDRVIEVGEVDPAAYPLPKTKLTLENLRDVVHLRSRTNTIGAVARIRHQLACATHRFFDENGFLYVHTPIITTSDCEGAGEMFQVTTLFSHAEKVEKELKENPAPSESDIDAARVVVKEKGDAVAQLKAAKASKQEITAAVAELNKAKENVSRLEERSKLKPGIPYRDDGTVAYENDFFKRQAFLTVSGQLQVETYACALSSVYTFGPTFRAENSHTSRHLAEFWMVEPEIAFANLQDDMNCAERYVQYLCKWLLEHCREDMEFMVKNYDKTAIERLELVSSTPFQRISYTKAVELLKNVTDKKFENKVEWGIDLASEHERYLTEVIFKKPVIVYNYPKEIKAFYMRLNDDQKTVAAMDVLVPKVGELVGGSQREERLDLLKTRIQDAGLPLEPYEWYLDLRRFGSVKHSGFGLGFERMILFATGLENIRDVIPFPRYPGRADL

SEQ ID NO: 20651 - protein, 232 aa, Schizosaccharomyces pombe
MARRPARCYRYCKNKPYPKSRYNRAVPDSKIRIFDLGRKRAGVDEFPLCIHLVSNEYEQITSEALEAARFCANKYLVKIGGKDSFHLRVRAHPFHVVRINKMLSCAGADRLQTGMRHAFGKPNGLVARVNIGQILMSVRTKDSSRATAIEALRRCQYKFPGQQRIIVSKKWGFSQYARDEYIEKRSRGEIIPDGCYAKFLNKRGSLQEKLDLFPEASFNLLRLTCNNEQCVN

SEQ ID NO: 20652 - protein, 394 aa, Unknown
  Rhodococcus sp. RHA1
MSQREWIEKDFYKELGVSSHASADEIKKAYRKLARDLHPDANPGDTKAEERFKSVSEAHAVLSDPAKRKEYDEARRLFASGGFGQGGGGFNPGAGGFGQGGFDINDLFGGGGAAAGDGGFGDIFGGLFNRGAGGGGATRTTNRPRRGSDVETETTLEFREATLGVTVPLRLTSPSPCTTCHGSGAKPGTSPRVCPRCNGTGIVSRNQGAFGFSEPCDDCRGTGSIIDSPCEVCHGNGVTNRTRTITVRVPAGVSDGQKIRLAGQGEAGLRGAPSGDLFVTVRVRPDKVFGRNGDDLTLVVPVSYGELVLGTTVSVPTLEGRVGVKIPAGTADGRVLRVRGRGVPKRAGGAGDLLVTVKVAVPQKLDDPATEALKTYLEAEKASGFDPRAGWAGA

SEQ ID NO: 20653 - protein, 312 aa, Shewanella oneidensis
MMFFEGAEKKLEISLTPKAVSLRQRGLAFWTTLVACANAEILSKISNKDCDAYLLSESSLFVWDNKILILTCGNSTLIEAACYFINSLGSEHIAALCYQRKNEYQAQLQSTTFAEDIAQLRTLISGQAFRVGHLDAHHHYVFCAAGVPITQVGTRLELMMYHIRGELAEYLNDPVQTEQGIVHRLKLTQLFPEFQLDMHCFKPTGFSLNAIQGSHYFTLHITPSAGQGEHSYVSFETNLNLAAYPYPVVAQLISLFAPSSWDLVSVNQLISTAGLSEHLCVGHCSITTEQGNYIDFNHYQQRQTEELFPKFM

SEQ ID NO: 20654 - protein, 411 aa, Brassica napus
MNALAATNRNFRHASRILGLDSKIEKSLMIPFREIKVECTIPKDDGTLVSYVGFRVQHDNARGPMKGGIRYHPEVDPDEVNALAQLMTWKTAVADIPYGGAKGGIGCNPRDLSLSELERLTHVFTQKIHDLIGIHTDVPAPDMGTNAQTMAWILDEYSKFHGHSPAVVTGKPIDLGGSLGREAATGRGVVYATEALLAEYGKSIKGLTFVVQGFGNVGTWAAKLIHEKGGKVVAVSDITGAVRNPEGLDIDALLSHKEATGSLVDFSGGDAMDSNELLIHECDVLIPCALGGVLNKENAGDVKAKFIIEAANHPTDPDADEILSKKGVIILPDIYANAGGVTVSYFEWVQNIQGFMWEEEKVNLELQKYMTRAFHNIKSMCHTHSCNLRMGAFTLGVNRVARATQLRGWEA

SEQ ID NO: 20655 - protein, 555 aa, Burkholderia vietnamiensis
MFCYQCEQTDRTGARPGCATAKGNCGKDETTADLQDLLIHAVKGIAQYGALARTMGVRDREADRFVLYAMFTTLTNVNFHAARFVALLREAAQTRDRVKAACDAQARATGAALPALQGPAAWQPADDLPGLLKQAAAVGIDAGLDTVGADIVGLRALVLYGLKGVCAYAHHARVLGYERDDIYEGIEAALAFLATDPTDVNALLEQALDLGRLNLTVMELLDSANTGRFGAQQPSAVRVSPVAGKAILVSGHDLGDLHALLEQTAGTGINVYTHGEMLPAHAYPALNAFPHLVGNYGGAWQDQQSDFAHFPGPILMTSNCIIEPLPQYRQRIFTTGPVGWPGVRHLEHHDFSTLIRAAQALPGFPATAPEETITVGFGRHAVLGVADKVIDAVKAGQIRHFFLIGGCDGAAPGRNYYTEFAEQAPDDTVVMTLGCNKYRFNRHAFGDIGGIPRLLDVGQCNDSYSAIRIATALADAFECGVNDLPLSLVISWFEQKAAAVLLTLLALGIRNIRLGPTLPAFITPGVLNVLVDQFGIQPIGDASADLAAALSRQAA

SEQ ID NO: 20656 - protein, 119 aa, Brassica napus
MAEHLASIYGTEKDRVNCPFYNKMGACRHGDRCSRIHNRPAISPTLLLANMYQRPDMITPGVDAQGQPLDPRKIQEHFEDFFEDLFEELGKFGEIESLNICDNLADHMIGNVYVQFKEE

SEQ ID NO: 20657 - protein, 536 aa, Hyphomonas neptunium
MFYICSMSGVHVIWFKRDLRVHDHAALAAAVASGAPILPLYIFEPGYWALPEHSRRQFDFVRDSLEELDAALKARGTKLVIRMGSAIDVFSALHQKHGIAAIHAHEETGLQWTFDRDRAVRRWARNAGISLREQPQNGVQRALQSRDGWANQWEAFMRRPRLVAPEALKPSAADSEEWPLPQDFGLGADDCPQRQKGGRMAAVDCLRSFLESRGRTYQKSMSSPLTAADACSRLSPHLAFGTVSIREAWQAAQKAQHEHGRSGDTGFAASIGSFISRLQWHCHFIQKLEDQTSIESRNLHPGYDGLRPEPLAGDPRLAAWIEGRTGFPFLDACMRSLRETGWLNFRMRAMVMGFASHHLWLDWKQPAEHLAALFTDFEPGIHYPQAQMQSATTGMNTPRIYNPVKQSQDQDPDGAFIRRWVPELSGLPAEWLHAPWEAPASVRARAGIVLGQTYPMRIVDHMAAAEEARSRIFAVRKRAGHGAQADALQARHGSKRSGIPFRGQQAARRQAVPRAPEPAQLSFDLHLTPPSQAHAS

SEQ ID NO: 20658 - protein, 258 aa, Ostreococcus tauri
MENPPRPSSRPSAGDVPHGCLARTAPRRRSRGRAGVGDAGAEARRATLSTQTDETRDAAREQIGVDYEPFRALLEAGEWEKADDEHRRLMCVLAGEEAEDREWVYFTEVDNMPVTDLRTIDALWKYYSNGRFGFSVQRKIWIGQKRQWAKFFKKIDWTTGENGDYRKFPQEFQWRADAAQGHMPLTNALRGTQLLAALLEHPAFGPGLPERTSEGSFYEGTASRETPVRFEMPTVGGVLDVAVRFGKFGVLFAQELMK

SEQ ID NO: 20659 - protein, 282 aa, Zymomonas mobilis
MTEITVAALQLALTDDIQTNIDRVSVLVEEAAAQGAKIILPPELFEGHYFCATEDESCFARAKPVEKHPVVLAMQKLAKRLKVTIPTSFFESDPPHYYNSLAMINSDGEVMGVYRKSHIPDGPGYEEKFYFRPGNSGFKVWDCGGIKIGVGICWDQWYPETARAMMLMGAELLFFPTAIGNEPHDPDLDTSRLWRRAMIGHAVSNVVPVIASNRIGQEATLSFYGHSFIADQRGDLVQAFGKDESGVLVAHFDIEQIRQHRAAFGFFRDRRPELYHRISEDR

SEQ ID NO: 20660 - protein, 222 aa, Unknown
  Nostoc sp. PCC 7120
MALFGFGKKLALPTPEKALPGRAQIMPVPANHYVNKNPLKPPFPDGFEKALFGLGCFWGAERKFWQQQGVYSTAVGYAAGFTPNPTYDEVCTGLTGHNEVVLVVFDPKVISYTQLLKVFWESHNPTQGMRQGNDVGTQYRSGIYVYSEAQKQLAEASRDAYQQALSSAGYEKITTEILDAPEFYYAEAYHQQYLAKNPNGYCGLGGTNVACPVGVFESSANG

SEQ ID NO: 20661 - protein, 192 aa, Xenorhabdus nematophila
QMIWHSLQSVVDKDVITRLEKFVDSDFIQLDYTDAIKILENCGQKFENPYFWGVDLSSEHERYLAEKHFEAPVIMKNYPKNIKAFYMRMNEDGKTVAAMDVLAPGIGEIIGGSQREERLDMLDKRLEEMGLNKEDYWWYRDLRRYGTVPHAGFGLGFERLVAYVTGVANVRDVIPFPRTPRNATFLMNQLNK

SEQ ID NO: 20662 - protein, 112 aa, Geobacter metallireducens
MKKVEAIIKPFKLDEVKEALNEIGIQGITVAEVKGFGRQKGHTELYRGAEYVVDFIPKIKMEIIVGDDIVGKVVETIEQAAKTGRIGDGKIFVTPVEEVIRIRTGERGEDAL

SEQ ID NO: 20663 - protein, 553 aa, Vibrio parahaemolyticus
MFCIQCEQTIQTPAVKGCSFAQGMCGKTSEVSDLQDVLVYTLQGVSFWASKALEFNIINDEINQWAPKAFFSTLTNVNFDPERILELTSQAANYKALLKEQVMSAATLSNTNLADIPAVANFELPNSAEAILAFAPQVAVNRGKDQVHEDVIGLRLLCLYGLKGAAAYMEHARVLEQTNNDIYAEYHEIMAWLGTDPEDLGELLDCSMRIGLMNYKVMEMLDQGETTTFGHPEPTTVNVKPVKGKCILVSGHDLHDLEKILQQTEGKGINVYTNGEMLPAHGYPELKKYPHLVGNYGSAWQNQQKEFANFPGAIVMTSNCLLNPNVGQYADRLFTRSIVGWPGVAHIEGDDFSQVIECALAQDGFQHDEIEHHITVGFSRNALMNAAPAVIDQVKQGNIKHFFLVGGCDGDKAERSYYTDFTAEAPEDTLILTLACGKFRFNKNTFGDINGIPRLLDVGQCNDAYSAIQLALALAKEFDCDINELPLTLVLSWFEQKAIVILLTLFALGVKGIYTGPTAPAFLTPNLIAIIQEKFDMRSIGNVQDDLKAILAA

SEQ ID NO: 20664 - protein, 368 aa, Medicago sativa
MPSFFAPTRRFSLASPLLLLGLFTINLIPTADAQIGVCYGMMGNNLPPANEVIDLYKANNIKRMRLYDPNQAALNALRNSGIELILGVPNSDLQSLATNSDNARQWVQRNVLNFWPSVKIKYIAVGNEVSPVGGSSWLGQYVLPATQNIYQAIRAKNLHDQILVSTAIDMTLIGNSFPPSKGSFRNDVRAYLDPFIGYLVYAGAPLLVNVYPYFSHVGNPRDISLPYALFTSPGVMVQDGPNGYQNLFDAMLDSVHAALDNTGIGWVNVVVSESGWPSDGGATSYDNARIYLDNLIRYEGKGTPRRPWATETYIFAMFDENQKSPELEKHFGVFYPNKQKKYPFGFGGERMGIVNGDFNATISLKSDM

SEQ ID NO: 20665 - protein, 276 aa, Unknown
  Shewanella sp. ANA-3
MEILSLPGQRAKGKVWLVGAGPGDVELLTLKAWRILKSADAVLYDALVSQDILDLIPKDAEKIAVGKRAGKHSAAQDEINQLLVTKAYTRKNVVRLKGGDPFIFGRGGEELQTLVEAGVEFEVVPGITAASGTSAYAGIPLTHRDYAQGVTFITGHCQLESRPMDWQGYANSNNTLVVYMGILNAGIIRQGLIDAGRSPNTPVAIVSKATTQSQQRFIGQLDSLEQLAADPQLQMPALMIIGEVVALADSLNWFQPKGEGESSLDTTDAAKIVAKI

SEQ ID NO: 20666 - protein, 378 aa, Alkaliphilus metalliredigenes
MSKRDYYEILGVSKDVDEQELKRAYRKQAMKYHPDRNPDDPEAESKFKEANEAYEILSSPEKKARYDQYGHAGVNGNGGGPQGFGGGGGFEDIFGDIFDMFGGGGGFSSGRRRSGPQRGSDIQYEMSITFEEAAFGAEKTVEFYKQDNCGTCHGSGAKPGTDAKSCSHCNGTGEVRYAQRTPLGQIVNVRPCEHCHGEGKIVEEPCTACSGKGKVKKHKKIKVKVPAGVDTGSAIPLRGEGEPGTKGGPYGDLYVVLRVLPHRLFVRDGYDVICEMPITFVQATLGDELEVPTLEGKVKYKIAEGTQSGTVFRLKNKGIVHPKGYGKGDQYVKVIIEVPKKLSDKQKEMLKQFAAASGEDIHEQRRSFFEKVKDAFSS

SEQ ID NO: 20667 - protein, 749 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQRFDRSMNTATLQ

SEQ ID NO: 20668 - protein, 169 aa, Gibberella zeae
MLIPKADRKKIHEFGSQYLFREGVLVAQKDFNLPKHPDIDTKNLFVIKAMQSLNSRGYVKTQFSWQYYYYTLTPEGLDYLREWLHLPAEIVPATHIKQQRSHAPPRGMLGEGERERRPFGRGRGGDRGDREGGYRRRDAGEGKEGGAPGEFAPQFRGGFGRGRGAAPPS

SEQ ID NO: 20669 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQDHSNVRSEVSDMLQ

SEQ ID NO: 20670 - protein, 156 aa, Unknown
  Frankia sp. EAN1pec
MARIDYFNDPNAPKANSVVPSVTAVVTDEAGRILMVHKTDNDLWALPGGGMDLGESITDAAVRETKEETGIDIEVTGLIGVYTNPRHVLAYDDGEVRQQFSLCFTTRNLGGELRTSSETKEVQFVAPEDLDTLNIHPSMRLRIDHYLENRATPYLG

SEQ ID NO: 20671 - protein, 364 aa, Haloarcula marismortui
MQGADADTVADALASDDALPGAGGFAGELDGTLVRDVLGRYPLFVERAVSDEARLDPGQWSHDPTALADPRSFPAGHIRNESGTQQRWSLPSLDPFGDRETAIETVGETVETSIDAVDTDSLAIAFSGGVDSALLAARLDAPLYVAGFPDSHDIEAARSAAELLGTEVRVVELTHDAIERAVPEIARATARTNAMDVQIALPLYLVAERVAGDGFDRLALGQGADELFGGYAKVAKAPEDPRVEADTVRGAQREVIASLPDQLERDVLALRAAGVEPVTPLLHDRVIGAALRLDGDLLVDGETRKVALRAAARESLPDEIADRDKKAAQYGSLAARELDRLARQAGYKRRMDDHVTQYVESLVE

SEQ ID NO: 20672 - protein, 457 aa, Porphyra yezoensis
MQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGM

SEQ ID NO: 20673 - protein, 147 aa, Oryza sativa
MSFAIRSSEPEFWFLIPSEEAAVAVAAHRLVVMDQRRSGSAYRPKRTHMAAAEDEHRRPGTSSRRRVAPTPTTQTQTQTAPGYFTVELVMAFVCVTASLVLLPLVLPPLPPPPSLLLVVPVCLLAVLVAMAFVPLDAQSNVVGSSCL

SEQ ID NO: 20674 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQCTTVSRSNEKAGLQ

SEQ ID NO: 20675 - protein, 180 aa, Rhizobium leguminosarum
EFDEFPTLEQLPLWGFDGSSTMQAEGRSSDCVLKPVAIYPDPARTNGALVMCEVMMPDGVTPHASNARATILDDEDAWFGFEQEYFFYQNGRPLGFPEQGYPAPQGPYYTGVGYSNVGDVAREIVEEHLDLCLAAGINHEGINAEVAKGQWEFQIFGKGSKKAADQIWMARYLLQRLTEK

SEQ ID NO: 20676 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQCCHTPRSDMIGGLQ

SEQ ID NO: 20677 - protein, 644 aa, Solibacter usitatus
MCGIAGFVTVQPSDSPSIIERMTDTIRHRGPDDFGFYRDPWASLGFRRLAIIDVSGGHQPMPNEDQSKFIIFNGEIFNHASLRPALEQAGHRYSNRSDTETILHSYEQYGADCVLRLRGMFAFAIWDKNTRKLFCARDRLGKKPLYYFWDGRTFAFASEIKALFEHPSISPQFEESLLPEYLAFGYVSEDRTLFRGIRKLMPGHHLTLHLGAPNPQPVIRQYWEIPDPQPEQRDDASWISECRDRMEQTVQMRLMSDVPLGMFLSGGVDSSAIAALMKRNFSGPVKTFAVGYQEAEFSELSYARHVAGAIGTDHHEVVVGMEDFFNALPRLIWHEDEPITWPSSVSLYFVSKLAREHVTVVLTGEGSDEMFGGYARYRFYAMNERWMRFYRILPRAVRTAIRSQVATTSLLSSTLRRKLQHTFVGRAEDLESLYLDNFYSAFSQSQQRDLFPALAATSPYANFRRYWDSKPGLNPLPRMLFADQKTYLIELLMKQDQMSMATSIESRVPFLDHEFVEFSTRVPEHMKLRNGEGKYIVKKAIEGLVPHEIIYRKKMGFPTPLRQWLLDPRAAHLFDMMRAKDGLLASCIDPARLDDLLLRQTSGREDVTDRIWRLLTLQLWGDMFFTGKREERWDGLMAAARPAV

SEQ ID NO: 20678 - protein, 180 aa, Rhizobium leguminosarum
EFDVFPTLEQLPLWGFDGSSTQQAEGRSSDCVLKPVAIYPDPARTNGALVMCEVMMPDGVTPHASNARATILDDEDAWFGFEQEYFFYQNGRPLGFPEQGYPAPQGPYYTGVGYSNVGDVAREIVEEHLDLCLAAGINHEGINAEVAKGQWEFQIFGKGSKKAADQIWMARYLLQRLTEK

SEQ ID NO: 20679 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQCIIFSRSDVAIALQ

SEQ ID NO: 20680 - protein, 180 aa, Unknown
  Rhizobium sp. USDA 1920
EFDNFPTLEQLPLWGFDGSSTMQAEGRSSDCVLKPVAIYPDPARTNGVLVMCEVMMPDGVTPHASNARATILDDEDAWFGFEQEYFFYENGRPLGFPESGYPAPQGPYYTGVGYSNVGSVAREIVEEHLDLCLAAGINHEGINAEVAKGQWEFQIFGKGSKKAADQIWMARYLLQRLTEK

SEQ ID NO: 20681 - protein, 72 aa, Thermus thermophilus
MAKEKDTIRTEGVVTEALPNATFRVKLDSGPEILAYISGKMRMHYIRILPGDRVVVEITPYDPTRGRIVYRK

SEQ ID NO: 20682 - protein, 723 aa, Listeria innocua
MSEKQVFSTEWAGKTLSVEVGQLAKQASGAALIRYGDTVVLTAAVGSKKPRPGDFFPLTVNYEEKMYSVGKVPGGFLKREGRPSDRATLTARLIDRPIRPLFAEGFRNEVQITSTVFSVDQDCSPEMAAMLGSSVALVISDIPFEGPIAGVDVGRIDGKYVINPTIEQAEKSDISLTVAGTYDAINMVEAGAKEVSEEAMLEAIMFGHEEIKRLCEFQQQIIAAVGKEKREIELFVSDPELEAEVKAASEGKMKAAIKTEEKKAREAAIEEVKEEILESYKAKELENEAEILGEVAHILEMIEKDEMRRLISQDKIRPDGRKVNEIRPLSSEVGMLPRVHGSGLFTRGQTQALSVCTLAPLREHQIIDGLGTEEYKRFMHHYNFPQFSVGETGPRRAPGRREIGHGALGERALQYVIPSEEEFPYTIRLVSEVLESNGSSSQASICGSTLAMLDAGVPIKAPVAGIAMGLVKLGDDYTILSDIQGMEDHFGDMDFKVAGTKDGITALQMDIKIDGLSRQILDEALTQAKEGRLHILEHLTSTISEPREELSAYAPKIITLNIKPEKIKDVIGPGGKQINAIIEETGVKIDIEQDGTVYIASQDQAMNRKAIAIIEDIVREVEVGEVYTGKVRRIEKFGAFVELFKGTDGLVHISELAHERVGKVEDILKLGDEVTVKVIEVDHQGRVNLSRKALLEKKEQPEGDKKPQAEKKFYPKTKKPESK

SEQ ID NO: 20683 - protein, 180 aa, Agrobacterium rhizogenes
EFDAFPTLEQLPLWGFDGSSTMQAEGRSSDCVLKPVAIYPDPARTNGALVMCEVMMPDGVTPHESNSRATILDDEDAWFGFEQEYFFYKDGRPLGFPESGYPAPQGPYYTGVGYKNVGDVAREIVEEHLDLCLEAGINHEGINAEVAKGQWEFQIFGKGSKKAADQIWMARYLLLRLCEK

SEQ ID NO: 20684 - protein, 374 aa, Unknown
  Oceanospirillum sp. MED92
MAIGREKLKRSKRWVIKIGSALLTNDGQGLDLEAISRWVDQIAALKASGLEVVLVSSGSVAEGMTRLGWDSRPHEVSKLQAAAAVGQMGLVQAYEANFRRHETHTAQILLTHEDHSNRKRYLNAQATLKELLALGVVPVVNENDTVVTKEIRFGDNDTLGALVANLVQADALILLTDQKGLFTADPRYDPGAILISEARAGDEALEAMAGDGGKLGRGGMATKVRAAKLAARSGAVTVIASGREDDVLLRLRESEQLGTLLVPEKEPMVARKQWIAGHLQARGTLVLDEGAVKALRDRGKSLLPAGVRSISGDFSRGEMVIISDEYGRIVARGLVNYGVEDAQRIMGKASRDIESVLGFMGEEELVHRDNLVLA

SEQ ID NO: 20685 - protein, 99 aa, Xylella fastidiosa
MKLITAIIRPFKLDEVREALSQVGVSGITVTEVKGFGQQKGHTELYRGTEYVIDFLPKIKIEMVVTDERLDAVIEVIRIAAVTGKIGDGKIFVTKIEQV

SEQ ID NO: 20686 - protein, 271 aa, Unknown
  uncultured bacterium
NSRLCMSSAVAGYTRSLGSDGPPCSYEDLDHCTVAFLIGTNTAECHPVLFQRLLKRKKRHPGSVTIVVIDPRQTDTAKAADIHLAVAPGSDLALLHGIAHLVMRENGQDPTFIDDCTDNYDSFFDVVARWTPRRVALFCGIPEKRLREVAQLFHRREKVLSLWSMGVNQRREGTAVVGGIINLHLLTGQIGKEGAGPFSLTGQPNAMGGREAGGLSHLLPGYRQVTNPEHRAEVEQTWGFPQGKIAPDPGLTAWQQVEAMERGELDLWWVA

SEQ ID NO: 20687 - protein, 271 aa, Unknown
  uncultured bacterium
NSRLCMSSAVAGYTRSLGSDGPPCCYDDLDHCSVAFMIGTNTAECHPVLFQRLLKRKKRNPGSLKIVVVDPRRTDTAKAADIHLPIAPGSDLALLHGIAHLILRENGQDPAFIDDHTENYEAFFDVVARWTPRRVARFCNLPEKRLREVAQLFHHRETVLSLWSMGVNQRREGTAVVSGLINLHLLTGQIGKEGAGPFSLTGQPNAMGGREAGGLSHLLPGYRLVANDQHRQVVEQAWNLPAGSIAAKPGLAAWQQIEAMERGELDLWWVA

SEQ ID NO: 20688 - protein, 355 aa, Zea mays
MACLTDLVNLNLSDTTEKIIAEYIWIGGSGMDLRSKARTLPGPVTDPSKLPKWNYDGSSTGQAPGEDSEVILYPQAIFKDPFRRGNNILVMCDCYTPAGEPIPTNKRYSAAKIFSSPEVAAEEPWYGIEQEYTLLQKDTNWPLGWPIGGFPGPQGPYYCGIGAEKSFGRDIVDAHYKACLYAGINISGINGEVMPGQWEFQVGPSVGISSGDQVWVARYILERITEIAGVVVTFDPKPIPGDWNGAGAHTNYSTESMRKEGGYEVIKAAIEKLKLRHKEHIAAYGEGNERRLTGRHETADINTFSWGVANRGASVAVGQTEQNGKGYFEDRRPASNMDPYVVTSMIAETTIVWKP

SEQ ID NO: 20689 - protein, 271 aa, Unknown
  uncultured bacterium
NSRLCMSSAVAGYTRSLGSDGPPCCYDDLDHCSVAFLIGTNTAECHPVLFQRLLKRKKRNPGSVTIVVVDPRRTDTAKAADIHLPIAPGSDLALLHGIAHLVLRENGQDPAFIDDHTENYEAFFDVVARWTPRRVARFCNLPEKRLREVAQLFHRRENVLSLWSMGVNQRQEGTAVVCGLINLHLLTGQIGKEGAGPFSLTGQPNAMGGREAGGLSHLLPGYRLVANDQHRQDVEQAWKFPAGSIAATPGLAAWQQIEAMERCEIDLWWVA

SEQ ID NO: 20690 - protein, 184 aa, Alkalilimnicola ehrlichei
MTGEGATTERATLGGGCFWCLEAVFQRLRGVRSVVSGYAGGRRAHPSYAQVCSGATGHAEVVQIEYDPGTISYRELLQVFFTIHDPTTPNRQGADVGSQYRSVIFYHDDQQAAVAREVMSREAGRRADPIVTELTPLPAFYPAEADHQDYYRRHGGQPYCQMVIAPKLEKAARHFGRLTGDDRP

SEQ ID NO: 20691 - protein, 87 aa, Zea mays
  misc_feature (53)..(53): Xaa can be any naturally occurring amino acid
  misc_feature (82)..(82): Xaa can be any naturally occurring amino acid
STPIRSTVLSLVWQPNNVLLAAGSCDFKCRIFSAYIKEVEERPAPTRETLHNXFGELMFESSSSCGWVHGVCFSASGSRVAXVSHDS

SEQ ID NO: 20692 - protein, 984 aa, Burkholderia thailandensis
MTSSAFDSSRQGCGSGQCACKSAAHARRADPFDDTDYGTPQRHADADVTLDIDGREVTVPAGTSVMRAAIEAGINVPKLCATDSLEPFGSCRLCLVEIEGRRGYPASCTTPVEAGMKVRTQSDRLQDLRRNVMELYISDHPLDCLTCAANGDCELQDMAGAVGLREVRYGFDGKNHLSDAKDESNPYFSYDPAKCIVCNRCVRACEETQGTFALTIAARGFDSRVAASAGDAFMDSECVSCGACVAACPTATLIEKSVARLGQPEHEVVTTCAYCGVGCSLKAEMKGEQVVRMTPHKNGQANEGHACVKGRFAWGYATHKDRITKPMIREKITDPWREVSWDEAIGHAAAQFRRIQDKHGRDSIGGITSSRCTNEETYLVQKLVRAAFGNNNVDTCARVCHSPTGYGLKVTLGESAGTQTFASVGSADVIVVIGANPTDGHPVFGSRLKRRVREGAKLIVADPRRIDLVDGPHVKAVHHLQLRPGTNVALVNALAHVIVTEGLVDEAFVAERCEPHAFDVWRAFAARPENSPEATADITGVPADAVRAAARLYATGGRAAIFYGLGVTEHAQGSTMVMGIANLAMATGNLGIEGAGVNPLRGQNNVQGSCDMGSFPHELPGYRHIGDAAVRARFDEAWATTLQPEPGLRIPNMFDAALDGSFKGLYCQGEDIVQSDPNTQHVAAALSSLECLVVQDIFLNETAKYAHVFLPGATFLEKDGTFTNAERRISRVRRAMRPLSGYADWEVTLMLSRALGYDMHYAHPSEIMDEIARLTPTFAGVSYALLDALGSVQWPCNDAAPEGTPTMHVDHFVRGKGKFMITQYIASPEKVTPRYPLILTTGRILSQYNVGAQTRRTENVRWHDEDRLEIHPHDASDRGIKTGDWVGVESRAGQTVLRALVTERMQPGVVYTTFHFPESGANVITTDSSDWATNCPEYKVTAVQVAPVAQPSEWQRAYTRFRAEQLALLEQRTAANAPATATGK

SEQ ID NO: 20693 - protein, 236 aa, Gossypium hirsutum
MARRYWNINLEEMLEAGVHFGHGTRKWNPRMAPYISAKRKGIHITNLTRTARFLSEACDLVFDAASKGKQFLIVGTKNKAADSVARAAIRARCHYVNKKWLGGMLTNWPTTETRLHKFRDLRTEQKTGGLNRLPKRDAAMLKRQLSRLQTYLGGIKYMTRLPDIVIIVDQQEEYTALRECITLGIPTICLIDTNSDPDLADISIPANDDAIASIRLILNKLVVAICEGRSSYIRNP

SEQ ID NO: 20694 - protein, 228 aa, Oryza sativa
MQRLSRFVPSSSRRVTDLKDALWSGSLTFQHALSTFAADENTSGRKFASYTVFKGKAALSMQPILPSFSKLESGGSRVNKNGSVMLTFFPAVGQRKYDYSKKQLFALSPTEVGSLISLGPAESCEFFHDPSMKSSHEGQVKKSLSVTPLGNDSGYFLNITVLNNLQKTTERLSLPISKAEFTVMRTALSFALPHILGWDQALTNHQPSPSPASKPRVERPHPDSEWER

SEQ ID NO: 20695 - protein, 500 aa, Nicotiana tabacum
MARKNCGFPAGFPSFPLSLALIFFLPVNPLRHCSAGGHDYRDALRKSILFFEGQRSGKLPPDQRIKWRKDSALYDGASAGVDLTGGYYDAGDNVKFVFPMAFTTTLLSWSIIDFKRNIGRELGNAVKAVKWATDFLLKATAKEGVIYVQVGDAFSDHSCWERPEDMDTLRTVYKIDQNHPGSDVAGEIAASLAAASIVFRSLDSSYSGLLLDRAVKVFEFANRHRGAYSSSLHSAVCPFYCDFDGYQDELLWGAAWLHKATRRRQYREYIVKNEVVLRAGDTINEFGWDNKHAGINVLISKEVLMGRAPDLKSFQVNADAFICSILPGISHPQVQYSPGGLIVKPGVCNMQHVTSLSFLLLAYSNYLSHANHAVPCGSISATPALLKHIAKRQVDYILGDNPQRMSYMVGYGPRYPLRIHHRGSSLPSVAAHPARIGCKGGSNYFLSPNPNPNRLIGAVVGGPNITDSFPDARPFFQESEPTTYVNAPLVGLLAYFSAHT

SEQ ID NO: 20696 - protein, 451 aa, Escherichia coli
MDHLPIFCQLRDRDCLIVGGGDVAERKARLLLDAGARLTVNALAFIPQFTAWADAGMLTLVEGPFDESLLDTCWLAIAATDDDALNQRVSEAAEARRIFCNVVDAPKAASFIMPSIIDRSPLMVAVSSGGTSPVLARLLREKLESLLPLHLGQVAKYAGQLRGRVKQQFATMGERRRFWEKLFVNDRLAQSLANNDQKAITETTEQLINEPLDHRGEVVLVGAGPGDAGLLTLKGLQQIQQADVVVYDRLVSDDIMNLVRRDADRVFVGKRAGYHCVPQEEINQILLREAQKGKRVVRLKGGDPFIFGRGGEELETLCNAGIPFSVVPGITAASGCSAYSGIPLTHRDYAQSVRLITGHLKTGGELDWENLAAEKQTLVFYMGLNQAATIQQKLIEHGMPGEMPVAIVENGTAVTQRVIDGTLTQLGELAQQMNSPSLIIIGRVVGLRAIN

SEQ ID NO: 20697 - protein, 969 aa, Prochlorococcus marinus
MTSKFGSDLFIDRHLGLGDNDERIMLNKLGFNNIDQFINQVIPEDIQIKDKSSEILPQGCSEIEALNELEEIANKNTKIRSLIGLGYYDNHMPKVIQRHVLENPRWYTSYTPYQAEIAQGRLEALFNFQTIVCELTGFPVANASLLDEGTAAAEAMAMSFSARKNKSSKVYLVESNVFDHTFNVLQTRAKPLGISLKRFTQSKLPNHDDVFGMLLQLPGKNGELYDPTFLISQAHRSEIIVTACIDPLAQVLIKPISEFGVDVAVGSMQRFGVPMGFGGPHAAYFACSEKYKRLIPGRIVGQTLSKNGEKSLRLALQTREQHIRREKATSNICTAQSLLAIISSFYAIYHGPSGLTKIAKRLVELRINLESSLAALGFDIPDGIRFDSVDVYSEHSHRIHNEALKNGYNLRILPLGSTIENSTGFGISLDELSNEKEIKDILTFIANIIEKEEDLEHIKFDKDFHLESLALRSSAWMQQDIFTNYQSETELMRYIFRLAEKDFSLVDGMMPLGSCTMKLNSAAELNPVSWANLSSMHPFSPPDQTKGYSKIISDLEKWISEIVGLKSVSFQPNAGSQGEFAGLLAINSYFESKGELLRKKCLIPKSAHGTNPASAVMAGFEVLTVECDDEGNIDYQDLSLKVKKFDNQIGALMLTYPSTHGVFELQIRKICDLIHSVGGFVYLDGANLNAQVGLCKPGNYGVDVCHLNLHKTFCIPHGGGGPGVGPVAASETLSPYLPTHFLMDNNLSNSFNFVSSAKHGSASILPISWMYIKMAGLSGLRKATSHAILSANYIAHSLKHKFKILYKGKNNFVAHECILDFRDLKSKTGLSVNDLAKRLIDYSFHAPTISWPVPETIMIEPTESESLAELDRFCEAMLLIGEEISEIENNHELKNNNVISNAPHTLKELIADNWQYPYSKEKASFPYKTPTNTKFWSSVSRINNAYGDRNLICSCNVNQNETLEEKKCA

SEQ ID NO: 20698 - protein, 979 aa, Sulfolobus solfataricus
MSLVSIKLVIDNKEVLANEGETILSTLKRNGIYIPHICYNEGLVPIESCDSCLVEVNGKLVRACSTRVEDGMSISVNSKRAMEARKTAISRILRYHKLYCSICENNNGDCVLHEAVIKLNINSQKYVEKPYQTDESGPFYIYDPSQCILCGRCVEACQDFAVNEVIWINWDLNPPRVVWDNGNPIGNSSCVNCGTCVTVCPVNALMEKSMLGEAGYLTWINKDLKKKAIEAIGKAEDNFSLLMTFSEIEAKARESQIKKTKTVCIYCGVGCSFEIWTKGRKILKIEPKPESPANGILTCVKGKFGWDFVNSSERITKPLIREGDKFREASWDEAISYIAKRLKEIKERYGPDSIGFIASDKMSNEEAYLLQKLARAIIGTNNVDNSARYCQSPATVGLWRTVGIGADSGTIRDIENANLIVIVGHNTTESHPVIGSKVKRAKKINGSKIVVIDVRKHEIAEKADLFIKPKPGTDAAVLAGVAKYLIDQGWIDKEFIDKRVNGFEEFKESIKGFTLDYVEDITGVPRDQIIKLAEMIHNANSVAVLWGMGVTQHLGGADTSTIISDLLLITGNYGKPGSGAFPMRGHNNVQGVSDFGCLPNYLPGYQKLEDENVIAKFEEAWGVKLNRNPGLQIPQMIEGVLEGKIHALYIVGEDTVMVDCGTPLTRQALEKVDFLVVQDMFITETAKLADVILPAAASLEKDGTFVNTERRIQRFYKAMEPIGDSKPDWEIIQMVANALGANWSYNHPAEIMNEIAKLGPIFAGVNYSRLEGFNSLLWPVNEDGSDTPLLYTNAFATKDGKAILYPLSWKPPELKDEVHKVTVNTGRVLEHFHVGNMTRRVEGLRRKVPETFVEVSKELASKYSIKNGDLVLVKSKFGGEIKARAIVSDRVEGEEIFIPLYASDPSKGVNNLTGLVIDKASGTPGYKDTPVVIEKIEEGKGESPLPLDNWRFHVNERRRQIGIEVEKKWKREEFKPLTG

SEQ ID NO: 20699 - protein, 434 aa, Burkholderia thailandensis
MSSQSQSPSVAQSIPSYLHADDLGPWGNYLQQVDRVAPYLGSLSRWIETLKRPKRILIVDVPIELDNGTVAHFEGYRVQHNVSRGPGKGGVRYHQDVTLSEVMALSAWMSVKNAAVNVPYGGAKGGIRVDPRKLSRGELERVTRRYTSEIGIIIGPNTDIPAPDVNTNEQIMAWMMDTYSMNQGQTATGVVTGKPISLGGSLGRKEATGRGVFVVGCEAAKKKGVEIEGARIAVQGFGNVGGIAAKLFQEAGAKVIAVQDHTGTIHQPAGVDTAKLLDHVGRTGGVAGFEGAEPMPNDEFWTVETEILIPAALENQITEKNASKIRTKIIVEGANGPTTTAADDILSANGVLVIPDVIANAGGVTVSYFEWVQDFSSFFWTEDEINHRLERVMREAFAGVWAVAEEHKVSVRTAAFIVACKRILMAREMRGLYP

SEQ ID NO: 20700 - protein, 112 aa, Geobacter metallireducens
MKLIEAIIKPFKLDEVKDALTEIGVEGITVSEVKGFGRQKGHTELYRGAEYVVDFIPKVKIEIAVADEVVAKVVETIENTAKTGRIGDGKIFILPLDEAVRIRTGEKGAEAI

SEQ ID NO: 20701 - protein, 533 aa, Porphyra yezoensis
MQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKLKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGM

SEQ ID NO: 20702 - protein, 315 aa, Bacteroides fragilis
MGKIAKKLTDLVGNTPLLELSNYNASNGLKARVVAKLEYFNPAGSVKDRISLAMVEDAEAKGTLKSGATIIEPTSGNTGVGLAFVAAAKGYKLILTMPDTMSMERRNLLKALGAELVLTPGANGMKGAIAKAEELRAATPGSVILQQFENPANPAVHVRTTGQEIWRDTDGKVDIFVAGVGTGGTVSGVGAALKEHNPAVRIVAVEPVDSPVLSGGAPGPHKIQGIGAGFIPKTYHAAVVDEIRQVGNDDAIRTSRELAAKEGLLVGISSGAAVYAATELAKLPENEGKLIVVLLPDTGERYLSTILYAFEEYPL

SEQ ID NO: 20703 - protein, 330 aa, Oryza sativa
MAVQIPDGIMGETIAKDVTELIGNTPLVYLNRVTDGCVGRVAAKLESMEPCSSVKDRIGYSMITDAEEKGLITPGKSVLIEPTSGNTGIGLAFMAAAKGYRLVLTMPASMSMERRIILKAFGAELILTDPLLGMKGAVQKAEELAAKTNNSFILQQFENPANPKIHYETTGPEIWKGTGGKVDGLVSGIGTGGTITGAGRYLREQNPDIKIYGVEPVESAVLSGGKPGPHKIQGIGAGFVPGVLDVDLINETVQVSSDEAIEMAKALALKEGLLVGISSGAAAAAAVRLAQRPENEGKLFVVVFPSFGERYLSSVLFQSIKKEAENMVVE

SEQ ID NO: 20704 - protein, 402 aa, Zea mays
  misc_feature (211)..(211): Xaa can be any naturally occurring amino acid
  misc_feature (228)..(228): Xaa can be any naturally occurring amino acid
MAVLSAADASPVSAIGFEGYEKRLEITFSEAPVFVDPHGRGLRALSRAQIDSVLDLARCTIVSELSNKDFDSYVLSESSLFIYPLKIVIKTCGTTKLLLTIPRILELAEELSMPLAAVKYSRGTFIFPGAQPAPHRSFSEEVAALNRYFGGLKSGGNAYVIGDPARPGQKWHVFYATEYPEQPMVNLEMCMTGLDKKKASVFFKTNADGNXTTCAKEMTKLSGISEIXIPEMEICDFDFEPCGYSMNAIHGSAFSTIHVTPEDGFSYASYEVMGLDATALSYGDLVKRVLRCFGPSEFSVAVTIFGGRGHAGTWGKALGAEVYDCNNMVEQELPGGGLLVYQSFCAAEDAVATSPKSVFHCFDGENVESAPPPMKKDYKLANLLCWEEEADAMEEKAGVLDE

SEQ ID NO: 20705 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQTSNRDRSNRDVTLQ

SEQ ID NO: 20706 - protein, 149 aa, Zea mays
  misc_feature (69)..(69): Xaa can be any naturally occurring amino acid
ASFPVSRKQSLDITSIASNGGRVSCMQVWPPINMKKYETLSYLPDLSDEQLLSEIEYLLKNGWVPCLEXFETEHGFVYRENHKSPGYYDGRYWTMWKLPMFGCTDATQVLAEGQEAKKAYPQAWVRIIGFDNVRQVQRIRFIGYKPEGY

SEQ ID NO: 20707 - protein, 486 aa, Saccharomyces cerevisiae
MVHLGPKKPQARKGSMADVPKELMQQIENFEKIFTVPTETLQAVTKHFISELEKGLSKKGGNIPMIPGWVMDFPTGKESGDFLAIDLGGTNLRVVLVKLGGDRTFDTTQSKYRLPDAMRTTQNPDELWEFIADSLKAFIDEQFPQGISEPIPLGFTFSFPASQNKINEGILQRWTKGFDIPNIENHDVVPMLQKQITKRNIPIEVVALINDTTGTLVASYYTDPETKMGVIFGTGVNGAYYDVCSDIEKLQGKLSDDIPPSAPMAINCEYGSFDNEHVVLPRTKYDITIDEESPRPGQQTFEKMSSGYYLGEILRLALMDMYKQGFIFKNQDLSKFDKPFVMDTSYPARIEEDPFENLEDTDDLFQNEFGINTTVQERKLIRRLSELIGARAARLSVCGIAAICQKRGYKTGHIAADGSVYNRYPGFKEKAANALKDIYGWTQTSLDDYPIKIVPAEDGSGAGAAVIAALAQKRIAEGKSVGIIGA

SEQ ID NO: 20708 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQVSAATRSVGGRNLQ

SEQ ID NO: 20709 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQTGDVDRSGESDIRK

SEQ ID NO: 20710 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQPDNINRSTGTRKLQ

SEQ ID NO: 20711 - protein, 382 aa, Unknown
  Magnetococcus sp. MC-1
MNRLVIIGTGLAGYGLAKELRKRQDKRPITLISSDDGASYSKPMLSSALAQNKDAAALVMASAEQMMAQLEAEIITHTQVEQLDTAARTLQLSSGQSIVYHTLVLAVGANPIQLPLQGSGAAEVMQVNSLADYARWRTRLQGVERVMVIGPGLIGCEFANDLLKVGKQVSLIGPDPWPISALIPEAAGRAVQQRLAEAGATWHLETFNGAIEKSAQGFVTELKNGQVVEGDLVLSAVGLRPNIALAQAAGLAVNRGIVTDAYLQTSDPHIYALGDCAEVEGRNLPYVQPLMVAGRALAATLSGEATAVVYPLMPVAIKTSLHPVVTLPVGKMEGRWALSQGEDGVLGRFFDQQERLQGFVLTGSNAALKGQLLKEMEERAAS

SEQ ID NO: 20712 - protein, 745 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQSTFLRRSG

SEQ ID NO: 20713 - protein, 587 aa, Oryza sativa
  misc_feature (382)..(382): Xaa can be any naturally occurring amino acid
MESNGGGGGSPKEAAVVVPSSGDATLGGHLARRLVQVGVSDVFAVPGDFNLTLLDHLIAEPGLRVVGCCNELNAGYAADGYARARGVGACAVTFTVGGLSVLNAIGGAYSENLPLICIVGGPNSNDYGTNRILHHTIGLPDFSQELRCFQPLTCYQAVVNNLDDAHDQIDRAISTAIRESKPVYISVSCNLPAVPHPTFSRDPVPYFLSPRLSNQASLHAALDATLAFLDKAVKPVLVAGPKLRVAKAGGAFVDLADASGHAVAAMPSAKGLVPETLPRFIGTYWGAVSTAFCAEIVESADAYLFAGPIFNDYSSVGYSCLLKKEKAVVVQPDRVTVGNGPAFGCVMMRDFLSELAKRVRKNTTAFDNYKRIFVPEGQLPEXRPGEALRVNVLFKHIQRMIGGTEIGAVMAETGDSWFNCQKLRLPEGCGYEFQMQYGSIGWSVGALLGYAQAVQKRVVACIGDGSFQVTAQDVSTMLRCGQRSIIFLINNGGYTIEVEIHDGPYNVIKNWDYVGLVNAIHNGEGRCWATRVRCEEELEAAIATATGDKADSLCFIEVVAHKDDTSKELLEWGSRVSAANSRPPNPQ

SEQ ID NO: 20714 - protein, 518 aa, Unknown
  delta proteobacterium MLMS-1
YICVIENEGQYIYFLDGIATILTPIPDIPFVEEFVNVPLLTHRQPEKILILSGGAGGIINEALKHPSLAAVEYAEQDPLLFELLRKFPTELTESELDDPRVKIHHTDGRLLLQTTPRQYDLIFIGILEPSSLQTNRYFTREFFTLARERLNPGGILVFGLPGSMTYLNDELKNLNSSVFHTVKSVFPHVRVIPGDGHNLFLSSDAPDVAAVDAHQIMARLTEREIRAEAMLPWHIEKKLHPGWQEWFYEFIEESSRQLNRDFTPLGVFYSISHWNALYSPEFGRFFNKLERADLKGAALVPLLLLAAYLLLRAGVKRAVRPGIPLAIATTGFAGMISSLVLIFTFQAFYGYLFSWIGLLVAAFMAGAAAGAQLVTSALGRIQDHRQLFKRIELAIVVFSLLLPLGLLAANTWVASVAAFDLLRVLFLVVSLVAGFLLGAQFPLANKLYLGDNAHLSRTAALLYTADLLGGWLGGIVGAVVLLPVLGLVGTCLVMGLLKAVSFVIISFEFSDQQQEVAT

SEQ ID NO: 20715 - protein, 421 aa, Streptomyces tubercidicus
MVDAHQTFVIVGGGLAGAKAAETLRAEGFTGRVILICDERDHPYERPPLSKGFLLGKEERDSVFVHEPAWYAQAQIELHLGQPAVRLDPEAKTVRLGDGTLIAYDKLLLATGAEPRRLDIPGTGLAGVHHLRRLAHAERLRGVLASLGRDNGHLVIAGAGWIGLEVAAAARSYGAEVTVVEAAPTPLHGILGPELGGLFTELHRAHGVRFHFGARFTEIVGQDGMVLAVRTDDGEEHPAHDVLAAIGAAPRTALAEQAGLDLADPEAGGGVAVDATLRTSDPYIYAAGDVAAADHPLLDTRLRVEHWANALNGGPAAARAMLGQDISYDRVPYFFSDQYDVGMEYSGYAPPGSYAQVVCRGDVAKREFIAFWLGEDGRLLAGMNVNVWDVAETIQQLIRGGVRLEPGELADPEVPLTSLLP

SEQ ID NO: 20716 - protein, 709 aa, Unknown
  delta proteobacterium MLMS-1
IIPNYRFFMAAVHPEDREMVEAALDHFRCHPKARNALEFRIGRSDSNERFIHLNGRLILNEEGLPKQVVGVILDVTKRKKVERDLIEAKEQAEQADRAKSRFLANMSHEIRTPMNAVINLSRLVLQDELTSRQRDYVGKVLRSGENLLAIINDILDFSKIEAGKLELESVPFGLRELIDDVVVPLSPTAHDKAIGFRVELAEELPERLVGDATRLRQILLNLVSNAIKFTEQGEVLLKVQLLKRQGDQVTIAFKVSDSGIGISPAQQQRLGESFRQADDSINRRFGGTGLGLAITKQLLGLMGSELEVESAPGAGSNFAFTIQLALADDASPPAASVFGEAGQMTAALEQIATAHVLLVEDNVINQEIGKALLRQVGLEVAVAADGVEAMELLARQPFDLVLMDLQMPGMDGYEATRMIRRQPSLAGLPIVAMTAYATSGVREQCLAAGMDDYLGKPIEVDQLHRVLTRWIAPRSPWPQVAPAVADGEGWGPKINNPLPGIDTVQGVQRCGGSWAMYRRLLRRFAVGNSGTMAALEQALAAGEREEARHLVHALKGVAGNLAATELFAAAAELEQILACAGESWEDALSRFSHALARVLEGLQPLLASAQASAAEFPSGVGEVDMAAVALLLAKIPPLLESDLGEARTTFESLRELLVATPLAGHGERLGHALAEYDTDQALELIGKLTLEITEVVASGEQKGRSEKKS

SEQ ID NO: 20717 - protein, 438 aa, Triticum aestivum
ARGTKRALTTYLKAHPGGPALSEFVWATGNTPRRSSRLSAKPKATESPEDEKPSRRSGKSKATESPEDEKPAKRGRPSSSKKGKKGKQEDAEDAEAESGDHADAEEAKGTEVEMKDAEEAKVTDLDLEMKEADNAQEEKKEEEAGGSVPRVREADTVAQEEKKEADPVAQEEKKEADTLAQEEKKEADTVAEEEKEEADTVAQEEMKDAPVADAPEKAEEVEGEAAESEVAPVETEMPDPVTENKENEKPAEFEEVPVEFEMSDLVSENKENEKPAESEEVPVEFEMSAPVLEEHKEDEKPAEYEVAPVEGEKTENGLAVESTVSPPATSEEKKVEADSTINPATPPPAEVKADAPAAEAAKAAENPADNAAHKDDQGNAGTTGEQSTGNVDNQWTDSSRCFYRAVHLKVGSVDDDRRGEAKRRQARRNGEQTWSLCA

SEQ ID NO: 20718 - protein, 271 aa, Unknown
  uncultured bacterium
NSRLCMSSAVAGYTRSLGSDGPPCCYEDLDHCSVAFLIGTNTAECHPVLFQRLLKRKKRDPKGLTIVVVDPRCTDTAKIADHHLAIAPGTDLALLHGLARLVIEDNGFDSDFIDAATEGFSDYTKTIHAWSAQETAKLCGITEQELRDVGRLWSRKAGILSLWSMGVNQRREGTAVVSGLINLHLLTGEIGKPGAGPFSLTGQPNAMGGREAGGLAHLLPGYRLVANPEHRSEVEQAWGLASGSIAAEPGLSAWQQVEAMERGELDLWWVA

SEQ ID NO: 20719 - protein, 271 aa, Unknown
  uncultured bacterium
NSRLCMSSAVAGYTQSLGSDGPPCCYDDLDHCSVAFLIGTNTAECHPVLFQRLLKRKKRNPGSVTIVVVDPRRTDTAKAADIHLSIAPGSDLALLHGIAHLILRENGQDPAFIDDHTENYEAFFDVVARWTPRRVARFCNLPEKRLREVAQLFHRREDVLSLWSMGVNQRQEGTAVACGLINLHLLTGQIGKEGAGPFSLTGQPNAMGGREAGGLSHLLPGYRFVANGQHRQDVEQAWDFPAGSIAATPGLAAWQQIEAMERGELDLWWVA

SEQ ID NO: 20720 - protein, 618 aa, Nicotiana tabacum
MMMFEEMGFCGDLDFFPAPLKEVETAASQIEQEQEQEPVMDDDYSDEEIDVDELERRMWRDKMKLKRLKEMTKGGKEGVDAVKQRQSQEQARRKKMSRAQDGILKYMLKMMEVCKAQGFVYGIIPEKGKPVTGASDNLREWWKDKVRFDRNGPAAIAKYQADNAIPGKNEGSNPIGPTPHTLQELQDTTLGSLLSALMQHCDPPQRRFPLEKGVPPPWWPTGQEDWWPQLGLSKDQGPPPYKKPHDLKKAWKVGVLTAVIKHMSPDIAKIRKLVRQSKCLQDKMTAKESATWLAIINQEEVLARELYPDRCPPLSSAGGSGTFTMNDSSEYDVDGVVDEPNFDVQEQKPNHLGLLNVNVDRFKERLPMQQQSLPIKDEIMIANLDFTRKRKPADELTFLMDQKIYTCECLQCPHSELRNGFQDRSSRDNHQLTCPFRNSPQFGVSNFHVDEVKPVVFPQQYVQPKPASLPINQAPPSFDLSGIGVPEDGQRMINELMSFYDNNIQGNKSSMAGNVVMSKEQPRQQPSIQQNNYLHNQGIILDGNIFGDTNISANHSMFPQGDRFDQSKVLTSPFNAGSNDNFHFMFGSPFNLQSTDYTEALSGITQDNMPKQDVPVWY

SEQ ID NO: 20721 - protein, 219 aa, Unknown
  uncultured bacterium
NSRLCMSSAVSGYTQSFGSDGPPCCYDDLDHCKVAFLIGTNTAECHPVLFQRLLKRKKRNPGSLKIVVVDPRRTDTAKAADIHLPIAPGSDLALLHGIAHLILRENGQDPAFIDDHTENYEAFFDVVARWTPRRVARFCNLPEKRLREVAQLFHRRENVLSLWSMGVNQRQEGTAVVCGLINLHLLTGQIGKEGAGPFSLTGQPNAMGGREAGGLSHLL

SEQ ID NO: 20722 - protein, 616 aa, Nicotiana tabacum
MMMFEEMGFCGDLDFFPAPLKEVETAASQIEQESEPVMDDDYSDEEIDVDELERRMWRDKMKLKRLKEMTKGGKEGVDAVKQRQSQEQARRKKMSRAQDGILKYMLKMMEVCKAQGFVYGIIPEKGKPVTGASDNLREWWKDKVRFDRNGPAAIAKYQADNAIPGKNEGSNPIGPTPHTLQELQDTTLGSLLSALMQHCDPPQRRFPLEKGVPPPWWPTGQEDWWPQLGLSKDQGPPPYKKPHDLKKAWKVGVLTAVIKHMSPDIAKIRKLVRQSKCLQDKMTAKESATWLTIINQEEVLARELYPDRCPPLSSAGGSGTFTMNDSSEYDVDGVIDEPNFDVQEQKPNHLGLLNVNVDRFKERLTMRQQSLPIKDEIIIANLDFTRKRKPADELSFLMDQKIYTCECLQCPHSELRNGFQDRSSRDNHQLTCPFRNSPQFGVSNFHVDEVKPVVFPQQYVQPKPASLPINQAPPSFDLSGLGVPEDGQRMINELMSFYDSNIQGNKNSMAGNVVMSKEQPRQQPSIQQNNYLHNQGIVLDGNIFGDTNISANHSVFPQGDRFDQSKVLTSPFNAGSNDNFHFMFGSPFNLQSTDYTEALSGITQDNMPKQDVPVWY

SEQ ID NO: 20723 - protein, 219 aa, Unknown
  uncultured bacterium
NSRLCMSSAVAGYTRSLGSDGPPSCYEDLDHCSVAFLIGTNTAECHPVLFQRLLKRKKRNPGSITIVVVDPRKTDTAKAADIHLPIAPGSDLALLHGIAHLVLRENGQDPAFIDDHTENYDAFFDIAARWTPRRVALFCNIPEKRLRDVAQLFHRRERVLSLWSMGVNQRREGTAVVQGIINLHLLTGQIGKEGTGPFSLTGQPNAMGGREAGGLSHLL

SEQ ID NO: 20724 - protein, 300 aa, Nicotiana tabacum
MMMFDDMRFCGDLDFFSAPLKEVEAAAPQTEPEPEPVVDDDYSDEEIDVDELERRMWRDKMKLKRLKEMTKSKEGVDPAKHRQSQEQARRKKMSRAQDGILKYMLKMMEVCKAQGFVYGIIPEKGKPVGGASDNLREWWKDKVRFDRNGPAAIAKYQADHAIPGMNEGSNPVGPTPHTLQELQDTTLGSLLSALMQHCDPPQRRFPLEKGVSPPWWPTGQEDWWPQLGLQKEQGPPPYKKPHDLKKAWKVGVLTAVIKHMFPDIAKIRKLVRQSKCLQDKMAAKESATWLAIISQEEALA

SEQ ID NO: 20725 - protein, 1693 aa, Gibberella zeae
MASADFCDDSEDITRKRTMLLPDFATCPNPQGLCKQTTAQRGATFNNKFPFAKKTRTHRPQDYPEEAIGPTDRNDPNNMYHLDTNLNDMEGILTKPPPLTPMDTTFVNPVEPERHDSIISTAPKGRWDAPDSWAVRRNTEDNSYNGGPELDEIGSPPRPEEKASPYCIRIFRSDGTFSTHSMSLDSSVTDVISQVIKKTYVMDGLENYHIIMKKHDLIRVLTPPERPLLMQKRLLQQVGYEEKDRIEDLGREDNSYLCRFMFLSARESDFHAKTTDMGLARAQKLNYVDLSGRNLVTIPISLYSKAMEIISLNLSRNLSLDVPRDFVQSCKHLRDIKFNNNEARKLPPSLSRANKLTYLDVANNRIEQLEHAELNALTGMIKMNLANNRLKHLPSYFGAYQSLRTLNISSNFIDKFPTFLCGLPSLVDLDLSFNAIATIPQEIGSLRNLEKLLITNNRLTHAVPATFGQLVSLRELDIKYNGISSIDIISELPKLEILSADHNCVSAFVGQFESLRKLKLNSNPLNKFEIVAPVPTLKTLNLSNAQLASIDSSFANMVNLERLILDKNYFVSLPQEIGTLSKLEHFSIANNSVGELPSQIGCLTELRVLNVRGNNISKLPMELWWANRLETFNASSNVLEHFPKPASRAPRIPGEESQPAPPPVNGRAAPLGTLSATASSEELSDDRRPSQNSSTLLSVGPSPLNAGDRKSSVVSVYGKGGRKTSVVSRSATPSAPTQSVNPRKDSGLSSRLNNTFAGSLRNLHLADNRLDDDVFDQITLLTELRVLNLSYNDEISDMPQRSIKSWPQLVELYLSGNALTTLPADDLEESSLLQALYINGNRFTNLPADISRAKNLAVLDCGSNYLKYNISNVPYDWNWNLNPNLRYLNLSGNKRLEIKQTATGPLGPGAVNREEYTDFSRLLNLRILGLMDVTLTQPSIPDQSEDRRVRTSGSLAGHLPYGMADTLGKHEHLSTVDLVVPRFNASETEMLLGLFDGQALSSGGSKIAKYLHENFGHIFALELKALKTRLNETPVDALRRAFLALNKDLVTIAIQQSEERPIQTHRNSGQPIILTKEDLNSGGVATVVYLQSTELYVANVGDAQAMVIQTDGTHKMLTRKHDPAEPTERSRIREAGGWVSRNGRLNDLLQVSRAFGYVDLMPAVQAAPYVSNMTIREQDDIILIATGELWEYLSPGLVTDVARAERQDLMRAAQKLRDLAIAYGASGKIMVMMISVADLKRRVERSRLHRGASMSLYPSGIPDDAQVLNIRRGRRTKGDVLDSSLNRLEAEIPAPTGNVSIVFTDIKNSTTLWEMYPSAMRSAIKLHNEVMRRQLRRIGGYEVKTEGDAFMVSFPTATSALLWTFAVQMQLLDVNWPSEVLNSVSCQPIFDKDNSLIFKGLSVRMGIHFGDCVSETDPVTRRMDYFGPMVNKAARISAVADGGQITVSTDFISEIQRCLENYQDTDRGNASGSEDTFGDEETYASAIRKDLRSLTSQGFEVKEMGEKKLKGLENPEVVYSLYPHALAGRIEFHSQHERKEEGGGDKPAVLAPGTELCIDPDSVWTLWRISLRLEMLCSSLEGNEPPGLQPPETELLERIKQRGGEVTDRFLLNFLEHQVARIEELEDLHGPMSAILDQFMAQNRELKRYRRKYGALPNPVNSLSSSEEEEEEDDDDDDDDPDTEEGSNTEQEL

SEQ ID NO: 20726 - protein, 233 aa, Ralstonia solanacearum
MSSPSLAAPALARARDRLARRRTAGVLSRHHLLIIAIAIVIAIIALLLPRTCHAAAGAQAAPAPQPAAAGPCPTALDFRVRRLQDDAPQNLCQYAGRVVLVVNTASYCGYTYQYEGLEALYARFRDKGLTVLGFPSNDFEQEPGTGKQIADFCYNTYGVKFPMFSKTSVVGPAASPLYHWLAQQTGQPPKWNFHKYLLDRSGRVVAVYPSKVEPGDPALIKRIDALLAEPAPR

SEQ ID NO: 20727 - protein, 487 aa, Legionella pneumophila
MKTNIPTLSKPIKDSGYRRGLKDRHVQLIALGGIIGSGYFLGTGEVINLVGPSVFIAYLLGGLIIYLTMLCMGELAVAIPISGSFVTYTSDFISPTVACGVGWSYWITWVAYIPAECVAGGIIMELFTGVSGYIWVVCFGLIITYINLAKVDTFGEIEFWLALIKIISLLAFVFLAILIFFGLIHGSEPPGIIGFKYLLGDGGLLPNGAMSLLTAMVLLLVNYQGSEIIGLAAGESENPARMIPHAIRNVTFRILFLYIIPVFCLVLIFPWQKAGLSNSVFADALNFYGLKWAGAVTSFVTLSATLSCANSGFYGAVRSLNALARDGMAPHVLAKFNQNSVPQNAVIATLIGVWILLGVGYFFGQTKLYIALLLVSGFTGTLAWLSLCIAQISFRNRLYKAGYSIKDLRYVTPYSPYTGILAVILMVGSLFFLLLNKDPIYKLSFIIGVVSFIIPVIIYKVFDLSKVRKKALHVKSRVKFQDLFPPQ

SEQ ID NO: 20728 - protein, 585 aa, Elaeagnus umbellata
MCGILALLGCSDDSQAKRVRVLELSRRLKHRGPDWSGLFQFGDCYLAHQRLAIIDPASGDQPLFNEDKTVVVTVNGEIYNHEELRKKLSHHKFRTGSDCDVIAHLYEEYGEDFVDMLDGIFAFVLLDTRDNSFIVARDAIGVTSLYIGWGLDGSIWISSELKGLNNDCEHFETFPPGHLYSSKAGGMRRWYNPVWFSETIPSAPYDPLALRRAFENAVIKRLMTDVPFGVLLSGGLDSSLVASITARHLSGTKAAKQWGTKLHSFCVGLEGSPDLKAAKEVAAYLGTVHHEFHFTVQDGIDAIEDVIYHVETYDVTTIRASTPMFLMSRKIKSLGVKMVMSGEGSDEIFGGYLYFHKAPNKEEFHEETCRKIKALYLYDCLRANKSTTAWGLEARVPFLDKEFINVAMNIDPEYKKIKRDEGRIEKWVLRKAFDDEERPYLPKHILYRQKEQFSDGVGYSWIDGLKAHAAKHVTDKMIRNAAHIFPHNTPNTKEGYYYRMIFERFYPQNSARLTVPGGASVACSTAKAVEWDESWSKNLDPSGRAALGVHLSAYDNQVPSGVVQPEIISNVPQITVNTLGLEIQS

SEQ ID NO: 20729 - protein, 559 aa, Prunus dulcis
  misc_feature (46)..(46): Xaa can be any naturally occurring amino acid
MGSLEEERSLLEDGLIQDETNGLYTGDGSVDITGKPVLKQSTGNWXACPFILGTECCERLAFYGISTNLVTYLTHKLHEGNVSAARNVTTWSGTCYLTPLIGAVLADAYWGRYWTIAIFSTIYFIGMCTLTISASVPALKPPQCVDSVCPSASPAQYGVFFFGLYLIALRTGGIKPCVSSFGADQFDDTDSRERVKKGSFFNWFYFSINIGALVSSTLIVWVQDNAGWGLGFGIPALFMGIAIVSFFSGTPLYRFQKPGGSPLTRMCQVLVASFRKWNLDVPRDSSLLYETQDKGSAIKGSRKLEHSDELNCLDKAAVISETETKTGDFSNPWRICTVTQVEELKILIRMFPIWATGIVFSAVYAQMATMFVEQGMMMDTSVGSFTIPPASLSSFDVISVIFWVPIYDRFIVPIARKFTGKERGFSELQRMGIGLFLSVLCMSAAAVVEMKRLQLATELGLVDKEVAVPLSIFWQIPQYFLLGAAEIFTFIGQLEFFYDQSSDAMRSLCSALSASDDFIGKLSELFDSDIVTYFTTQGGKAGWIPDNLNDGHLDYFSGS

SEQ ID NO: 20730 - protein, 515 aa, Unknown
  Rhodococcus sp. RHA1
MTATTTQHAAAPDGGGDERHLRVVVVGAGLSGIAAAVKLERAGITDFVVLEKSDRVGGVWRENTYPGCGVDIPAPVYSFSFHPNPRWRSNFALQPELLSYIEDTVDTFGLQSRISMQTDVREAAWSDERRRWILDTSRGTIVAQHVIFAAGPITEPSTPAVPGIDRFDGDVFHSARWNHDVDLTGKRVAVVGTGASAVQFIPEIQPDVEELYVFQRTPAWVVPRLDFPFPRIAQWAFARVPAVQRALRRLLDVILRTLTWVMRCERTARLLNPIGTRWLARQVPDPALRAALTPNFTLGCKRLLLSNTYLPALTKSNVELIPHALAEVDGRVVVGADGTRREVDVIIFGTGFDVSHPPIASRIRGRDGTLLSEKWSKSPEAYLATTTPGAPNAYIMLGPNILVYNSFLGLAETQLDYVIDGLTTAERQGIEVLEVRDQPFRRFNDAVQKGLEPTVFNNGGCSSYYLDADGRNFAAWPWSTGSLRRRLARFDLENYAIRPYRTEQSPALHPSGKSR

SEQ ID NO: 20731 - protein, 307 aa, Unknown
  Nostoc sp. PCC 7120
MQETTISILGAGAWGASLANLAIANGNRVRVWSRRGSETLSAVLQGADIVLSAISMKGVREVASQIQSLTPSPETIFVTATKGLEPETIYTPSQIWQSCFPHHPVVVLSGPNLSKEIDQSLPAATVVASRVATAAATVQLAFSSSRFRVYTNPDPVGVELGGTLKNVIAIASGVCDGLHLGTNAKAALVTRGLTEMVRIGNCWGAKTETFYGLSGLGDLLATCNSPLSRNYQVGYQLAGGETLAQILAKLPGTAEGVNTCQVLVQLARQQNIVIPITEQVYRLLQGEVTPQQALDELMLRDIKPEYN

SEQ ID NO: 20732 - protein, 312 aa, Manihot esculenta
METFPVIDLSKLSGEERKPTMEMIQDACENWGFFELVNHGISHELMDTVERLTKEHYKKCMEQRFKEMVASKGLEAVQSEISDLDWESTFFLRHLPVSNMAEIPDLDEEYRKTMKEFAEELEKLAEQLLEVLCENLGLEKGYLKKAFYGSKGPTFGTKVSNYPPCPKPDLIKGLRAHTDAGGIILLFQDDKVSGLQLLKDGQWFDVPPMKHSIVINIGDQLEVITNGKYKSVMHRVIAQTDGTRMSLASFYNPGSDAVIYPAPALVEKEAEKSQVYPKFVFEDYMKLYAGLKFQAKEPRFEAMKAMGPIATA

SEQ ID NO: 20733 - protein, 1096 aa, Glycine max
  misc_feature (813)..(813): Xaa can be any naturally occurring amino acid
RNGGRIEENKEKWVHDASVDYKGRVPLRASTGVWKASLFVLTIEFSERVSYFGIASNLISYLTKVMHEDLSTASKNVNYWSGTTTLMPLVGGFVADAYTGRFYMVLFSSFVYLMGLSLLTMSQFIPSLMPCNTKMCQQPRKVHKVVFFLALYCISFGTGGYKPCLESFGADQFDDDHLEERKKKMSFFNWWSFALCFALLLGATVVVYVQDFVSWGVATLILAILMALTVIAFCVGKPFYRYRRAEGNPLTPILQVLIAAIRKRNLTCPSNPALLHEVPESERSQGFLDKAAIIEEKHFEQKYNPWRLATVTRVEETKLVLNIIPIWLTSLTVGVCVGQGQTLFVKQAAATNLKISDSFKIPPASMASVAAVGTLIAVPIYDRVVVPILRKVTGNERGISILRRISIGMTLSVLLMVVAALVEAKRLRMAAHEVLTVGETRHETMSVMWLIPQYLILGIGDSFSLVGLQEYFYDQVPDSMRSIGMALYLSVLGVGFFLCSFLIIIVEHVTGKTGNSWIGKDINSSRLDKFYWMLAVKRNVVRIEENEEKWVHDASVDYKGRVPLRASTGVWKASLFVLTIELSERVSYFGIATNLISYLTKVMHEDLQTAAKSVNYWSGTTTLMPLVGGFVADAYTGRFYMILFSSFVYLMGLSLLTMSQFIPSLKPCNNGVCHRPRKVHEVVFFLALYCISFGTGGYKPCLESFGADQFDDDHLEERKKKMSFFNWWNFAMCFALLLGATVVVYVQDFVSWGVATLIVTILMTLTVIAFCMGKRFYRYRRTEGNPLTPILQVLIAAMRKRNLSSKSTCVLNXLMQINSMNRFLDKAAIIEEKRIEQKYNPWRLATVTRVEETKLVLNIIPIWLTSLTVGVTVGQGQTLFVKQAAATNLKISHSFKIPPASMASVTAVGTLIAVPIYDRITVPIMRKFTGNERGISILRRISIGMALSVIVMVVAALVEGKRLRMATHEVLTVGETRHETMSVVWLIPQYLILGVGDSFSLVGLQEYFYSQVPDSMRSLGMALYLSVLGVGFFLSSFLIIIVDRVTGKTGNSWIGKDINSSRLDRFYWMLAVINALVLCVFLLVIKRYTYKTVQRR

SEQ ID NO: 20734 - protein, 420 aa, Pasteurella multocida [sequence omitted]

SEQ ID NO: 20735 - protein, 172 aa, Bacteroides fragilis
MEKLIRRIGLVAHDAMKKDLIEWVLWNSELLMGHKFYCTGTTGTLIQEALKEKHPDVEWDFTILKSGPLGGDQQMGSRIVDGEIDYLFFFTDPMTLQPHDTDVKALTRLASVENIVFCCNRSTADHIISSPLFLDPDYERTHPDYSGYTKRFENKPVVTEAVESVKKRKRKK

SEQ ID NO: 20736 - protein, 251 aa, Unknown
  Azoarcus sp. BH72
MTVTMRQMLEAGVHFGHQTRFWNPRMAPYIFGQRNKIHIVNLEKTMVKYNEAMNFVRKLAANRGTILFVSTKRQAREILAEEARRAGMPYVDERWLGGMLTNFKTVKQSIKRLKEVEAMIEDGSIERLSKREALTVTRELEKLQKSIGGIKDMGGLPDAIFIIDVGYHKIAVTEAQKLGIPVVGVVDTNHSPEGIDYIIPGNDDSSRAIRLYARGVADAVLEGRSQVLQEIVAAGGDEFVEVEEGSQEQQG

SEQ ID NO: 20737 - protein, 956 aa, Colwellia psychrerythraea
MTNNNLLAQLNDNLDFISRHNGPDRTQQQHMLDTLKVDSIEQMIDKTVPDNIRLLQPMALAKPQSEIEMLATLKGIASKNKVNRSYIGQGYYDTHVPHVILRNVFENPGWYTAYTPYQPEISQGRLEALLNFQQMITDLTAMELSNASLLDEATAAAEAMSLCKRASKNKSNVFFVSDDVHPQTLDVINTRAKYFSFEVVVAPCSELENHDVFGALLQYPGTTGQVHNLEKIIEQAHSKKTLVAVAADLLALTVLKAPGEMGADVVIGSAQRFGVPMGYGGPHAAFMATKEKYKRTIPGRVIGVSIDSKGKPALRMAMQTREQHIRREKANSNICTAQALLANMASFYAVYHGPQGLRKMGRRVNRLTSVLAAGLQKAGIELVHNDFFDTITLQTNEKTDAIYQRALAADLNLRLLPDQLGISLDETTTSADVEALWLAITEQSFNVDDIEQTLSAEFCNIPADCQRTSEYLSHPVFNSYHSETRMLRYLKSLENKDFSLTHGMIPLGSCTMKLNATAQMIPVTWPEFSRMHPFAPSDQCTGYETLAESFSDMLIEITGYDAFSLQPNSGAQGEYAGLIAIQRYHASRGEDYRNICLIPSSAHGTNPASASMVSMRIVLVNCDKEGNVDLDDLKEKINLHRDQLSAMMITYPSTHGVYEESIKEICELIHEAGGQVYLDGANMNAQVGLTSPGFIGADVSHLNLHKTFCIPHGGGGPGMGPIGVKSHLADFLPGHSVTNTVGAVSATALGSASILPISWAYIALMGAEGLKSATELAILNANYIMEKLSPHYPILFRGKQGRVAHECIIDLRPLKESSGISEEDVAKRLMDFGFHAPTMSFPVAGTLMIEPTESESLEELDKFIDALITIRHEIAKVEEGTWTLADNPLVNAPHTLNDLTGSDWPRAYSRLTACYPSSCPSQPKFWPTTNRIDNVYGDRNLICSCPPIESYQSTDT

SEQ ID NO: 20738 - protein, 486 aa, Desulfovibrio desulfuricans
MEKTRKGKRKMFISVLPEEQVEVVLSEEGVIVEYYVEMVHQAKTKGNIYKGIINNIDSNLQAAFVNYGAEKNGFLQVDEVHPEYYSAPHDPSKGKKYPLLQKVLKAGQEVLVQVVKEPTGSKGAFLTSYLSLPGRFLVLTPGREQIGVSRKVESEEERVRLRALLEGATPGPGLGLIVRTVSVGQSKTSIQRDLQFLKRLWKDVRKKGTVEKAPSLIYKELDLAARAVRDYLTDDVGEVWVDDEQTADAVQEFAAIVFPRRTNLVKRHKDTDRTLWERFSMQKQLDQIYSREVSLPSGGRLVFDQTEALMAIDINSGKIAGKTNFESMALRTNMEAAETIAQQLKLRDIGGQIVVDFIEMRDRNHWREVEKTLRAAMKNDRARHDVGKMSRFGLLQIVRQRLGSSALSISTEPCPCCKGTGLRRNMEWQAMQALKDIHRQLRATTASSLRWEAPEELGMYLLNHKRGHLTELENRFERDIDIAIRR

SEQ ID NO: 20739 - protein, 389 aa, Debaryomyces hansenii
MSQYRANQRLQQLSNILRPNQLSAEKSLKPETPFKVAVIGSGNWGTTIAKVLAENTAEKPDTFAKQVDMWVFQEKIDGTNLTEIINNKHENVKYLPGVKLPENLHAEPDIVKAAQGADLLVFNLPHQFLPKICKQLKGTLKPTTRAISCLKGLEVTPDGCKLLSTYITENLGIECGALSGANLAPEVARCKWSETTVAYNIPADFKGPGKDIDSAVLKEAFHRPYFHVNVIEDVAGVSVAGALKNIVAIAVGFVEGLGWGDNAKSAIMRVGLIETINFSNMFFPNSKPTTFTHESAGVADLITTCSGGRNVKVGRHMSKTGESAEEAEKKLLNGQSSQGIITAKEVHELLSNVGKTDQFPLFEATYQIIYGDESIQNLPNLLEDHSLFK

SEQ ID NO: 20740 - protein, 750 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQSFTINRSTTNRLQ

SEQ ID NO: 20741 - protein, 750 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQFFLNRSKSIAVLQ

SEQ ID NO: 20742 - protein, 489 aa, Oryza sativa
RRRRRRWSRGGRGAQGPPAEASACGVGGVRRAVRVGAAALPADPLRPGARHPARLRQPRLALRPPLRPPRPAPRRPPLRPHRPRRRPFIAAGAASIAAAVLTVGFSADLGRIFGDSITPGSTRLGAIIVYLVGFWLLDVGNNATQGPCRAFLADLTENDPRRTRIANAYFSLFMALGNILGYATGAYSGWYKIFPFTVTPSCSISCANLKSAFLLDIIILVVTTCITVASVQEPQSFGSDEADHPSTEQEAFLWELFGSFRYFTLPVWMVLIVTALTWIGWFPFILFDTDWMGREIYRGSPDDPSITQSYHDGVRMGSFGLMLNSVLLGFTSIVLEKLCRKWGAGLVWGVSNILMALCFVAMLVITYVAKNMDYPPSGVPPTGIVIASLVVFTILGAPLAITYSIPYAMAASRVENLGLGQGLAMGILNLAIVIPQVIVSLGSGPWDQLFGGGNAPAFAVAAAASFIGGLVAILGLPRARIASRRRGHR

SEQ ID NO: 20743 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQYTHFDRSVDAAVSK

SEQ ID NO: 20744 - protein, 304 aa, Enterococcus faecalis
MYDVIIIGAGPAGMTAALYASRSNLSVLMIERGAPGGQMNNTAEVENYPGFDSIMGPELAYKMYENVEKFGTENAYGIVMGIEDHGSYKEVICDDKSYEAKAVIIATGCEHRKLGVKGEEEFAGRGVSYCAVCDGAFFKNKRLVVVGGGDSAVEEAIYLTQFASEVVIVHRRDELRAQKIIQDRAFANEKISFVWDTVVEEIVGNEMVVTGVKARNVKTDEVSEIEANGVFIYVGLDPLTEPFKKAGITNEAGWIETDQEMRTKIPGVYAIGDVREKTLRQITTAVGEGGIAGQQVFNYIEELK

SEQ ID NO: 20745 - protein, 753 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQALDNTDLRGGCTAVSK

SEQ ID NO: 20746 - protein, 743 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQYFLNFY

SEQ ID NO: 20747 - protein, 448 aa, Listeria innocua
MAKHRYLPMTEQDEKEMLEVIGVKSIDDLFQDIPEKIRFKRDYDLKPAKSEPALLRELSKLASKNANTSEYASFLGAGVYSHYIPTVVDHVISRSEFYTAYTPYQPEISQGELQAIFEFQTMIAELTGMDLANSSMYDGGTALAEAAMLASGHTKRKKILISGAVHPESINVLKTYATGQHIEVEVIPEVDGKTDIDVLKKALSDDIAGFVVQYPNFYGQVEPLAELEKLVHENNSLLLVSSNPLSLGLLTPPGEFGADIVVGDSQVFGIPESFGGPHCGFFAVTNKLMRKVPGRLVGETVDENGKRGYVLTLQAREQHIRRDKATSNICSNQALNALASSVAMATLGKTGLVEMAKQNLDKSHYAKQKFRENGFEVLFSDGFFNEFVVKLSKPIKEVNESLLDEGIIGGYDLGFYDAKYEQHMLVAVTEMRTKEEIDAFVASLEGVK

SEQ ID NO: 20748 - protein, 488 aa, Listeria innocua
MNLEETMPLVFERSIPGRIGFSLPESDVPETNAGDYFDEAYLRSTPADLPELSELEIMRHYTNLSNHNFGVDSGFYPLGSCTMKYNPKINEKVARFPGFANIHPNQPESSVQGALELLYDLQTSLVEITGMDEVTLQPAAGAHGEWTGLMLIRAFHEKNGDTKRTKVIIPDSAHGTNPASAAVAGFDVVTVKSNEKGLVDVADLKKVVGEDTAALMLTNPNTLGLFEKDIVEMAEIVHAAGGKLYYDGANLNAIMAKVRPGDMGFDVVHLNLHKTFTGPHGGGGPGSGPIGVKKELIPFLPTPVLTKKDDAYTFDYNYPDSIGRVKPYYGNFGINVRAYTYIRTMGPDGLKLVTEYAVLNANYMMRKLQDAYDLPFDQVCKHEFVLSGNRQKKLGVRTVDIAKRLLDHNFHPPTVYFPLIVGEAIMIEPTETESKETLDSFIDTMLKIAKEAEENPEIVQEAPHSTYVKRLDETRAARKPVLRYQKEV

SEQ ID NO: 20749 - protein, 223 aa, Scenedesmus obliquus
MALLCKTFSKAGVRPARAQRRVVKVEARRTVKGASSAPDSVWYGPDRPKYLGWLSGETPAYLTGEFAGDYGWDTAGLSADPETFKRYRELELIHARWAMLGALGCITPELLANNGTPIAEPVWFKAGAQIFQDGGLNYLGNENLVHAQSIIVTLLVQVILMGTVEGYRVNGGPAGEGLDKLYPGGDFFDPLGLADDPDTFAELKVKEIKNGRLAMFSMFGFFV

SEQ ID NO: 20750 - protein, 249 aa, Scenedesmus obliquus
MAFALKQAVATKAAATRATRQVTRAAIEWYGPDRPKFLGPFSEGDTPAYLTGEFAGDYGWDTAGLSADPQTFAKYREIEVIHARWAMLGALGCITPELLAKNGVPFGEAVWFKAGAQIFQDGGLNYLGNENLVHAQSILATLAVQVLLMGAAESYRANGGAPGGFGEDLDSLYPGGAFDPLGLADDPDTLAELKVKEIKNGRLAMFSMFGFFVQAIVTGQGPIANLDAHLSDPSGNNAWNYATKFVPGN

SEQ ID NO: 20751 - protein, 294 aa, Glycine max
MEKGRTVVVSALQFACTDDISTNVATAERLVRAAHKQGANIILIQELFEGYYFCQAQREDFIQRAKPHKDHPTILRMQKLAKELGVVIPVSFFEEANNAHYNSIAIIDADGTDLGIYRKSHIPDGPGYEEKFYFNPGDTGFKVFQTKLAKIGVAICWDQWFPFFFRAMVLQGAEILFYPTAIGSEPQDGSIDSRDHWKRVMQGHAGANLVPLVASNRIGKEIIETEHGKSEITFYGNSFIAGPTGEIISTADDKDEAVLIAQFDLDKIKSMRHCWGVFRDRRPDLYKVLFTLDG

SEQ ID NO: 20752 - protein, 452 aa, Wolinella succinogenes
MAENQDYASGNGGIKALLLNFIHSQSFSGIFLFFCAVVAMISANSALSESYFHLWHTEIGFFIGETFIGMSLHHWINDVLMSFFFLMVGLEIKRELLFGELAGIKRAAFPAIAALGGMIVPAIVYTLFNFGTDSAHGFGIPMATDIAFALGVLLLLGDKVSLALKVFLVSLAVVDDLGAVVVIAIFYTEDLQTLWLLYSVVILGLLIGLNKMGVRSLFPYAILGVLLWITVHNCGIHATIAAVALAFTIPVKPKIESENFAQEAKELLERFLSHDKERANLLLASEQVHSVELLSKHSKSVQSPLVRLEHALHPWSAYFIMPVFAFANAGVAISSNIHFDIDGVLPGIMLGLIVGKPVGILGLTYLAEKMGIATRPEGVMWIDILGAGMLAGIGFTMSIFITNLAFTNPEATDVAKIAILSASLFAGALGYFFISIRCRFKKKKEACCTIKS

SEQ ID NO: 20753 - protein, 248 aa, Scenedesmus obliquus
MAFALKQAVATKAAATRATRQVTRAAVEFYGPDRAKFLGPFTPESDYLTGEFPGDYGWDTAGLSADPQTFSRYREVEVIHARWAMLGALGCITPELLAKNGVPFGEAVWFKAGAQIFQDGGLNYLGNENLVHAQSILATLAVQVILMGAAEAYRANGGAPGGFGEDLDSLYPGGKFFDPLGLADDPDTLAELKVKELKNGRLAMFSMFGFFVQAIVTGQGPIANLDAHLADPSGNNAWNFATKFVPGN

SEQ ID NO: 20754 - protein, 219 aa, Unknown
  uncultured bacterium
NSRLCMSSAVAGYTRSLGSDGPPCSYEDLDHCSVAFLIGTNMAECHPVLFQRLLKRKRKNPGSVNIIVVDPRRTDTAKAADIHLPIAPGSDLALLHGIAHLVLRENGQDPAFIDDHTENYDAFFDVAARWTPRRVARFCNIPEKRLREVAALFHRREKVLSLWSMGVNQRREGTAVVQGLINLHLLTGQIGKQGAGPFSLTGQPNAMGGREAGGLAHLL

SEQ ID NO: 20755 - protein, 379 aa, Treponema denticola
MPASKRDYYEVLGVDKKASNDDIKKAYRKLAIKYHPDKNQGDKAAEEKFKEATEAYEILIDEKKRSMYDQFGHAGVDGMSGGGGYDPSAFQGFEDIFGGSFSDIFENLFGGGFSSRSSGFGGRHAGPVRGSNLRYDLQISFVDAVYGKKAELSYTRNEKCSECHGTGSESGSSKRMCPDCKGTGQVRQSTGFFSISRPCPTCGGEGSIIEKPCKKCGGNGLERKKQRIIVTIPAGVENGKRITIPSQGNAGQAGGDYGDLFVFIFVQAHPYFERNGIDLYCAVPISMTQAALGGEINIKSLDEKTLRLKIPAGTQNGKLLRIRGEGVPTGIGRKGDLYIQIQVQIPSKLSSNSKKLLQEISAIEGENENPNLIPLKDLP

SEQ ID NO: 20756 - protein, 239 aa, Triticum aestivum
TRPAQANGEEDDDANADDDLGSEDDEYSGSDEDDQEEHQEEGKEANKPTGKIAIALQRAVPPPKINPFDDKPKMKFGFEEEEEEVPNKKAKVAGKATDTRRSAIDDLMKEEEKAKERSNRKDYWLCPGIVVKVMSKSLAEKGYYKQKGLVKRVIDKYVGEIEMLESKHVLRVDQDELETVLPQIGGLVRIVNGAYRGSNARLLSVDTERFSAKLQVEKGLYDGKVLKAIEYEDICKVAQ

SEQ ID NO: 20757 - protein, 306 aa, Prunus dulcis
MGKEHALVISNHRSDIDWLVGWVLAQRSGCLGSSLAVMKKSSKFLPVIGWSMWFSEYLFLERSWAKDEGTLKSGVQRLKDFPQPFWLALFVEGTRFTQAKLLAAQEYAAATGLPVPRNVLIPRTKGFVTAVSQMRSFAPAIYDVTVAIPKSSPAPTMLRLFEGRPSVVHVHIKRHVMRDLPETDEAVAQWCKDIFVAKDALLDKHTVEQTFGDQQLKVTGRPLKSLLVVTAWACLLILGALKFLYWSSLLSSWKGIAFSALGLGVVTVLMQILIRFSQSERSTPAPVAPTNNKNKGESSGKPEKQQ

SEQ ID NO: 20758 - protein, 255 aa, Scenedesmus obliquus
MAFAVASRRSSVLVQAKKGGKAKAPAKRAAAAPSKGTEFYGPNRAKWLGPFSTATPGYLTGEFAGDYGWDTAGLSADPETFRRYRELELIHARWAMLGALGCITPELLAKNGVPFGEAVWFKAGAQIFQEGGLNYLGNSSLIHAQSILATLACQVILMGLVEGYRVNGGPAGEGLDPLYPGEAFDPLGLADDPDTFAELKVKEIKNGRLAMFSMFGFFVQAIVTGQGPIANLDAHLSDPSGNNAWNYATKFVPGN

SEQ ID NO: 20759 - protein, 219 aa, Unknown
  uncultured bacterium
NSRLCMSSAVAGYTRSLGSDGPPCSYEDLDHCSVAFLIGTNMAECHPVLFQRLLKRKRKNPGSVNIIVVDPRRTDTAKAADIHLPIAPGSDLALLHGIAHLVLRENGQDPAFIDDHTENYDAFFDVAARWTPRRAARFCNIPEKRLREVAALFHRREKVLSLWSMGVNQRREGTAVVQGLINLHLLTGQIGKQGAGPFSLTGQPNAMGGREAGGLAHLL

SEQ ID NO: 20760 - protein, 119 aa, Corynebacterium efficiens
MSCCLVFSTWTCNLNRRCIRIMCACRNLQWKNLKGPDESHSPGNVEDMAKEGAIEVEGRVVEPLPNAMFRVELDNGHKVLAHISGKMRQHYIRILPEDRVVVELSPYDLTRGRIVYRYK

SEQ ID NO: 20761 - protein, 453 aa, Mycoplasma penetrans
METVAVRDIFKNYKEFSNVKLVGWVRSNRDNGSIGFISFTDGSCIHSIQLVYKNGETNNFEEAKSTRTGSAILVEGVVVESKQPNQSFEIKVTNFILLKQADEDYPLQKKEHGAEFLRTIAHLRQRTNKYGTIMRLRSELAFAIHNFFHQNNFVWVSSPIITSNDAEGAGENFYVDSKTVKNFFGKNASLTVSGQMHAEAYAQSYKRVYTFGPTFRAEKSNTNRHVSEFWMVEPEIAFCNLEQLMYLIEEFVKYLIRFILKNCKDEMTFLNKLSNNTLSEKLLNAISHPFEKITYKKAIAILKSDVANKKVKFENESIYFGMDLNSEHEKYLCEKVFNKPLFIYDYPAEIKAFYMKMNADGTTVGACDLLMPGIGEIVGGSERESDYTKLVKKCTKANMKVEDIEWYLALRKYGYHKSAGFGLGFERFLMYVTECENVKDTIPFPRSYGSLDF

SEQ ID NO: 20762 - protein, 198 aa, Alkalilimnicola ehrlichei
MAWDEAERILSEADLIHDGQAVDRALDDLASQITERLEHTRPLILGVMIGGMVPAGMLLPRLGFPLQLDYVHATRYRGGLSGQNDLQWRAEPGTPVRDRVVLVVDDILDEGHTLAGIVEALQAQGAAEVLTAVLVNKLHQRKHPGLRADFVGLEVPDRYVFGVGMDYKGLCRNAPGIFAVREPAPATGDRAEAKEPTQ

SEQ ID NO: 20763 - protein, 432 aa, Exiguobacterium sibiricum
MKAMIRDVEKHVGEEITIGCWLANKRSSGKIVFLQLRDGSGFMQGVVVKETVGEELFKTAKGLTQETSMWVTGTIKSDGGRTAIGHEMEITTIEVIHEAVDYPITPKAHGTDFLMDNRHLWLRSKRQHAVMVVRNELIRATYEFFNQEGFIKVDPPILTGSAPEGTTELFHTKYFDEDAYLSQSGQLYMEAAAMALGKVFSFGPTFRAEKSKTRRHLIEFWMMEPEMAFYDHDMNLEVQENYVSHLVQSALKNCRPELELLERDLTVLENIQAPFPRVKYTEAIDMLKEQGFDDIEFGDDFGAPHETAIANTFARPVFITHWPKAIKPFYMKEDPENPGFVLCDDLIAPEGYGEIVGGSQREEDFEKLLAGMKEHDLDETGAYKWYLETRKYGSVPHSGFGLGLERTVAWITGVEHVRETIPFPRLLNRLYP

SEQ ID NO: 20764 - protein, 928 aa, Clostridium thermocellum
MITSIIAVPSYVSAEPEYNFAKALQLSLYFYDANKCGEGITGGRLEWRGDCHLEDKEVPLIPMTEDYFGTNMSQEYIDKYRHIFDPDGDGTVDLSGGMHDAGDHVKFGLPGTYAASTLGWGFYEFREAYEKVGVDDHAKEILRWFNDFYLKATFLDEDGNVIAYCYQVGEGNIDHNFWNPPELQSSKVLDSFARPAYFATPETPASDQCAGAAASLAINYLNFKDEDPEYAQRCLDTAIALYEFAKKYRGLGESGGFYGSSYDHDELAWAAVWLNIATGDMQYIDDIVATDSEGNYIGYMQRIIKDTTNTWQNIWVHCWDTVWGGVFAKLAPITNTERDWYIFRWNLEYWSGIPHENPNDTTFLAKSPGGFSVVNAYGSARYNTAAQLCALVYRKYTGRSDFADWAKSQMEYIMGNNPMNRCYIVGYSENSAKHPHHRAAHGSKTFSMLDPEEHRHTLWGALVGGPDLDDFHVDETTDYVYNEVAVDYNAAFVGACAGLYYYYGEALGHKPVPNFPPKEEAVEEYYVEGKIEQENKERTQVTIKIFNDTCHPPRFETGLMARYFFNISELLDAGQSIDDVKIEVYYDENKASYDGPAEVRGPIKYDDAGTYYVEVDWSGRIIYGKREIQLALISSLDSNYKSNWNPENDYSREGLGKEFVRTEKIPLYLNGVKVFGNEPPQIEPSPTPSDGPGSTPPPSQKPSLEVLYKYGDTTAATKDIRGSIKIKNTGTKPVNLSDVKVRYWFTKDGASSQEFVCDYAHLSESMITAKFVDLENPVENADNYLEIGFDSNAGILGPGSDTGEIQFRIVKGDYESYDQSNDYSCMATAKDFTANPNITAYVNSVLVYGNPPVDEEEEIEIVYGDLNGDGRVNSTDLLLMKKRIIREIDKFNVPDENADLNLDGKINSSDYTILKRYVLKSIEKLPVK

SEQ ID NO: 20765 - protein, 240 aa, Ostreococcus tauri
MRAIGTTCAATARALRRASTSADVARADRARDRRPRPRDGDRRERHHRWTSSTAYGASTPPPRSWDDGARRDDGRAPPPTTFVDFGVYKTRGAMKMKAVRPTLGALGENAVVRRPGGVLLELANATAPRTYDWQNKGSFMLSGTEAAELADRMAANGSCSFFHDSAKANGGGGGTLGKAFKVEPMPDGSGGMFVNLTVTLSENRGQQRFSVPVSYGESAAIRQLLVYLVPRVLGFDEVFK

SEQ ID NO: 20766 - protein, 957 aa, Ralstonia metallidurans
MNARDDFDYGTPASDAETQVTLEIDGVSVTVPAGTSVMRAAAEAGVGVPKLCATDSLKAFGSCRLCLVEIEGRRGYPASCTTPVEAGMKVRTQSEKLGDLRRGVMELYISDHPLDCLTCPTNGNCELQDMAGVVGLREVRYNDGAGTAPPIATHTHLAKDESNPYFTYDPSKCIVCNRCVRACEETQGTFALTISGRGFDSRVAAGTSQPFMESDCVSCGACVQACPTATLTETSVIQLGQASHSKITTCAYCGVGCSFKAEMKGNEVVRMVPYKDGAANEGHACVKGRFAWGYATHKDRILKPMIRARITDPWREVSWEEAIGYAASQFRRIQAEHGKDSIGGIVSSRCTNEEGYLVQKLVRAAFGNNNVDTCARVCHSPTGYGLKTTIGESAGTQTFRSVAKADVIMVIGANPTDGHPVFASRMKRRLRAGARLIVVDPRRIDLVESPHIRADYHLQLRPGTNVAVVTSIAHVIVTEGLLAEQFIAERCEDRAFQQWRDFVALPENSPEALEAETGVPAEQLRGAARLYATGGNAAIYYGLGVTEHAQGSTTVMAIANLAMATGNIGREGVGVNPLRGQNNVQGSCDIGSFPHELPGYRHVSDSTVRGSFEAAWNVEINPEPGLRIPNMFEAAITGSFRGLYCQGEDIVQSDPNTQHVAEALSSMECIVVQDIFLNETAKYAHVFLPGSSFLEKDGTFTNAERRISRVRKVMPPKAGYSDWEATILLSNALGYPMHYNHPSEIMDEIARLTPTFAGVSYKKLEELGSIQWPCNAEAPEGTPTMHVDTFVRGKGKFIITKYVPTSEKVNRKYPLILTTGRILSQYNVGAQTRRTHNVHWHDEDRLEIHPHDAEERGIKDGDWVGIQSRAGETVLRAIVSERMQPGVVYTTFHFPESGANVITTDNSDWATNCPEYKVTAVQVMPVAQPSTWQRNYHAFNEEQLAHLRAAGEPTPTR

SEQ ID NO: 20767 - protein, 219 aa, Unknown
  uncultured bacterium
NSRLCMSSAVAGYTRSLGSDGPPCSYEDLDHCSVAFLIGTNMAECHPVLFQRLLKRKRKNPGSVNIIVVDPRRTDTAKAADIHLPIAPGSDLALLHGIAHLVLRENGQDPAFIDDHTENYDAFFDVAARWTPRRVARFCNIPEKRLREVAALFHRREKVLSLWSMGVNQRREGTAVVQGLINLHLPTGQIGKQGAGPFSLTGQPNAMGGREAGGLAHLL

SEQ ID NO: 20768 - protein, 294 aa, Geobacter metallireducens
MSKLTVGLVQQSCTSDKDLNLAKSIENIRKASALGAKLVVLQELHCGPYFCQNEDTGHFDLAEEIPGPTTELLGGVAREFGVVLVSSLFEKRASGIYHNTAVVFEKDGSIAGKYRKMHIPDDPGYYEKFYFTPGDLGFEPIRTSVGKLGVLVCWDQWYPEAARLMALAGADLLIYPTAIGWDPRDEDEEKVRQKEAWITIQRGHAVANGIPVVSVNRVGLEPDPSGVLPGSLFWGSSFVAGPQGEILTQASNDREELLSVELDLDRSEAVRRIWPFLRDRRIDAYQDLLKRYRD

SEQ ID NO: 20769 - protein, 508 aa, Shewanella oneidensis
MQNHSNLNDIGVIGLGVMGKNLALNIADNQYRVSVFDLDPVKVNGVLQQEKQERVGQELRITGCANLSEMLASLTKPRILVLSVPAGAPVDGVCAALISAGIEADDIVIDTGNSLWTDTVEREQHYQGQFIFFSSAVSGGEVGARFGPSLMPSGDLGAWQHVAPIWKAIAAKVNPQTGLPIERFEPGNPVTEGEPCTTYIGPAGAGHYVKMVHNGIEYADMQLICEAYQLLHDGLGMSAAEVGEVFERWNQGSLNSYLMGISAEVLKQADPLTGKPLVEMILDKAGQKGTGLWTAVSSLQIGCPAPTIAEAVYARAVSTQKSLRVELSKKLAGPLSPAMDENQKANLIDALESALYCAKVCCYAQGFQLMAMTALEQKWQLDFAEIAKIWRAGCIIRATFLQSITQAYQADANLSCLLMADTFASTLSEKQTEWRIAVAAAIMQGIPVPCISSALAYYDSYRSETLPANLLQGQRDFFGAHTFERLDKPAGEKYHLDWSAQERVLIKL

SEQ ID NO: 20770 - protein, 330 aa, Thermoanaerobacter tengcongensis
MKIAVLGAGSWGTAIAIHLNKLNHQVRLWMRSKEQFEELIATRHNSRYLDVDLPSSILLYNDLDKAVEDSEVVVIAVPSHAVREVSEKLKGKISKNAIVVNLAKGIETSSLKRMSEVIKEYLLNPVVVLSGPSHAEEVVRQIPTACVLASEDVKACEFIQEAFMNETFRLYVNTDVIGVELGGALKNIIALGAGISDGLGFGDNTKAALMTRGLAEITRLGVAMGSDPLTFLGLAGVGDLIVTCTSNYSRNRRAGILIGKGKSLKEALKEIGMVVEGVNTTKSAYRLSQIYGVEMPITKEIYSIIFENKNPFEAVYNLMTRDKKHELHGI

SEQ ID NO: 20771 - protein, 507 aa, Ralstonia metallidurans
MPESQVPPAASGAPTAATAVAAAPKLNIHWGLYAAVVVLIAVLLIPMPADLPVAGQRMLAILAFAVVVWITEAVTYETSAIMITSLMAGLIGFAPMVNDPNTLYGTSRALGMALAGFSNTALALVAAALFISAAMTVTGLDRRIALVTLSAIGTSTRRILIGTIAVTILLSLVVPSATARSACTVPIMMGVIAAFGVDKKSNIAAGIMIMVAQATSVWNVGIQTAAAQNLLTAGFMDKLLGERVTWLQWLIAGAPWAIVMSIVLYFLVRWLLPPETDAIAGGKEAVQRELAALGPMTGPQKRLAAVAIGLLLFWATEGKLHKFDTASITFVGLVILMLPRIGVMDWKTMQQRTPWGTLIVFGVGISLGTALLTTQAGQWLGKFVVTHSGLANHGTLLVFAVLAAFLILIHLGFASATALTSAMLPILISVLQTIPGDMNKVGMTMLLGFTVSFGFILPINAPQNMVCLGTDTFNGRQFARIGIPTTIIGYLLMLLFASTYWRWLGWI

SEQ ID NO: 20772 - protein, 633 aa, Musa acuminata
MEGCDCIEPQWPADELLVKYQYISDFFIALAYFSIPLELIYFVKKSSFFPYRWVLIQFGAFIVLCGATHMINLWTFTMHSRTAALVMTVAKISTAVVSCATALMLVHIIPDLLSVKTRELFLKNKAEELDREMGIIRTQEETGRHVRMLTHDIRSTLDRHTILKTTLVELGRTLDLAECALWMPSRSGLNLQLSHTLHHQMPLGSVVSINLPVVNQVFSSNRAVRIPHTCPLARIRPQTGRYVPPEVVAVRVPLLHLSNFQINDWPELSAKSYAIMVLMLPSDSARKWHIHELELVEVVADQVAVALSHAAILEESMRARDLLMEQNVALDSARREAEMAIRARNDFLAVMNHEMRTPMHAVIALSSLLLETELTPEQRLMIETVLKSSNLLAALINDVLDLSKLEDGSFELEIANFNLHAVFREVINLIKPIAAVKKLSVSVTLAPDLPLCAVGDEKRLMQTILNVAGNAVKFTKEGHISITASVARSDSSRDPRAPEFSPVTSDRHFDLRVQIKDSGCGISPQDLPHIFTKFAHSRNSANKASNGSGLGLAICRRFVNLMEGQMWLESEGIGKGCTATFIVKLGICDPSGNLQQILQTTPSHGDANLPGPRAKFDDENGKFTPMMRYQRSV

SEQ ID NO: 20773 - protein, 191 aa, Zea mays
MGFSEAQEELVLRSWKAMKSDSESTALKFFLRIFEIAPGAKQMFSFLRDAGDAPLEKHPKLKAHAVTVFVMACESATQLRSTGDVKVREATLKRLGATHARAGVADAHFEVVKTALLDTIRDAVPDMWTPEMKAAWEEAYDQLAAVIKEEMKNAAAAEEQTKNAATAEEEIKNAAAAEEETTNAAAAVDGS

SEQ ID NO: 20774 - protein, 656 aa, Burkholderia pseudomallei
MCGITGFVGPVACAPQTARATLARMTDSLAHRGPDDTGLWIDHDAGVALGHRRLSIVDLSEHGHQPMLSACGRYAMTFNGEIYNFRALRSELEREHRAPEWRGHSDSEVLLAAFCAWGVDRALQKAVGMFALALWNRESRVLTLARDRIGEKPLYYGRIGGSFVFGSELKALRRFPGFDAHPIDRDALCLYLRHASVPAPYTIYEGIRKLPPGTYAQFEDLAEAPAPRRYWSLERAIAAGRANPFDGDANAAVAQLDHVLRDAIAEQSVADVPLGAFLSGGVDSSVIVALMQTQTAQPVQTFTIGFHEAGYDEAGYAKAVARHLGTSHTELYVKPADVLATVPRMPCVYDEPFADSSQIPTLLVSELTRRHVKVSLSGDGGDELFGGYTRYFLTPRLWGRLRRVPAAVRMRIAAALHALRPDHADQIASLVQGAWSASAQRDASPRVGDRLHKLANVMTADSRASLYRLLMSSVHHPERFTLAGHEPQTLIDTPGAWPPGLSFAEQAMAVDTLTYLPTDILTKVDRAAMAVSLETRMPFLDYRVVEFAWRLPEALRIPDGQDKWLLRKLLYRYVPRPLIDRPKQGFCAPVGAWLRGELSDWAAELLRPARLRDEGYLDAARVERLWRQHQSGRMNWQHPLWTVLMFQAWLERQRAE

SEQ ID NO: 20775 - protein, 634 aa, Musa acuminata
MDGCDCIEPQWPADELLIKYQYISDFFIALAYFSIPLELIYFVKKSSFFPYRWVLMQFGAFIVLCGATHLINLWTFALHSKTLAIVMTVAKVSTAVVSCATALMLVHIIPDLLSVKTRELFLKNKAEELDREMGLIRTQEETGRHVRMLTHEIRSTLDRDTVLKTTLVELGRTLDLKDCMLWMPSHSGTSLQLSHTLHHQIPTGSAVPINLPVVNQIFSSNHAMIIPHTCRLARIWPLSVRHVPPEVAAVRVPLLHLSNFQMSDWSELSTKSYAVMVLILPSDSARKWHVHELELVEVVADQVAVALSHAAILAESMRARDLLTEQNVALYLARQEAELAIRARNDFLAVMNHEMRTPLHATITLSSLLLETELSPEQRSMVETVLKSSSLLATLINDILDLSRLEDGSLELEIGDFNLHSVFREVMNFIKPIAAVKKLQVSLMLSPDLPLYAIGDEKRLMQIMLNVAANAVRFTKEGDISLTASVARTDYLRDFRALDFYPVASDGHFYLRVQIKDTGCGISYQDLPNLFTKFSQSQNVSSQGYSGNGLGLAICERYVSLMQGHIWVESDGIGKGCTATFVVRLRLCENPDGSQQKILPLPWKKQTQKFSSSRGMPTDPGGLIRLKTRYQKSV

SEQ ID NO: 20776 - protein, 635 aa, Musa acuminata
MENCDCIEPQWPADELLIKYQYISDFFIALAYFSIPLELIYFVKKSSFFPYRWVLIQFGAFIVLCGATHLINLWTFTVHSKTLAIVMTIAKVSTAVVSCATALMLVHIIPDLLSVKTRELFLKNKAEELDREMGLIRTQEETGRHVRMLTHEIRSTLDRDTILKTTLVELGRTLGLEECALWMPSRNGSSLYLSRTLHHQLPTGSTVPINLPVVNQIFSSNHAMIIPHTCQLAKIRPSSGRYVPPEVAAVRVPLLHLSNFQINDWSELSAKSYAVMVLILPSDSARKWHVHELELVEVVADQVAVVLSHAAILEESMRARDLLMEQNVALDYARQEAELAIRARNDFLAVMNHEMRTPLHAIITLSSLLLETELNPEQRSMVETVLKSSSLLATLINDILDLSKLEDGSLELEIGIFNLHSVFREVVNFIKPIAAVKKLSVSLTLSPDLPLCAIGDEKRLMQILLNIVGNAVKFTKEGHISLTASVARADYLRDFRASEFYPVSSDGHFYLRVRVKDTGCGISSQDLPHLFTKFAPGRNVASRGFSGSGLGLAICKRYVSLMQGHIWLESEGIGKGCMATFVVKLGICENPDGSQQKIVLLPWTKHGQEDTSSSRGMPKDPKAFIPLKPRYQRSV

SEQ ID NO: 20777 - protein, 456 aa, Securigera parviflora
MCGILAVLGCSDDSQAKRVRVLELSRRLKHRGPDWSGLHQHGDCFLAHQRLAIVDPASGDQPLFNEDQSIIVTVNGEIYNHEELRKQMPNHKFRTGSDCDVIAHLYEEHGENFVDMLDGIFSFGLLDTRDNSFIVARDAIGVTSLYIGWGLDGSVWIASELKGLNDDCEHFETFPPGHLYSSKEREFRRWYNPPWFSESIPSAPYDPLALRQAFEKAVVKRLMTDVPFGVLLSGGLDSSLVASITARHLADTKAAKQWGAKLHSFCVGLEGSPDLKAGKEVADYLGTVHHEFQYTVQDGIDALEDVIYHIETYDVTTIRASTPMFLMSRKIKSLGVKWVISGEGSDEIFGGYLYFHKAPNKEELHKETCRKIKALHKYDCLRANKSTFAWGLEARVPFLDKEFINVAMNIDPENKMIKLDEGRIEKWILRKAFDDEENPYLPKHILYRQKEQFSDG

SEQ ID NO: 20778 - protein, 176 aa, Unknown
  Halobacterium sp. NRC-1
MSEKPASMYRKIDKPSYTRRDYVTGIPGSKIAQHKMGDLQADADDYPVQISLVPQEECQLRHGSLEAARLSANRHLIKELGEGNYKMQLRKFPHQIIRENKQATGAGADRVSDGMRQAFGVPVGTAARIQPGDQLFTAYCEVEQAAAVKEAFRRAYNKITPPCKINVERGETLLVR

SEQ ID NO: 20779 - protein, 378 aa, Streptomyces coelicolor
MATDYYAVLGVRRDASQDEIKKAFRRLARELHPDVNPDPKTQERFKEINAAYEVLSDPQKKQVYDLGGDPLSQAAGGGAGGFGAGGFGNFSDIMDAFFGTASQRGPRSRTRRGQDAMIRIEVELDEAAFGTTKDIQVDTAVVCNTCNGEGAAPGTSAQTCDMCRGRGEVSQVTRSFLGQVMTSRPCPQCQGFGTVVPTPCPECAGDGRVRSRRTLTVKIPAGVDNGTRIQLAGEGEVGPGGGPAGDLYVEIHELPHSTFQRRGDDLHCTVTIPMTAAALGTKVPLETLDGMEEVDIRPGTQSGQSIPKHGRGVTHLRGGGRGDLIVHVEVTTPGKLDPEQERLLRELAKLRGEERPTGQFQPGQQGLFSRLKDAFNGR

SEQ ID NO: 20780 - protein, 752 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQLLVFDRYEKGTAVSK

SEQ ID NO: 20781 - protein, 162 aa, Parasponia andersonii
MSSSEVNKVFTEEQEALVVKAWAVMKKNSAELGLQFFLKIFEIAPSAKNLFSYLKDSPVPLEQNPKLKPHATTVFVMTCESAVQLRKAGKVTVKESDLKRIGAIHFKTGVVNEHFEVTRFALLETIKEAVPEMWSPEMKNAWGVAYDQLVAAIKFEMKPSST

SEQ ID NO: 20782 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQDCYSVRSNDANTLQ

SEQ ID NO: 20783 - protein, 538 aa, Triticum aestivum
MGYQVVAAQLARLSGALGTSDHASVVSITLFVALLCACIVLGHLLEENRWLNESITALIIGLCTGVVILMTTKGKSSHVLVFSEDLFFIYLLPPIIFNAGFQVKKKQFFRNFMAITLFGAVGTMMSFFTISLAAIAIFSRMNIGTLDVSDFLAIGAIFSATDSVCTLQVLNQDETPFLYSLVFGEGVVNDATSVVLFNALQNFDPNQIDAIVILKFLGNFCYLFVSSTFLGVFTGLLSAYVIKKLYIGRHSTDREVALVMLMAYLSYMLAELLDLSGILTVFFCGIVMSHYTWHNVTESSRVTTKHAFATLSFIAETFLFLYVGMDALDIEKWKFASDSPGKSIGISSILLGLVLVGRAAFVFPLSFLSNLTKKTELEKISWRQQIVIWWAGLMRGAVSIALAYNKFTRSGHTQLHGNAIMITSTITVVLFSTMLFGILTKPLIRFLLPASSNGAASDPASPKSLHSPLLTSQLGSDLEAPLPIVRPSSLRMLITKPTHTIHYYWRKFDDALMRPMFGGRGFVPYSPGSPTDPNVLVE

SEQ ID NO: 20784 - protein, 160 aa, Debaryomyces hansenii
MSFYDLSPLDTNDKPFPFEELKGKVVLVVNVASKCGFTPQYKELEELNKKYQDKGLQIIGFPCNQFGGQEPGSSEEIASFCSLNYGVSFPVLKKVDVNGDKTDPVYKYLKGEKLGLLGLNRIKWNFEKFLIDKNGKVIERYSSLTKPASLLSTIEELLKK

SEQ ID NO: 20785 - protein, 745 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQHTSPVDLS

SEQ ID NO: 20786 - protein, 318 aa, Unknown
  Oceanospirillum sp. MED92
MSEVQHHELIILGSGPAGYTAAVYAARANLNPVVITGMQAGGQLTTTTEVDNWPGDVDGVQGPELMQRMQQHAERFDTQIIFDHINETDLQNRPFRLKGDMGEYTCDALIICTGASAQYLGLPSEEEFAGKGVSACATCDGFFYRGQKVAVVGGGNTAVEEALYLSNIAEEVTLIHRRDSLRSEKILQDKILERAENGNINIIWNHTLEEVLGDDMGVSGLRLKSTTDGEEQQLDVAGVFIAIGHKPNTDIFQGQLDMTDGYLKIQSGLEGNATQTSVEGVYAAGDVCDHIYRQAITSAGFGCMAALDAERYLDDLKK

SEQ ID NO: 20787 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQGSIYNRSIKGEALQ

SEQ ID NO: 20788 - protein, 537 aa, Enterococcus faecalis
MDQWWKNAVGYQIYPRSFKDSNGDGIGDLQGIIEKLPYLKELGVDFLWLNPIYTSPNVDNGYDIADYQGIQPEFGTMEDFQELLDQAHQLGLKIILDLVVNHTSDQHPWFVEAKKSLDNPYREYYLWADATPDRMPNEWQSFFGGSTWTYDEGTKQAYFHVFAKEQPDLNWKNPKVREEIYAMIRWWLDLGIDGFRLDAISHIQKEPWDFKITTNPWAPFMNVKGIEDYMLDLKVIFAEYDIMTVGEASGVSSKKAVEWTNDAGYLNMIFELEHNVREGKPGEERLNILGYKKVMARWQKHLGTEGWNALYVENHDNPRINSILGNETSHSAKAIGTIALLLRGTPFIYQGQEIGMVNYPFQQIDELDAKDSHNHYRLLIESGYDAKQALKEVAHWTRDHSRTPMQWTSQEASSFTSGHPWLAIHPNFKEINVADQETDAQSVLNYYKKLIALRKDNPVFTDGQFELLAPNHPSVFAFLRKTTEATALVIVNLSGEKCQFDLPNKLLGRKWQQLLGNQDFTVKKRMQLAPYQAGVFQ

SEQ ID NO: 20789 - protein, 250 aa, Scenedesmus obliquus
MAFAVMQRRALNVQAKASKKGTTKAAPKKAAKAASSGTSWYGPERAKWLGPFSTNTPGYLTGEFAGDYGWDTAGLSADPETFRRYRELELIHARWAMLGALGCITPELLAKNGVPFGEAVWFKAGAQIFQEGGLNYLGNSSLIHAQSILATLACQVILMGLVEGYRVNGGPAGEGLDPLYPGEAFDPLGLADDPDTFAELKVKEIKNGRLAMFSMFGFFVQAIVTGQGPIANLDAHLSDPSGNNAWNYAT

SEQ ID NO: 20790 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQDIVLARSAAIASLQ

SEQ ID NO: 20791 - protein, 489 aa, Candida glabrata
MSADFGLIGLAVMGQNLILNIADHGYTVVAYNRSVDKVHQFLDNEAKGKSIIGAESIEDLVAKLKRPRKIMMLVKAGAPVDGLIAQLVPHLEKGDIIIDGGNSHFPDSNRRYEELKAKGILFVGSGVSGGEDGARYGPSLMPGGAEEAWPHIKEIFQSISAKSDGEPCCDWVGPAGSGHYVKMVHNGIEYGDMQLICEAYDIMKRIGGFTDKEISEVFGKWDTGVLDSFLVEITTNILKKDDVDGKPLVEKIMDSAGQKGTGKWTAINALDLGMPVSLIGEAVFARCLSALKCERVKASKTLPGPEIPKDLIKDRQQFIDDLEQALYASKIISYAQGFMLIREAAKTYGWKLNNPAIALMWRGGCIIRSVFLGEITKAYRENPDLENLLFHKFFKDAVTKAQGGWRRSLALAATYGIPSPAFATALSFYDGYRSERLPANLLQAQRDYFGAHTFRVLPECASDSLPKDKDIHINWTGHGGNVSSTTYDA

SEQ ID NO: 20792 - protein, 72 aa, Unknown
  Oceanospirillum sp. MED92
MAKEDSIEMEGTVIDTLPNTMFRVELENGHVVTAHISGKMRKNYIRILTGDKVKVELTPYDLSKGRIVYRAR

SEQ ID NO: 20793 - protein, 848 aa, Brassica oleracea
YHHSYTFSFLLVFLVLILFHPALSIYVNTLSSSESLTISSNRTLVSPGGVFELGFFKPLGRSRWYLGIWYKKVSQKTYAWVANRDSPLTNSIGTLKISGNNLVLLGQSNNTVWSTNITRGNARSPVIAELLPNGNFVMRYSNNKDPSGFLWQSFDFPTDTLLPEMKLGYDLKTGRNRFLTSWKGSDDPSSGNFVYKLDIRRGLPEFILINTFLNQRVETQRSGPWNGIEFSGIPEVQGLNYMVYNYTENSEEIAYSFHMTNQSIYSRLTLTEFTLDRFTWIPPSWGWSLFWTLPTDVCDPLYLCGSYSYCDLITSPNCNCIRGFVPKNPQQWDLRDGTQGCVRTTQMSCSGDGFLRLNNMNLPDTKTATVDRTIDVKKCEERCLSDCNCTSFAIADVRNGGLGCVFWTGELIAIRKFAVGGQDLYVRLDAADLDISSGEKRDRTGKIIGWSIGVSVMLILSVIVFCFWRRRQKQAKADATPIVGNKVLMNEVVLPRKKRDFSGEEEVENLELPLMEFEAVVTATEHFSDFNKVGKGGFGVVYKGRLVDGQEIAVKRLSEMSAQGTDEFMNEVRLIAKLQHYNLVRLLGCCVYEGEKILIYEYLENLSLDSHLFDETRSCMLNWQMRFDIINGIARGLLYLHQDSRFRIIHRDLKASNVLLDKDMTPKISDFGMARIFGRDETEADTRKVVGTYGYMSPEYAMNGTFSMKSDVFSFGVLLLEIISGKRNKGLCDSDSSLNLLGCVWRNWKEGQGLEIVDRVIIDSSSPMFRPREISRCLQIGLLCVQERVEDRPMMSSVVLMLGSEAALIPQPKQPGYCVSGSSLETYSRRDDENCTVNQITMSIIDAR

SEQ ID NO: 20794 - protein, 149 aa, Oryza sativa
MVMCDTYTPAGEPIPTNKRNRAAQVFSDPKVVSQVPWFGIEQEYTLLQRDVNWPLGWPVGGYPGPQGPYYCAVGSDKSFGRDISDAHYKACLYAGINISGTMESSCLVSLNPAQPIHFSAHAQQELDILHGYQKLQESRCPVFVKYSLY

SEQ ID NO: 20795 - protein, 109 aa, Solibacter usitatus
MAGQNTLTFSDSTFDEDVLRSDVPVLVDFWAEWCGPCRQMSPTIDVVAGEYAGKVKVGKLDVDANGGTAMRYNVRGIPTLLLFKGGQVVEQRVGAIGKSDVLKMIDAHV

SEQ ID NO: 20796 - protein, 219 aa, Unknown
  uncultured bacterium
NSRLCMSSAVAGYTRSLGSDGPPSCYEDLDHCSVAFLIGTNTAECHPVLFQRLLKRKKRNPGSITIVVVDPRRTDTAKAADIHLPIAPGSDLALLHGIAHLVLRENGQDTAFIDDHTENYHAFFDIAARWTPRRVARFCNIPEKRLRDVAQLFHRRERLLSLWSMGVNQRREGTAVVQGIINLHLLTGQIGKEGAGPFSLTGQPNAMGGREADGLSHLL

SEQ ID NO: 20797 - protein, 625 aa, Oryza sativa
MASISGAAAPPSSSAACRLRLRRQLLLRPSHLRLRAPHSIADLSRSSSSSSEQQPSSTPAAPLASRPGQNGSTRGAVEKDPIKLWERYVEWLYQHKELGLFVDVSRMGFTEEFLRRMEPRMQRAFAAMRELEKGAIANPDEGRMVGHYWLRDPGLAPNSFLRTKIETTLDRILAFSQDVVSGKIKPPSSPAGRFTQILSIGIGGSALGPQFVSEALAPDNPPLKIRFIDNTDPAGIDHQIAQLGPELASTLVIVISKSGGTPETRNGLLEVQKAFRDAGLDFSKQGVAVTQENSLLDNTARIEGWLARFPMFDWVGGRTSEMSAVGLLPAALQGIDIKEMLVGAALMDEETRNTVVKENPAALLALCWYWASEGIGNKDMVVLPYKDSLLLLSRYLQQLVMESLGKEFDLDGNRVNQGLTVYGNKGSTDQHAYIQQLREGVHNFFVTFIEVLRDRPPGHDWELEPGVTCGDYLFGMLQGTRSALYSNDRESISVTVQEVTPRAVGALVALYERAVGIYASLVNINAYHQPGVEAGKKAAGEVLALQKRVLTVLNEASCKDPAEPLTLDQIAERCHCPEDIEMIYKIIQHMAANDRALIAEGSCGSPRSIKVYLGECNVDEDMLAA

SEQ ID NO: 20798 - protein, 111 aa, Zea mays
MLRWGQNSIIFLINNGGYTIEVEIHDGPYNVIKNWNYTGLVEAFHNGEGACYTAKVRTEEELTEALEAALGPKKDCLCFIEVIVHKDDTSKELLEWGSRVSAANSRPPNPQ

SEQ ID NO: 20799 - protein, 244 aa, Arabidopsis thaliana
MTESSIISVKQSSPVPEEEDHHHHQQDSHRTNTKKRVRSDPGYRGVRMRTWGKWVSEIREPRKKSRIWLGTFSTPEMAARAHDAAALTIKGTSAVLNFPELATYLPRPASSSPRDVQAAAAVAAAMDFSPSSSSLVVSDPTTVIAPAETQLSSSSYSTCTSSSLSPSSEEAASTAEELSEIVELPSLETSYDESLSEFVYVDSAYPPSSPWYINNCYSFYYHSDENGISMAEPFDSSNFGPLFP

SEQ ID NO: 20800 - protein, 773 aa, Arabidopsis thaliana
MVKEIASWLLILSMVVFVSPVLAINGGGYPRCNCEDEGNSFWSTENILETQRVSDFLIAVAYFSIPIELLYFVSCSNVPFKWVLFEFIAFIVLCGMTHLLHGWTYSAHPFRLMMAFTVFKMLTALVSCATAITLITLIPLLLKVKVREFMLKKKAHELGREVGLILIKKETGFHVRMLTQEIRKSLDRHTILYTTLVELSKTLGLQNCAVWMPNDGGTEMDLTHELRGRGGYGGCSVSMEDLDVVRIRESDEVNVLSVDSSIARASGGGGDVSEIGAVAAIRMPMLRVSDFNGELSYAILVCVLPGGTPRDWTYQEIEIVKVVADQVTVALDHAAVLEESQLMREKLAEQNRALQMAKRDALRASQARNAFQKTMSEGMRRPMHSILGLLSMIQDEKLSDEQKMIVDTMVKTGNVMSNLVGDSMDVPDGRFGTEMKPFSLHRTIHEAACMARCLCLCNGIRFLVDAEKSLPDNVVGDERRVFQVILHIVGSLVKPRKRQEGSSLMFKVLKERGSLDRSDHRWAAWRSPASSADGDVYIRFERNVENDDSSSQSFASVSSRDQEVGDVRFSGGYGLGQDLSFGVCKKVVQLIHGNISVVPGSDGSPETMSLLLRFRRRPSISVHGSSESPAPDHHAHPHSNSLLRGLQVLLVDTNDSNRAVTRKLLEKLGCDVTAVSSGFDCLTAIAPGSSSPSTSFQVVVLDLQMAEMDGYEVAMRIRSRSWPLIVATTVSLDEEMWDKCAQIGINGVVRKPVVLRAMESELRRVLLQADQLL

SEQ ID NO: 20801 - protein, 334 aa, Prochlorococcus marinus
MSKNIKGLVLITGTTSGVGLNTLKPLLRFGWEVIAVNRSNKRAIKIAEESLTKEEVKNVHFIEIDLSNLDDVRKGCDEILERFKKPINSLICNAAVYKPRLKRPERSPQGFENSMAVNHFGHFLMINLLMENILSSEREIVLNGKSTLFKPRITVLGTVTANYSELGGRIPIPAPADLGDLSGFKNGFLSPISMANGKKFKPGKAYKDSKLCNMVTVQELSKRYPAEEIIVNSLYPGCVADTKLFRDTPWLFRFLFPIFQKFITRGYVSQRLAGERVAKVATYKEFAKPSVHWSWGNRQKTGRKAFSQKLSKRIIDANTSKKTYDLTKLLVGLD

SEQ ID NO: 20802 - protein, 363 aa, Solanum tuberosum
MATTQIAVIVLLGLLVATNIHITEAQLGVCYGMMGNNLPSHSEVIQLYKSRNIGRLRLYDPNHGALNALRRSNIEVILGLPNVDVKHIASGMEHARWWVQKNVKDFWPDVKIKYIAVGNEISPVTGTSSLTSFQVPALVNIYKAIGEAGLGNDIKVSTSVDMTLIGNSYPPSQGSFRNDVRWFTDPIVGFLRDTRAPLLVNIYPYFSYSGNPGQISLPYALFTAPNVVVQDGSRQYRNLFDAMLDSVYAAMERTGGGSVGIVVSESGWPSAGAFGATQDNAATYLRNLIQHAKEGSPRKPGPIETYIFAMFDENNKNPELEKHFGLFSPNKQPKYNLNFGVSERVWDISAETNSTTSSLISEM

SEQ ID NO: 20803 - protein, 520 aa, Bacillus megaterium
MKGKKWTALALTLPLAASLSTGVDAETVHKGKAPTADKNGVFYEVYVNSFYDANKDGHGDLKGLTQKLDYLNDGNSHTKNDLQVNGIWMMPVNPSPSYHKYDVTDYYNIDPQYGNLQDFRKLMKEADKRDVKVIMDLVVNHTSSEHPWFQAALKDKNSKYRDYYIWADKNTDLNEKGSWGQQVWHKAPNGEYFYGTFWEGMPDLNYDNPEVRKEMINVGKFWLKQGVDGFRLDAALHIFKGQTPEGAKKNILWWNEFRDAMKKENPNVYLTGEVWDQPEVVAPYYQSLDSLFNFDLAGKIVSSVKAGNDQGIATAAAATDELFKSYNPNKIDGIFLTNHDQNRVMSELSGDVNKAKSAASILLTLPGNPYIYYGEEIGMTGEKPDELIREPFRWYEGNGIGQTSWETPVYNKGGNGVSVEAQTKQKDSLLNHYREMIRVRQQHEELVKGTLQSISVDSKEVVAYSRTYKGKSISVYHNISNQPVKVSVAAKGNLIFASEKGAKKVKNQLVIPANRTVLIK

SEQ ID NO: 20804 - protein, 219 aa, Unknown
  uncultured bacterium
NSRLCMSSAVAGYTRSLGSDGPPCSYEDLDHCSVAFLIGTNMAECHPVLFQRLLKRKRKNPGSVNIIVVDPRRTDTAKAADIHLPIAPGSDLALLHGIAHLVLRENGQDPAFIDDHTENYDAFFDVAARWTPRRVARFCNIPEKRLREVAALFHRREKVLSLWSMGVNQRREGTAAVQGLINLHLLTGQIGKQGAGPFSLTGQPNAMGGREAGGLAHLL

SEQ ID NO: 20805 - protein, 528 aa, Unknown
  Nostoc sp. PCC 7120
MDAKALWQRYQEWLYFHEGLGLYLDVSRMRFDDAFVKSLLPKFDKAFADMAELEKGAIANPDENRMVGHYWLRNPDLAPTPEIAQEIVQTLEQIEAFAEKIQTGAIHPPKANRFTDIISIGIGGSALGPQFVAEALAPEFPPLKIHFIDNTDPAGIDRILTHLRNHLASTLVLVISKSGGTPEPRNGMIEVKKAYAGQNLDFAQYAVAITSTGSNLDKVAQSEGWLATFPMYDWVGGRTSEMSSVGLVPAALQGIDVRAMLEGAKEMDDATRVPEVKNNPAALLALSWYYSGNGKGEKDMVVLPYKDSLLLFSRYLQQLVMESLGKEKDLDGNTVYQGIAVYGNKGSTDQHAYVQQLREGVPNFFATLIEVLEDRHGASPEIDPGVTSGDYLSGFLLGTRQALYENQRDSITVTIPQVNARTVGALVALYERTVGLYASLVNINAYHQPGVEAGKKAAAVILDLQTKVVGLLQKEKTALSLEQIAEKIGAADQVEAIYKILRHLQANQRGVVFQGNLGQPSSLKISLS

SEQ ID NO: 20806 - protein, 307 aa, Zymomonas mobilis
MAKINTILEAIGNTPHLRLNKLFPDHEVWIKVEKSNPGGSIKDRIALAMIEDAEKSGKLKKGGVIIEPTSGNTGIGLAMVAAVKGYKLILVMPESMSIERRRLMLAYGAEFDLTPKEKGMAGAIERARQLAEETEGAWIPQQFENPANINIHATTTGQEILKDFADTPIDALVSGVGTGGHLTGIGESLRKKWPDIQIFAVEPATSPVLAGGKPGAHAIQGIGAGFVPKNLHRNILNGIVEIENDEAKKWALRAAKEEGLLVGISTGATLAAIAKKIKELPENSRILGVNYDTGERYLSVPDFLPEA

SEQ ID NO: 20807 - protein, 217 aa, Oryza sativa
MDDSHDLASPTSPDTASSSSSSTSTSSSSATVAPKKRPRNDGRHPTYRGVRMRSWGKWVSEIREPRKKSRIWLGTFATAEMAARAHDVAALAIKGRTAHLNFPDLAHLLPRPATAAPKDVQAAALLAAAAADFPSVSVDANAKSPENCSVASAASPQPPPPDAEADPDSTLFDLPDLLLDLRYETSSSLSCGASWAVDDDVAGGVVFRLEEPMLWDY

SEQ ID NO: 20808 - protein, 296 aa, Unknown
  uncultured bacterium
NSRLCMSSAVSGYLQSFGSDGPPCCYDDLDLTDCAFLIGTNTAECHPIVFNRLRKHHKRNPQVKLIVVDPRFTETAQVADLHLAIRPGTDITLQNGIGHLLLKWGALDQSFIHQSTQGFADYTEVLRHYEPSIVAERCGITEADLETAARTWAESQSVLSLWSMGLNQSSEGTAKVCSLINLHLLTGQIGRPGAGPFSLTGQPNAMGGREAGGLAHILPGYRLVKNPQHRQEIEQFWSLPEGQISPSRGLTIGEMIPALEHNQVGLLWIAATNPAVSLPDLNRTKAALQRSPFTVY

SEQ ID NO: 20809 - protein, 106 aa, Arabidopsis thaliana
  misc_feature (22)..(22): Xaa can be any naturally occurring amino acid
  misc_feature (47)..(47): Xaa can be any naturally occurring amino acid
  misc_feature (54)..(54): Xaa can be any naturally occurring amino acid
  misc_feature (62)..(62): Xaa can be any naturally occurring amino acid
  misc_feature (84)..(84): Xaa can be any naturally occurring amino acid
  misc_feature (93)..(93): Xaa can be any naturally occurring amino acid
MGRRAARCYREMKGGRYPKSRXCRGVTDAEIRIYDVGMKRKGVDEFXCCVHLVXWEKENVSXEALEAARIAGSKYMVKSGGKDXFHSRIRVHXYHVLRINRMVSVR

SEQ ID NO: 20810 - protein, 578 aa, Arabidopsis thaliana
MCGILAVLGCVDNSQAKRSRIIELSRRLRHRGPDWSGLHCYEDCYLAHERLAIVDPTSGDQPLYNEDKTIAVTVNGEIYNHKDLRENLKSHQFRTGSDCEVIAHLYEEHGEEFVDMLDGMFAFVLLDTRDKSFIAARDAIGITPLYIGWGLDGSVWFASEMKALSDDCEQFMCFPPGHIYSSKQGGLRRWYNPPWFSEVVPSTPYDPLVVRNTFEKAVIKRLMTDVPLGVLLSGGLDSSLVASVALRHLEKSEAACQWGSKLHTFCIGLKGSPDLKAGREVADYLGTRHHELHFTVQDGIDAIEEVIYHVETYDVTTIRASTPMFLMSRKIKSLGVKMVLSGEGSDEIFGGYLYFHKAPNKKEFHEETCRKIKALHQYDCLRANKSTSAWGVEARVPFLDKEFINVAMSIDPEWKMIRPDLGRIEKWVLRNAFDDEKNPYLPKHILYRQKEQFSDGVGYSWIDGLKDHANKHVSDTMLMNASFVFPDNTPLTKEAYYYRTIFEKFFPKSAARATVPGGPSVACSTAKAVEWDAAWSQNLDPSGRAALGVHVSAYGEDKTEDSRPEKLQKLAEKTPAIV

SEQ ID NO: 20811 - protein, 358 aa, Gibberella zeae
MASATRQFARAATRATRNGFAIAPRQVIRQQGRRYYSSEPAQKSSSAWIWLTGAAVAGGAGYYFYGNSASSATAKVFNPSKEDYQKVYNEIAARLEEKDDYDDGSYGPVLVRLAWHASGTYDKETGTGGSNGATMRFAPESDHGANAGLAAARDFLQPVKEKFPWITYSDLWILAGVCAIQEMLGPAIPYRPGRSDRDVSGCTPDGRLPDASKRQDHLRGIFGRMGFNDQEIVALSGAHALGRCHTDRSGYSGPWTFSPTVLTNDYFRLLVEEKWQWKKWNGPAQYEDKSTKSLMMLPSDIALIEDKKFKPWVEKYAKDNDAFFKDFSNVVLRLFELGVPFAQGTENQRWTFKPTHQE

SEQ ID NO: 20812 - protein, 637 aa, Musa acuminata
  misc_feature (477)..(477): Xaa can be any naturally occurring amino acid
MGGLLMEGMVYPGGPNYVQLFPSNDEKNLCYGSLHQPSMGECIMGEGDLVDPPPEKFAEVGDEESDEDIDIEELERRMWRDRVRLKRLKEQQQNKNKEQGDAAKQWQSQEQARRKKMSRAQDGILKYMLKMMEVCKAQGFVYGIIPEKGKPVSGASDNLRGWWKEKVRFDRNGPAAIAKYQADNTIPGSNNEVVSSTVSPHSLQELQDTTLGSLLSALMQHCDPPQRRFPLEKGVAPPWWPTGREEWWPQSGIPNEQGPPPYKKPHDLKKAWKVSVLTAVIKHISPDIEKIRRLVRQSKCLQDKMTAKEIATWLAVVKQEEDMYMKLHPDTCLPPSSGSGLTGAISFNTSCGDYDVEGVDEDKSEDVILHNPPADGNTFSLSATVGNEKFVLSVPMKDETDCAFIQKRTAAEPELLLNQRIYTCDNAKCPHHDFCHGFTDRNARNSHQYLCKYQDTFPQSIGALSAENFPVNENKPXFLSMSSTAQPTPTSLGPSLNPISVSDLGIPSDGQKSINELMGFYDNNISGDKSLTLGSASVLEGSNSFQSRIQMEDTFFGQETGMGGSLFEEVGSLVQQPQFFVREDMMPFGQQFSNQPNESSGGFRFTSGLNIPAVDYSNAASQRGMLQKKHDGSNWFY

SEQ ID NO: 20813 - protein, 578 aa, Arabidopsis thaliana
MCGILAVLGCIDNSQAKRSRIIELSRRLRHRGPDWSGLHCYEDCYLAHERLAIIDPTSGDQPLYNEDKTVAVTVNGEIYNHKILREKLKSHQFRTGSDCEVIAHLYEEHGEEFIDMLDGMFAFVLLDTRDKSFIAARDAIGITPLYIGWGLDGSVWFASEMKALSDDCEQFMSFPPGHIYSSKQGGLRRWYNPPWYNEQVPSTPYDPLVLRNAFEKAVIKRLMTDVPFGVLLSGGLDSSLVAAVALRHLEKSEAARQWGSQLHTFCIGLQGSPDLKAGREVADYLGTRHHEFQFTVQDGIDAIEEVIYHIETYDVTTIRASTPMFLMSRKIKSLGVKMVLSGEGSDEILGGYLYFHKAPNKKEFHEETCRKIKALHQFDCLRANKSTSAWGVEARVPFLDKEFLNVAMSIDPEWKLIKPDLGRIEKWVLRNAFDDEERPYLPKHILYRQKEQFSDGVGYSWIDGLKDHANKHVSDTMLSNASFFFPDNTPLTKEAYYYRTIFEKFFPKSAARATVPGGPSIACSTAKAVEWDATWSKNLDPSGRAALGVHVAAYEEDKAAAAAKAGSDLVDPLPKNGT

SEQ ID NO: 20814 - protein, 406 aa, Unknown
  Burkholderia sp. 383
MSADPFVIVGAGHAARRTAEALRERDAAARIVMIGAERELPYDRPALSKDALLSDGGEQRAFVRDAAWYDAQRIELRLGTRVDAIERDAQRVRLDDGTTLPYASLVLATGSRVRTFDGAIDEGVKPHYVRTVDDARTLRAQLLPGRRVAVLGGGFIGLEVAAAARQLGCEVTVIDPAPRLLQRALPEVVGAYAHQLHDARGVVFQMATLPRAIRRAPGGGAIVETDRGDVPADLVVVGIGVVPNVELAQAAGLDIDNGIRVDAGCRTVDPAIFAAGEVTMHFNPLLGRHVRIESWQVAENQPAVAAANVLGADDTYAELPWLWSDQYDCNLQMLGLFGSERTIVVRGDPANGPFTVFGLGDDGKIVAVAAANLGRDIGASRRLIAAGAVPDPVKLADPAVNLKAFM

SEQ ID NO: 20815 - protein, 86 aa, Glycine albicans
INISGTNGEVMPGQWEYQVGPSVGIEAGDHIWASRYILERITEQAGVVLSLDPKPIEGDWNGAGCHTNYSTKSMREDGGFEVIKKA

SEQ ID NO: 20816 - protein, 592 aa, Musa acuminata
MMGGLLMEGMVYPGGPNYAQLFASNDEKNLSYGSLLHQPSLGECIVGEGDLVDPPPENFAEAGDEESDEDIDVEELERRMWRDRMRLKRLREQQQNKNKEQGDTAKQHQSQEQARRKKMSRAQDGILKYMLKMMEVCQAQGFVYGIIPEKGKPVSGASDNLRGWWKEKVRFDRNGPAAIAKYQADNAIPGSSSETIPGTVSPHSLQELQDTTLGSLLSALMQHCDPPQRRFPLEKGVAPPWWPTGREEWWPELGFPKDQGPPPYKKPHDLKKAWKVSVLTAVIKHMSPDIEKIRRLVRQSKCLQDKMTAKEIATWLAVVKQEEDVYLKLHPNTCPPPSSGSAISFNSSCSDYDIEGADEGKSEDAVIQNPAADGNTFSLSATVGNEKFVISVPLKEEINCDFIQKRTAAEPQLMLNQRVYTCDNAKCPHHDFRQGFTDRNARNRHQYLCKYQNTFPQSLTMLSDNFQVNESKPPVVPMSSNAQPNATRLGSSLNPVHVSDLGIQMEDNFFRQGTGTGGSLFEQVGSLVQQPQFFLREDMMPFGQQFTNQPNELSGGFRFRSGLNIPAMDYSDVSQRGMGGSLQKHDGSSWFY

SEQ ID NO: 20817 - protein, 220 aa, Zea mays
MDDAQEPPSPPSPSQSSSSSSSSSSVAPNPKKRARKDGSRHPTYRGVRMRSWGKWVSEIREPRKKSRIWLGTFATAEMAARAHDVAALAIKGARDAHLNFPGLAHLLPRPATAAPKDVQAAAALAAAADFPLPPSPGGANAKSPESSSSGSASASASDDASAASPAAPQDAEPNPDDALFDLPDLLLDLRCCGPSSWAVDDDVAGGGAFRIIEEPLLWEY

SEQ ID NO: 20818 - protein, 622 aa, Musa acuminata
MMGGLLMEGMVYPGEPNYVQNISYGSLHQPLVGECNGQGHLIDPPQDNFAEVCDEESDDEDVDIEELERRLWRDRVRLKHLKEQQQQQSKSKSKSKEQGDSAKQRPCHDQALRKKMSRAQDGILKYMLKMMEVCNAQGFVYGIIPEKGKPVSGASDNLRGWWKEKVRFDRNGPVAIAKYQVDNAIVGSNSEMSSGTASLHSLQELQDTTLGSLLSALMQHCDPPQRRFPLEKGVAPPWWPTGKEEWWPQLGIPNDQRPPPYKKPHDLKKARKVSVLTCVIKHMSPDINKIRRLVRQSKCLQDKMTAKESATWLAVIKQEEDMYMKLHPEAYFPPSSGSCISGSISFVSSCSEYDAEGVDEGKCEDVVNHKLHAEGNPFDLSGTARKEKTVKEEMNMEFTRKRNVAEPESVLNQCIYTCDNVQCPHHDPRHGFLDRNARNSHRYVCLYQGTGVAFNSFPVKENKLLSFSVPYDTQPNPTTLESGPIPANTSDLSIPSDGQRSIDELMSLYDKNLNANKSFNSRGIGMSEGRTPLQPRTRVEDNFFPQGTKAIGGMLEEVSNLVQQQQQFPVRENVMPFQQQFGNPSDEMSGDLCYGSAFSMPSMDYSDTLHRLQKAEAANWFY

SEQ ID NO: 20819 - protein, 521 aa, Debaryomyces hansenii
MSHFSDNDENDCCNHPKERRRSFLDLGGANSLNKFASSYTRAQSYLGLSLVETSVVQGTEDDLSPCTSLDDVVTESAIDDSPRGNERALDQINAFSFERNEESSLLSRRTSKADSERLITGDSTAPQTIFNCINTLMGIGMLSLPFGFRLSGWVLGTLMLLFSSIVTNISAKMLGKILRKYPHLMSYGDIAHLYGGRGINIVVTLVFSFDLLGAMISLIILFSDSFHILFPSLQRVLLKGIIVAVLFVLSFLPLSILSLCSLLGIICTSLLIVVIIICGLLTSTSPGSLVTPAVTNLWPSEYKYLFLSLGLFMAPWGGHPVFPELYRDMRHRSKFSKCCNIAFGITFNLDYLIAAIGFLMFGINCQDSLTKNLMTNKNYPDWVRPLICLFMGLLPVSKLPLITRPIITVYESFFKLNQTNYAVIKNGIRQEVYGIKRVLSRVVFCVLLLLVSLIFNSFGKVISFLGSAICFTICMTLPLIFYLKFYDDEITVMERLLIKFGILIGVVFSLIGTYGSIVIDI

SEQ ID NO: 20820 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQNIHGSRSKKVRVLQ

SEQ ID NO: 20821 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQYRSLDRSGDVENLQ

SEQ ID NO: 20822 - protein, 530 aa, Laminaria digitata
MSASALSDVGLYGLAVMGQNFALNMASHGFSVSVSNRSPEKVDATVARAKEEGNLPLRGFKDPKSFVDSLSKPRKIVLLVQAGAAVDATIATLSELLEEGDILVDGGNEWFPNSQRRAKELEPKKIMFVGMGVSGGEEGARNGPSLMPGGPREAYDALSPIISKCAAQVDGPCTTYLGSIGSGNYVKMVHNGIEYGDMQLIAEVYDVLKHVAGLTNDELSATFTDWNQGELQSFLIEITAVIFSRKDDLTSSGHVVDKILDKTGMKGTGRWTVQEAAERSTAAPTMAAALDARYMSGRKGERVEAAKTLKGPSTIPQVPKAQLIEDMKAALYCSKICSYAQGMNLIKAASEHFEWGVDLGECARIWKGGCIIRAAFLDDIKNAYIKNADLDNLLVDPFITSQILERQAAWRRVVTLCVASGIAAPAMTASLSYFDSYRRARLPANLVQAQRDFFGAHTYERVDKEGVFHCLWDDTHKEIATSPAHGGRTLIGSLPNLFRPLCMGCLNWSSTVVSVAYCGMKYYIGSLSFT

SEQ ID NO: 20823 - protein, 265 aa, Emericella nidulans
MEQAQQTSGQQQGRQQPVYDTRQGGHYGASAALAAQGFAPVAELYTGTWANVNQGLQGTARDILTTYWQHVINHLESDNHDYKIHQLPLARIKKVMKADPEVKMISAEAPILFAKGCDVFITELTMRAWIHAEDNKRRTLQRSDIAAALSKSDMFDFLIDIVPREEATSHAKRSSQSAGAPAGPGGPTAAGQLPQTQHGVQHHPHHMAPPDYGALGQHPLQDQEYRQQTMYGGAVQSDPTAAYAQPQTQMFEGMYTAYPHLPPQQ

SEQ ID NO: 20824 - protein, 463 aa, Pseudomonas syringae
MSSTANSSELEQGLKPRHITMLSIAGVIGAGLFVGSGHAIAEAGPAVLLAYAAAGTLVVLVMRMLAEMAVASPDTGSFSTYADRAIGHWAGFTIGWLYWWFWVLVIPLEANAAATILHAWFPNIAIWVFTLVITLVLTATNLFSVKNYGEFEFWFALIKVVAIIAFVVLGVAAIFGLLPTSNVSGVSHLFDTGGFLPNGMGAVLAAMLTTMFSFMGTEIVTIAAAESKNPGKQITKATNSVIWRIFLFYLVSIFIVVSLVPWNDPRLAEVGSYQTVLDAMGIPNAKLIVDLVVLVAVTSCLNSALYTASRMLFSLGKRGDAPAVSKRTSKGGTPHWAVIMSTAAAFLTVFANYIAPAAVFDFLLASSGAIALLVYLVIAVSQLRMRQKRIAAGEAIDFKMWLFPWLTWAVIAFIVAVLTIMLLQEEHRLEIIATGVLSLLVIGAGMIVSRRRKDGRVGAAALG

SEQ ID NO: 20825 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQIHSGIRSMTGANLQ

SEQ ID NO: 20826 - protein, 375 aa, Unknown
  Bradyrhizobium sp. BTAi1
MSTKRCYYETLEVERDADETKLKAAFRKLAMKWHPDKNPGDASSEVKFKEINEAYEVLRDADKRAAYDRYGHAAFEQGAGGPHGFGAGFASSFSDIFEDLFGMAGQRRGGTGRERGADLRYNMEITLEEAFQGKTAQIEIPVSVTCESCSGTGAKAGTKPKTCAMCGGAGRVRQAQGFFTLERTCPGCHGRGQMIEDPCPSCSGSGRVTRDRTLSVNIPQGVEDGTRIRLAGEGEAGLRGGPPGDLYIFLSLSQHEFFQRDGADLHCRVPISMVTAALGGEFEVPTIDKGKTKVKIPAGAQSGRRFRIASKGMPVLRSRQTGDMYVQIVVETPQNLTKKQQELLAEFEKLSSGATQPEAAGFFTKVKDFFGKAAS

SEQ ID NO: 20827 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQSRYRCRSNTVIGLQ

SEQ ID NO: 20828 - protein, 492 aa, Unknown
  Synechocystis sp. PCC 6803
MTNTLTSTFADLGLSEKRCQLLADIGFEAPTQIQTEAIPLLLSGRDMLAQSQTGTGKTAAFALPLMDRIDPEGDLQALILTPTRELAQQVAEAMKDFSHERRLFILNVYGGQSIERQIRSLERGVQIVVGTPGRVIDLIDRKKLKLETIQWVVLDEADEMLSMGFIDDVKTILRKTPPTRQTACFSATMPREIKELVNQFLNDPALVTVKQTQSTPTRIEQQLYHVPRGWSKAKALQPILEMEDPESAIIFVRTKQTAADLTSRLQEAGHSVDEYHGNLSQSQRERLVHRFRDGKIKLVVATDIAARGLDVNNLSHVVNFDLPDNAETYIHRIGRTGRAGKTGKAIALVEPIDRRLLRSIENRLKQQIEVCTIPNRSQVEAKRIEKLQEQLKEALTGERMASFLPLVRELSDEYDAQAIAAAALQMIYDQSCPHWMKSDWEVPEVDFNKPVLRRGRNAGGGQNKSGGGYQGKPGKPRRSSGGRRPAYSDRQQ

SEQ ID NO: 20829 - protein, 188 aa, Arabidopsis thaliana
  misc_feature (132)..(132): Xaa can be any naturally occurring amino acid
MASSMLSSAAVVTSPAQATMVAPFTGLKSSAAFPVTRKTNKDITSIASNGGRVSCMKVWPPIGKKKFETLSYLPDLSDVELAKEVDYLLRNKWIPCAEFQLQHGFVYREHGNTPGYYHGRDWDMWKLPLFGXCTHSPPVLYEAPQCQKEFPGALLKDHRDLKTPPTFQCSSFLGLQTPSFSRKPIFSF

SEQ ID NO: 20830 - protein, 745 aa, Oryza sativa
MAAPEAPSCYVGIARQSAAFRLMKQMGWEEGEGLGKDKQGIKGHVRVKNKQDTLGVGVDSPHNKWVYDTTQFDNILKKLKVVLFDSIFGVAEFEDDVSNSPDSTPKEAKPTNNEVTKVTRPQGSLRNTYFRYKKRERGKSVSGYSAKDLEGILVRKSDDNCKVDQEVEPTCCDEPDPIICQDTVSQADDVNWWGHKFGFKSGGFLGAKSRKNKSSATKGTSNVRQTFGEEDQENLYNLVQDKATSGKQGLGIKGLPIKVAGHHWKGNKTSFGDSDEENSTQSNELSELEEDGDEEESANDNELIDANVNTVKEMCVDVKHKHKTKVKKLCKTILRQAPAQSMKLKELKVAVEAHSESMFSNFSCRREALLFLKRKLQGSRKFNIDGKRIYTNPGDSTFLLTCHVALYIRIVSFVHSGANGRTGNQWKQLLPHLRTRFADQCDICECITSAPFDAIDITREAVKDGADAVIAVGGDGTLHEVVNGFFCKGSPVHALDQGPDHSTALGLIPLGTGSDFARTFGWTNDPHEAIDRIVRGSFFDSSFIVCAVSPYSWSHSGHSSPGVKSKLDIGMMEGPDGNPHYFVNVADIHLSAKAGYFSSMYKRFGNLCYVFGALRAFWGHSNRDLRIKVNGGEWKTIRKVTALCIGNAKYFGGGMKITPTADPFGGDLEVVILQDFKWHDFLLKLHRLYGGTHLSVNGVSSIRVQSIEVAEKEVSADIFVQSDGEHFGFLPTKFSVLPGAVDFFC

SEQ ID NO: 20831 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQIIYDDRSEKTVDLQ

SEQ ID NO: 20832 - protein, 329 aa, Solibacter usitatus
MKNLSIIGGGSWGTALAIVLASRFSKVKLWVYEEDLAVRMTAGRINDVYLPSVAIPTNVDIHHELAEVVADADIVLGVMPSHLARGMYEKMRPFIKDRMIFVSATKGLENHSLLRISEVICEVLETPRVAVISGPSFAKEVARSEPTAVVAAAADPNLAAMVQTAFSGPSFRVYTSGDPTGVEIGGSIKNVVAIGAGVLHGMGLGHNAMAALITRGLAEMTRLAVAMGGQSQTLAGLAGLGDLVLTCTGDLSRNRTLGVELAKGRKLEDIINSMKMVAEGVKTTNAAVDLAKRYSVEMPIAEQMFHMLHSGSSPQQAIRRLMERSLKGE

SEQ ID NO: 20833 - protein, 95 aa, Oxalis tuberosa
LYAGINISGTNGEVMPGQWEYQVGPSVGIEAGDHIWASRYILERITEQAGVVLTLDPKPIDGDWNGAGCHTNYSTKSMRDEGGFEVTKKAILNLS

SEQ ID NO: 20834 - protein, 112 aa, Idiomarina baltica
MKKVEAIIKPFKLDDVREALSEVGIAGMTVSEVKGFGRQKGHTELYRGAEYMVDFLPKVKLEVVVADTDVERCIEAIMETAQTGKIGDGKIFVSDIERVIRIRTGEENEQAV

SEQ ID NO: 20835 - protein, 459 aa, Bacillus anthracis
MIQKQHESKLEVGQTFPVTIKRLGINGEGVGYFKRQVVFIPGALPGEEVVAETTKIQRGFAEAKVKKVRKASPHRVKAPCPVYEECGGCQLQHLDYKEQLNQKRDIVVQAFEKYMKNSMEEKIRPTLGMENPWHYRNKSQLQVGRKDEKVITGLYKQNSHQLIDIAHCMIQHKATNEATKVVRRILEKLNVSIYNEKKQKGLVRTIVTRTAVQTGEVQVTLITTKEELPNKEQFIAEVQKQMPAVKSIMQNVNWRKTSVIFGDKTFKLAGKEVIQETLGDLSFELSARAFFQLNPEQTVVLYNEAKKAAALTGNEKIVDAYCGVGTIGLWLANDAAEVRGMDVIPEAIADARKNAKRHGFTNTKYEAGKAEQWLPKWVKEGWRPDVIVVDPPRTGCDDKLLETILKVKPKQVVYVSCNPSSLARDVQALMKSYEVEYVQPVDMFPHTAHVENVVKLTLK

SEQ ID NO: 20836 - protein, 341 aa, Glycine max
FGSSLPFLLIQIRWQPWQPQPSLQTPNSHSSTESPSHILPASRPPPNYPHPNKESIVSREMTRRYMTDMITYADTDVVIVGAGSAGLSCAYELSKNPAVSVAIVEQSVSPGGGAWLGGQLFSAMVVRKPAHLFLDELGVAYDEQEDYVVIKHAALFTSTIMSRLLARPNVKLFNAVAAEDLIVKEGRVAGVVTNWALVSMNHDTQSCMDPNVMEAKVVVSSCGHDGPFGATGVKRLKSIGMIDSVPGMKALDMNAAEDAIVRLTREIVPGMIVTGMEVAEIDGSPRMGPTFGAMMISGQKAAHLALKALGRNNAIDGTCGVGREEPQLILASADTEEIVDA

SEQ ID NO: 20837 - protein, 297 aa, Wolinella succinogenes
MDVAIIGGGAWGSALYKALLEKSSVALVSRSGREGIHQCSLQEALEARFLVLAIASSALRGWLNEANLPPKTKILVACKGIEEGSGALVSEILEEFLPRENLAYLAGPSFAKEVREGLPCALVIHSHHLELAQEMSQFFPSWIRLYVENDVVGGEVCGAYKNVIAIAGGICDGLGLGYNAKASLVARGLVEMARFGQYFGAKIETFLGLSGAGDLFLTSGSTLSRNYRVGLGLAQGKSLEEILIELGEVAEGIKTARAITQIAQREGIHAPIAHEVNAILQGKNPKESLKDLLSHGR

SEQ ID NO: 20838 - protein, 296 aa, Unknown
  uncultured bacterium
NSRLCMSSAVSGYLQSFGSDGPPCCYDDLDLTDCAFLIGTNTAECHPIVFNRLRKHHKRNPQVKLIVVDPRFTETAQVADLHLAIRPGTDITLQNGIGHLLLKWGALDQSFIHQSTQGFADYTEVLRHYEPSIVAERCGITEADLETAARTWAESQSVLSLRSMGLNQSSEGTAKVCSLINLHLLTGQIGRPGAGPFFLTGQPNAMGGREAGGLAHILPGYRLVKNPQHRQEIEQFWSLPEGQISPSRGLTIGEMIPALEHNQVGLLWIAATNPAVSLPDLNRTKAALQRSPFTVY

SEQ ID NO: 20839 - protein, 225 aa, Brassica napus
  misc_feature (88)..(88): Xaa can be any naturally occurring amino acid
  misc_feature (117)..(117): Xaa can be any naturally occurring amino acid
  misc_feature (134)..(134): Xaa can be any naturally occurring amino acid
MGRRPARCYRQIKGKPYPKSRYCRGVPDPKIRIYDVGMKKKGVDEFPFCVHLVSWEKENVSSEALEAARIACNKYMVKSAGKDAFHLXGIRVHPFHVLRINKMLSCAGADRLQTGMXEGAFGKALGTLARGVAXIGQVLLSVRCKDNHGAHAQEALRRAKFKFPGRQKIIVSRKWGFTKFNRADYTRLRQSKRVVPDGVNAKFLSNHGPLANRQPGSAFISATSD

SEQ ID NO: 20840 - protein, 262 aa, Methanothermobacter thermautotrophicus
MFFMVRRKNEWPEEGELVVGTVHKVLNYGAFATLEEYPGKEAFIHISEVSSGWVKNIRDFVRENQKIVARVLRVNPRKGHVDVSMKRIREDQRTKKIQAWKIEQKAEKFLELAARDLGKDLDTAYEEVGYELMDIFGDLYGAFETAAEEGEKSLIEEGVPEDWAAVITEVAKRNITPPEVQITGYVDIKSYAPNGVEIIRKALKSAQDEGITVQAVGAPRYRLIVKSTDYLKAEKQLKEAAQKCIEIVEKEGGEGEFLRELT

SEQ ID NO: 20841 - protein, 224 aa, Helianthus annuus
NDFFDYVLEELKQNDTMLTEATALDLMFALLFANFETTSQAITVAIKFLTHNPRALKELTEEHQKILRKRENPKLDLHGKNIVDEIYLQVINETLRLASIVPVLFRKAKKDIKFKGYTIPSGWAVMVCPPAVHLDPVNYKDPLDFNPWRWEDMDLKSASKTFMAFGGGQRFCVGADFAKLQIAIFLHCLVTKYQWQPIKGGDIVRTPGLQFPNGFHVRIFEKET

SEQ ID NO: 20842 - protein, 296 aa, Unknown
  uncultured bacterium
NSRLCMSSAVAAYMYSLGSDGPPCCYDDLELTDCAFLIGTNTADCHPIVFNRFRKHHKQQAGVKLIVVDPRRTATAVVADLHLAIRPGSDIDLLHGMAFLLRQWGRIDADFIAHHTHGYKDYGQVIDQYPPDVVAERCGIPVEQLEQAARWWGDSQNVLSLWSMGINQSAQGTAKARSLINLHLLTGQISKPGSGPFSLTGQPNAMGGREAGGLSHLLPGYRLIKNPDHRREVEQAWGLPPGRICPEPGLSAWEMIRGLEAGTVGCFWVVATNPLVSMPDLNRVKAALRRSPFTVC

SEQ ID NO: 20843 - protein, 416 aa, Streptococcus thermophilus
MIFDKEDYKAFDPELWNAIDAEAERQQNNIELIASENVVSKAVMAAQGTLLTNKYAEGYPGKRYYGGTAVIDVVETLAIERAKKLFGAKFANVQPHSGSQANAAVYMSLIQPGDTVMGMDLSAGGHLTHGAPVSFSGKTYNFVSYNVDKESELLDYDAILAQAKEVRPKLIVAGASAYSRIIDFAKFREIADAVGAYLMVDMAHIAGLVASGHHPSPVPYAHVTTTTTHKTLRGPRGGLILTDDEDIAKKLNSAVFPGLQGGPLEHVIAAKAVALKEALDPAFKEYGENVIKNAAAMADVFNQHPDFRVISGGTNNHLFLVDVTKVVENGKVAQNVLEEVNITLNKNSIPYEQLSPFKTSGIRVGSPAITSRGMGEAESRQIAEWMVEALENHDKPEVLERIRGDVKVLTDAFPLY

SEQ ID NO: 20844 - protein, 604 aa, Coprinopsis cinerea
MQEFPLPTQGASLILAFRPQTTLIIGAGPLAATRAFSALETGSTVTILVNGGLTSACEELKWRFEHGQLDIVDWDLLRSEYQPESDIEALRHFLDQFSTVSLACITDTVIGSAGRRTRHESEELYRLFQSRNIPVNTTDMPELCDFTFTSTHRFVDPVSGSSSPLQVGVTTNGQGCRLASRLRRDIVSKLPADVGTAAANVGHLRTLAKASAEPLKAKQGDLPEEEVGFDEIEEDNVVTTPNRPVPSRSTTESEVESAKRRMKWVAQVSEYWPLSKLSALTTPEMDKLLDGEFSQLSLPSPNTSIHSLSPPKQGKIFLVGSGPGHPSLLTIATHTVLTRVADIVLSDKLVPDAVLALIPKHVEVRIARKFPGNAEAAQNEMMEAAVEAASRGFNVVRLKQGDPVVYGRAGEEVLYFRSHGFEPLVVPGVSSALAGPTFAGIPVTQRGVAESFIVCTGVGRKGKEIRLPGYERGRTLLILMGVARLAQVVQSLTSPEPGSRRDGSAYPLHTPIAIIERASMPDQRVVSSTLRDIVKALESSGEQRPPGMILVGWSVIALYGKGDTSVLDDCGEEEDEKRIQRWLGGDQATGWRVQTGIDDKWDLF

SEQ ID NO: 20845 - protein, 77 aa, Brassica napus
MGIVMVMIGFLFVLVLLCSALLRWNEMRYSKTNLPPGTMGWPIFGETTEFLKQGPDFMRNQRLRYGSFFKSHLLGCP

SEQ ID NO: 20846 - protein, 296 aa, Unknown
  uncultured bacterium
NSRLCMSSAVAAYMYSLGSDGPPCCYDDLELTDCAFLIGTNTADCHPIVFNRLRKHHKQQAGVKLIVVDPRRTATADVADLHLAIRPGSDIDLLHGMAFLLRQWGRIDADFIAHHTHGYKDYGQVIDQYPPAIVAERCGIPVEQLEQAARWWGDSQNVLSLWSMGINQSAQGTAKARSLINLHLLTGQIGKPGSGPFSLTGQPNAMGGREAGGLSHLLPGYRLIKNPDHRREVEQAWGLPPGRICPEPGLSAWEMIRGLEAGTVGCFWVVATNPLVSLPDLNRVKAALRRSPFTVC

SEQ ID NO: 20847 - protein, 911 aa, Brassica napus
MATSVDNRHYPRLNPAINGVVRSFKPPPIPSPRHQNKTVSFLTEKVIVKETKNDAVDDSYDSSDDEDESHNRNVSYYKEMIRKSHSDVEPSILDSRDESTADNWIHRNSSMVRLTGKHPFNAEPPLPRLMHHGFITPVPLHYVRNHGTVPKADWSEWTVEITGLVKRPAKFTMEELISEFPSREFPVTLVCAGNRRKEQNMVKQTIGFNWGSAGVSTSLWKGVPLSEILGRCGIYSRRGGGLNVCFEGAEDLPGGGGSKYGTSIKKEMAMDPARDIILAYMQNGELLTPDHGFPVRIIVPGFIGGRMVKWLKRIIVTPQESDSYYHYKDNRVLPSLVDAELANAEAWWYKPEYIINELNINSVITTPGHQEILPINAFTTQKPYTLKGYAYSGGGKKVTRVEVTLDGGDTWSVCDLDHQEKPNKYGKFWCWCFWSLDVEVLDLLSAKDVAVRAWDESFNTQPDKLIWNLMGMMNNCWFRIKTNVCKPHKGEIGIVFEHPTRPGNQSGGWMAKERQLEISSESNPILKKSVSSPFMNTSAKMYSMSEVRKHNSVESAWIIVHGHIYDCTRFLKDHPGGSDSILINAGTDCTEEFEAIHSDKAKKLLEDYRIGELITTGYDSSPNVSVHGGSTAVSLLAPIKELAPSKNIALVNPREKVPVTLIEKTSISHDVRRFRFALPSEDQQLGLPVGKHIFLCANINDKLCLRAYTPTSTVDAVGHIDLVVKVYFKDVHPRFPNGGLMSQHLDSLPIGSVLNIKGPLGHIEYLGKGNFMVTGKPKFAKKLAMLAGGPGITPIYQVIQSILSDPEDETEMFVVYANRTEDDILVREELEGWANKHKDRLKVWYVVEIAKEGWNYSTGFITEPVLREHVPEGLEGESLALACGPPPMIQFALQPNLEKMGYNVKEDLLIF

SEQ ID NO: 20848 - protein, 73 aa, Mycobacterium smegmatis
MAKKDGAIEVEGRVIEPLPNAMFRIELENGHKVLAHISGKMRQHYIRILPEDRVVVELSPYDLSRGRIVYRYK

SEQ ID NO: 20849 - protein, 296 aa, Unknown
  uncultured bacterium
NSRLCMSSAVAAYMYSLGSDGPPCCYDDLELTDCAFLIGTNTADCHPIVFNRLRKHHKQQAGVKLIVVDPRRTATADVADLHLAIRPGSDIDLLHGMAFLLRQWGRIDADFIAHHTHGYKDYGQVIDQYPPDVVAERCGIPVEDLAQAARWWGDSQNVLSLWSMGINQSAQGTAKARSLINLHLLTGQIGKPGCGPFSLTGQPNAMGGREAGGLSHLLPGYRLIKNPYHRREVEQAWGLPPGRICPEPGLSAWEMIRGLEAGTAGCFWVVATNPLVSLPDLNRVKAALRRSPFTVC

SEQ ID NO: 20850 - protein, 296 aa, Unknown
  uncultured bacterium
NSRLCMSSAVSGYIQSFGSDGPPCCYEDLEQTDCAFLIGTNTAECHPIVFNRLHKHCKKNRKVKMIVVDPRRTSTAEAADLHLAIRPGTDIDLLNGIAHLLMRWGKINTLFIDDCTRDFPLYADIIRHYPPELVARKCGIRLDELEKAARYWGDSERVLSLWSMGMNQSSEGTAKVRTLINLHLMTGTIGRPGSGPFSLTGQPNAMGGREAGGLAHILPGYRLVKNPQHRAELEQLWQLKPGQISPEPGLSAWDMILGLETGAVGFLWIAATNPAVSMPDLERTKAALKQSSFTVY

SEQ ID NO: 20851 - protein, 373 aa, Propionibacterium freudenreichii
MSMRVGILTSGGDSPGLNAAIRGFGKAAVSTYGMELIGFRDGMRGLAENRFMQLDSHALSGILTTGGTILGTSRDKVHKMLVDGKVQNMIPVIKKNYEKNKLDALVCLGGGGTAKNAKRLSDAGMNVITLPKTIDNDLVGTDQTFGFATALEIATDAVDRLHSTAHSHHRIILTEIMGHRAGWLALGAGIAGGADVILLPEVPYNVESIAAAISRRSAHGSNFSVVAVAEGARNERDAAELAAADALVREADSPVARDAAKTHRANVEASHRAHTFTLATELEKATGLESRVTILGYVQRGGTPCGRDRVLATVLGTAGADLVAKGVFGVMVAAKGDGAEPVPLEEVAGKIRRVPVDHPWIRAAKEVGTGFGD

SEQ ID NO: 20852 - protein, 163 aa, Unknown
  Nostoc sp. PCC 7120
MELKIGSTEAPMEKATFGAGCFWGVEAAFRKVKGVVSTSVGYMGGHFPNPCYLDVLSRITGHAEVVQIEYDPQLVSYEDLLAVFWDIHDPTTLNRQGPDKGEQYRSVIFFHNEQQAEAAQQSKAKVQVSGRFELDIVTEIKHKSEYYLATEEHQQYFEKQAKR

SEQ ID NO: 20853 - protein, 336 aa, Gibberella zeae
MSRYTAAHANLQGPGDARPTALQIVKDEDLVGKLTDKVILVTGGNSGLGLETAKTLHATGATVYITARTSEKLEEAIKDIKAWPEAESSAPVYGIELQLDSLASVRAAAKKFLEKSEKLNILILNAGVMATPEGRTEDGFETQFGTNHLGHFLFFELLKPALIASSTPSFHSRVVSLSSKGHRYGGVRFDDFNFEKEPYIPWIAYAQSKTANIYFASELERRYGSQGLHGLSVHPGFIFTNLARHIDVSQIDVKGDTKNYVKNIEQGSATTVYAALSKDWEGRGGRYLADCDEEPPLKPGIDPASSAPGYASWIYNEEAEGRLWAESLRLVGLKKD

SEQ ID NO: 20854 - protein, 299 aa, Campylobacter coli
MRVYKKVNELIGNTPIIQLEKFGANLFAKCEFLNPSHSIKDRAAFAMIQSALNEGKIDSKTVIVEATSGNTGIALAMICADLGLQFVATMPESMSIERRKMITLFGAQLELTPASLGMKGAVDKANEILKNTPNSFMPSQFDNLANKNAHRKTTALEILKDLDNDLDIFVAGFGTGGTISGVGEILKEKLGKIHVVAVEPLASPLLSKGEAGSHKIQGIGANFIPAILNKDVIDEIITVSNEDAINTAKELAKNGLMVGISSGANVFAASVLAKKFPDKKILTMLNDTAERYLSTDLFA

SEQ ID NO: 20855 - protein, 462 aa, Arabidopsis thaliana
MSGSTRKEMDRIKGPWSPEEDDLLQSLVQKHGPRNWSLISKSIPGRSGKSCRLRWCNQLSPEVEHRGFTAEEDDTIILAHARFGNKWATIARLLNGRTDNAIKNHWNSTLKRKCSGGGGGGEEGQSCDFGGNGGYDGNLTDEKPLKRRASGGGGVVVVTALSPTGSDVSEQSQSSGSVLPVSSSCHVFKPTARAGGVVIESSSPEEEEKDPMTCLRLSLPWVNESTTPPELFPVKREEEEEKEREISGLGGDFMTVVQEMIKTEVRSYMADLQLGNGGGAGGGASSCMVQGTNGRNVGFREFIGLAFLISLDWSCDSKSEVMNSTEPSDDFRSLLPSVTDYSIAVKVIVKASTGEILKAQGSKYLPIGCMVPFSIAAATTNASFSQFGIQYNKESHLHQFLLDDVHKWVQLLCTSIRNNILQKLSKELVNFNFHGNRDFLVKVEVDVAVKEVSLGDYHSEEG

SEQ ID NO: 20856 - protein, 517 aa, Brassica napus
MAMAMALRRLSSSVDKPIRPLIRSTTCYMSSLPSEAVDDKERSRVTWPKQLNASLEEVDPEIADIIEHEKARQWKGLELIPSENFTSVSVMQAVGSVMTNKYSEGYPGARYYGGNEYIDMAETLCQKRALEAFRLDPEKWGVNVQPLSGSPANFHVYTALLKPHERIMALDLPHGGHLSHGYQTDTKKISAVSIFFETMPYRLDESTGFIDYDQMEKSATLFRPKLIVAGASAYARLYDYARIRKVCNKQKAVMLADMAHISGLVAAGVIPSPFDYADVVTTTTHKSLRGPRGAMIFYRKGGKEINKQGKEVLYDFEDKINQAVFPGLQGGPHNHTITGLAVALKQATTSEYKAYQEQVLSNSAKFAQTLMEKGYELVSGGTDNHLVLVNLKPKGIDGSRVEKVLEAVHIASNKNTVPGDVSAMVPGGIRMGTPALTSRGFVEEDFAKVAEYFDKAVKLALKVKSEAQGTKLKDFVSAMESSSAIQSEIAKLRHDVEEFAKQFPTIGFEKETMKYKN

SEQ ID NO: 20857 - protein, 330 aa, Gibberella zeae
MPCHPTEPEFEVRDIPSLRGYVAIVTGETDYSGNSGIGYETTLQLALKGARVYIASRSNDRVNKAIAEMHKNSPDLDLHFLKLDLQDMQSIKDTTADFMSRENRLDILINNAGIMSSPWELTKDGHEIQWQTCFLSHHALTMSLMPLLVTAAQVSGRMDRVRIINVASDMALRMGPEAIHYDDPNLTNETGKLAPWRRYGHCKEASIIAAKAITDRYQSLGVTAYSLHPGLVKSNLQSHNPTMLGAMSRMMFKVGPSSTPLEGAMNSLFCATSHKVYEHAGRYYVPVQKLDDRANKWLDDAQAVNKLWDLATRQCREHGFIIDDIPGYYN

SEQ ID NO: 20858 - protein, 830 aa, Streptomyces coelicolor
MEDATDRIARPWGARVPYGRHETWPARVDTFLAEGVEPEAVQRWVQSASILHSDGDAMDIAVADGRMVGVRGRDVDRVNRGRLGPKDLFGWQANASRDRLTRPLVRRDGQLVETDWDTAMDLVAARSRELLDSRGPGSIGFYTSGQLFLEEYYTLAVLARAGIGTNHLDGNTRLCTSTAAEALKESFGCDGQPGSYDDFDHADVIALFGHNIAETQPVQWMRLLDRLEGADPPRLLCVDPRPTRVAEHAAVHLAPRSGTNVALLNALLHETIRHERIDRDFIDAHTVGFGELAARVADCTPKWAAEICDVPAARIEEAAELVGTAEALVSTVLQGVYQSHQATAAAVQVNNLHLIRGMLGRPGAGLLQMNGQPTAQNTRECGANGDLPGFRNWQNDAHVADLARVWNVEPETIPHFAPPTHAMQIFRYAEQGSLRMLWISGTNPAVSMPELPRIRSILSQERLFTVVQDLYLTETARLADVVLPAATWGEKTGALTNADRTVHLSRKAVEPPGEARPDLDIFLDYARRMDFRDKDGGPLIPWDGPESAFEAWKRCSAGRPCDYTGLSYAKLRDTSGIQWPCDDRAPEGTARLYTDGFGWAHPDVCESYGKDLETGASQEVVEYRSLNPDGRAMLKAAAYLPPHEEPDEEYPFQLTTGRTLYHFHTRTKTGRAPQLNDAAPDVWVEVSAGDAERLGLGEGDLVEVTSRRGSLRGRLRVTGIRTGLLFVPFHYGYWDTAGGSGPGPDTPGRAANETTVTDWDPASKQPLFKTAAAALTLVERGGGRPSPAPTTTASAPVTAGAAPPTSGGPAARTTEREPTEFPHGREEGAR

SEQ ID NO: 20859 - protein, 425 aa, Fusobacterium nucleatum
MSKETLNPLASGQQQVKKACDALGLDPAVYELLKEPQRIIEITIPVRMDDGSIKTFKGYRSAHNDAVGPFKGGIRFHQNVNADEVKALSLWMSIKCQVTGIPYGGGKGGITVDPSELSQRELEQLSRGWVRGLWKYLGEKVDVPAPDVNTNGQIMAWMQDEYNKLSGEQTIGVFTGKPLSYGGSQGRNEATGFGVAVTMREIFKALGKELKGATVAVQGFGNVGKYSVKNIMKLGGKVVAVAEFEKSKGAFAVYKEAGFTFEELEAAKAAGSLTKVAGSKEISMDDFWALNVEAIAPCALENAIKEHEANLIKAGIICEGANGPITPEADEILYKKGTVVTPDVLTNAGGVTVSYFEWVQNIYGYYWTEKEVEEKEERAMVDAFNPIWALKKEFDGKGQPISFRQATYMKSIKRIAEAMKIRGWY

SEQ ID NO: 20860 - protein, 86 aa, Glycine tomentella
INISGTNGEVMPGQWEYQVGPSVGIEAGDHIWASRYILKRITEQAGVVLSLDPKPIEGDWNGAGCHTNYSTKSMREDGGFEVIKKA

SEQ ID NO: 20861 - protein, 152 aa, Asparagus officinalis
KKPAEKKPAAEKPDEEPKAEKKAEKAPAGKKPKAEKRLPSKEGGGDKSGVGKAKKKKKAKSVETYKIYIFKVLKQVHPDIGISSKAMGIMNSFINDIFEKLAQEASRLARYNKKPTITSREIQTSVRLVLPGELAKHAVSEGTKAVTKFTSS

SEQ ID NO: 20862 - protein, 319 aa, Saccharomyces cerevisiae
MVHNKVTIIGSGPAAHTAAIYLARAEIKPILYEGMMANGIAAGGQLTTTTEIENFPGFPDGLTGSELMDRMREQSTKFGTEIITETVSKVDLSSKPFKLWTEFNEDAEPVTTDAIILATGASAKRMHLPGEETYWQKGISACAVCDGAVPIFRNKPLAVIGGGDSACEEAQFLTKYGSKVFMLVRKDHLRASTIMQKRAEKNEKIEILYNTVALEAKGDGKLLNALRIKNTKKNEETDLPVSGLFYAIGHTPATKIVAGQVDTDEAGYIKTVPGSSLTSVPGFFAAGDVQDSKYRQAITSAGSGCMAALDAEKYLTSLE

SEQ ID NO: 20863 - protein, 432 aa, Streptomyces coelicolor
MRVCVIGAGLSGLAMGHALKERGISFVCLEKAPDVGGIWRQPGAGERGPGYQSLHLNTARQLTGYADFPMPSDYPLYPRHDQVAAYLRSFAEWAGLLDHVELRTEVLSVRQDSDGSWTVVSRDADGAQSARRFEQVVVASGHHTDPALPDPLPAGADSFAGTILHSLDYRDGGDFAGRRVVVVGLGASAVDIAADLSRHAERTLLSVRRGLHIVPKQVFGMSLDEIAEAPWWNEMPFAERRRWVEQALLVARGRLSDYGLPEPDHPILSSATTLSDEILSRIRHGAVTPKPAIASFESDRVVFTDGSSEAADTVVYCTGFHMTFPFLPPGCPVAADGAVELYRRIVPADRPGLYFVGLVRPAGALTRLVEAQAQWVARLVDGAAALPGTEEMREEISTYLAGIVERYGRTRGASIQVDVSPYLAEFREPLPV

SEQ ID NO: 20864 - protein, 87 aa, Glycine latifolia
INISGTNGEVMPGQWEYQVGPSVGIEAGDHIWASRYILERITEQAGVVLSLDPKPIEGDWNGAGCHTNYSTKSMREDGGFEVIKKAI

SEQ ID NO: 20865 - protein, 1026 aa, Enterobacter cloacae
MSDTPSLTLSALLARRDWENPVVTQWNRLAAHAPLHSWRNEPSARDDAGSARRQTLNGLWRFSYFTAPEQVPQAWVTEDCADAVAMPVPSNWQMQGFDTPIYTNVTYPIPVNPPFVPQENPTGCYSLTFEVDDAWLQSGQTRIIFDGVNSAFHLWCNGQWIGYSWDSRLPAEFDLSAALRPGQNRLAVMVLRWCDGSYLEDQDMWRMSGIFRDVTLLHKPETQIADYHVVTDLNAELDRAVLKVDVTLAGAGFADGEVVFTLWRKGEKCASVSRQPGSAIVDERGSWAERLTVTIPVETPALWSAETPELYRLTMALLNPQGEVLEIEACDVGFRRVEISNGLLKLNGKPLLIRGVNRHEHHSENGQVMDEATMRRDIETMKQHSFNAVRCSHYPNHPLWYQLCDRYGLYVVDEANIETHGMVPMSRLADDPRWLPAMSERVTRWVQRDRNHPSIIWSLGNESGHGANHDALYRWLKTTDPTRPVQYEGGGANTAATDIVCPMYARVDRDQPFPAVPKWSIKKWIGMPDEPRPLILCRYAHAMGNSFGGFAKYWQAFRSHPRLQGGFVWDWVDQALTKRDEDGNTFWAYGGDFGDKPNDRQFCLNGLVFPDRTPHPALYEAHGPQQFFTFTRVSTSPLVIEVQSGYLFRHTDNEVLNWTVARDGDVLVAGEVTLAMVPEGTQRLEIALPELNAGPGEVWLNVEVRQPRATPWSPAAIAAAGSSGRFRLRSLLLRQPRRRAAVLTQTDRILEIAHRQQRWQFDRASGNLTQWWRNGVETLLSPLTDNVSRAPLDNDIGVSEATKIDPNAWVERWKAAGMYDLTPRVLHCEAEQHAGEVVTTQHVLEYRGKALFLSRKVWRIDEQGVLHGDIQVDMASDIPEPARIGLSVHLAETPENVRWLGLGPHENYPDRKLAAQQGRWTLPLEAMHTPYIFPTENGLRCDTRELVVGMHQLNGHFHFSVSRYSQQQLRETTHHHLLREEPGCWLNLDAFHWGVGGDDSWSPSVSPEFILQTRQLRYTFSWQQNP

SEQ ID NO: 20866 - protein, 84 aa, Brachypodium sylvaticum
DEPYPYAVYRCHTTGPARAYVVDMDGEGSNKVTLATVCHTDTSLWNPDHVSFQLLGTKPGGAPVCHLMPYGHILWAKDVKRSPA

SEQ ID NO: 20867 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQYDSSDRSSAAIDLQ

SEQ ID NO: 20868 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQGCAALRSKIGKRLQ

SEQ ID NO: 20869 - protein, 608 aa, Unknown
  Frankia sp. EAN1pec
MPAPAVAAVRLAVRDAVADVPPGGLVLVACSGGADSLALAAALAFVAPRRALRAGLLTVDHGWDDTSRPRAEEVAASGRLLGLSPVEVLAAPSPRSEGAARDSRRAALLAAGERLGAHAVLLGHTLDDQAETVLLRLARGSGARSLSGMPATDGAIRRPLLRLRRDQTRQACQSLGLEFWDDPTNADPAFARARTRSTVLPVLEAELGPGIAEALARTADLLRADADALEAQAESVYAELAGSAAGTTAPRAPRTPLAAEAEPGPRVEFDVAALAGLTQALRSRVLRRAALAAGSSASALRADHIWAVEDLVTRWRGQKPVPLPSGVLARRTGGRITLVGPDAPVRPDTPAGAGHPGRPGVVRTPGERGGPTSRAPASGTLTPGTPASGDRGPGDPARNEEDRPVSQAATAKPDHDGTSIPAGGPPRAHPDIDEILVSQDEIAAKIAELAARVDADYAGREILLVGVLKGAVMVMADLSRALSVPITMEFMAVSSYGSTTSSSGVVRILKDLDRSIEGRDVLVVEDIIDSGLTLSWLLRNLRSRGPASLEVLALFRKPEAITVDVDVRYVGFDIPSAFVVGYGLDYAEHYRTLPFVGTLTPEAIARRA

SEQ ID NO: 20870 - protein, 450 aa, Oryza sativa
MESKGGKKKSSSSRSLMYEAPLGYSIEDVRPAGGVKKFQSAAYSNCSDQPAPMGVLSAADPPPVSAIGFEGYEKRLEITFSEAPVFADPDGRGLRALSRAQIDSVLDLARCTIVSELSNKDFDSYVLSESSLFIYSDKIVIKTCGTTKLLLTIPRILELAEGLSMPLAAVKYSRGMFIFPSAQPAPHRSFSEEVAVLNRYFGHLKSGGNAYVIGDPAKPGQKWHIYYATQHPEQPMVTLEMCMTGLDKEKASVFFKTSADGHTSCAKEMTKLSGISDIIPEMEICDFDFEPCGYSMNAIHGLAFSTIHVTPEDGFSYASYEVVGFDASTLAYGDLVKRVLRCFGPSEFSVAVTIFGGHGHAGTWAKELNADAYKCNNMVEQELPCGGLLIYQSFDATEDVPVAVGSPKSVLHCFEAENMVNPAPVKEGKLGNLLPWGEDALEENDGVFDE

SEQ ID NO: 20871 - protein, 309 aa, Streptococcus pyogenes
MIYLAGGCFWGVEEYFSQVDGVLDAVSGYANGRGDTTNYQLIHQTGHAETVEVAYDTNRISLKELLLHFFRIIDPTSLNKQGNDRGSQYRTGIYYTDKADLAIIDEVFKEKAKDYKKKIVVEKAPLKHFIKAEDYHQDYLKKNPNGYCHIDINQATYPVIDESKYPKPSATEIKEKLSADEYRVTQKNETEKAFSNRYWDSFDAGIYVDVVTGEPLFSSKDKFESGCGWPSFSRPISPDVVRYKEDKSFNMTRTEVRSRSGNSHLGHVFTDGPKDQGGLRYCINSLSITFIPKADMEAKGYGYLLSSVE

SEQ ID NO: 20872 - protein, 785 aa, Neurospora crassa
MLTLFSSFDPSASSNLQHHNNNSQKRAFANGNGQGLPRFSICFMAAELLDSVPDPVLSDLDQKEAVAGLQGYQHPAVSANPDPVEAELEAKELSKYLLAKSFFDCKEFDRCASVFLPDSLLSGLLSTKATDATTPKGKAKASSAPPYEQALPSLSQKSLFLALYAKVISGEKKKNEESEMIMGPQDLGTIKNSHLVVVSRFLERWFAERKAEDSDLPPSQGFLEYLYGMVMVKEKNEDAALDYLLNSVHLFPWNWGAWLELTNLISGVEQLNKITPVLPQNIMSFIFYANTAVNLYQQGQDLAASVNDLLKLFPTSSFILTCRALLNYHSKDLYTAEQNFSNLLALHPHRLDSLDHYSNILYVLNMRPKLAFLAHLCSSIDKFRPESCVVIGNYYSLLSLHEKAVQYFRRALTLDRSCLSAWTLMGHEYVELKNTHAAIESYRRAVDVNRRDYRAWYGLGQTYEVLEMNSYALYYYKKAAGLRPWDGKMWQAVGSCLQKMGKDRDGIKALKRALLADSYYDSTLSSFGSAGPADRMAQMDPEVLLQIASMYDRLGEVEEARAYMELCVAQEDGGATDNADASAVCTSNPGESFVVHGDSPGSDGDAEGGYEGRGGAGQGEGTGVTVATSKARMWLARYAMRTEDYVTANRLATELCQDGVEVEEAKALIREKPPSLAFPNIEEYLPSAAMIRIGSNGGGGPKLRRVPRSQRYYENISTIPPLTDQGSGIYEDPSQESDDDDDDDDENGGNDRHDDWSGEDYLTDGYDDDDVDDDDDDNGGAPTNA

SEQ ID NO: 20873 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQSDLSFRSVGVDILQ

SEQ ID NO: 20874 - protein, 438 aa, Symbiobacterium thermophilum
MRGVTNGGKEMGGAQNPFLIAQQQVRNAVAALGESEELFELLKAPAHFIEVQIPVRMDDGSLRVFTGYRSQHLTTLGPAKGGIRFHPAVTADEVKALSMWMTFKTSVVGLPYGGGKGGVVVDPRKLSLGELERLSRGYVRAIWPYLGPDKDIPAPDVNTNAQIMGWMTDEYETIVGASCPAVFTGKPLSMGGSLGREEATGRGTVITIREALAYLGLPVAGARVAVQGFGNAGQHAARLLEELGAVLVAASDSRGGIVCPGGMRVADLIAYKQATGSVVGFPGSRATDQFGVLTADCDILVPAALENQIDAEVARSIRARVVAEAANGPTTPDGDHVLAQRKIFLIPDILANAGGVTVSYFEWVQNRNQYYWTAEEVNARLEQRMVASFRDVVAMAERHGAYTRTAAYMYAIHRIAESLRMRGLLRAPARQALRAAAG

SEQ ID NO: 20875 - protein, 92 aa, Oxalis tuberosa
GINISGTNGEVMPGQWEYQVGPSVGTEAGDHIWASRYILERITEQAGVVLTLDPKPIDGDWNGAGCHTNYSTKSMRDEGGFEVIKKAILNLS

SEQ ID NO: 20876 - protein, 628 aa, Kluyveromyces lactis
MVQEVDPEHQSLKADSSSAAQVHYVSIPINKDRRFGAGVGAGSSNDYPDYLDGSSEMPTQYQGIRRRTSILDQPIGSFRGVNSLGRFATSFQRANSFKAIEMNADRERSYIGADGDECYDPDTLGFSHHGRKLSFAITGPGTVSIKPSIADLYGAMSRRSSIQAGTPYGNFENPIDESDGLQSVFSHDSMGPHHLTEYSFDDSGNAVGPEADAIILKQVETKAGKVITVIAGQSTAPQTIFNSINVLIGIGLLALPLGLRYAGWVLGVPILFIFAFATFCSAQLISRCLDADPSISTYGDLAYAAFGPKGRALISFLFAMDLLACGVALIILFGDSLNALFPEYSVNFFKFVAFFAVTPPIFLPLSVLSNISLLGIISTIGTALLVVFCGLLKQYSPGSLLQPEATSMWPNSFKEFCLSLGLLSACWGGHAVFPNLKSDMRHPEKFTRCLKTTYSITIVTDIGIAVVGFLMFGNLVMNEVTRSVLLTPGYPPFVYGLISTLLSLIPLAKTPLNARPIVSIFDSMFNVVHIDETKPASKVFFAKATRIFNRIMVNVMFVIIAILFPEFDKIIAFLGAALCFMICFILPCLFYKRICYKTIKSWELIACNITILISAVLSTLGVYASFTS

SEQ ID NO: 20877 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQDSHHLRSGAGTDLQ

SEQ ID NO: 20878 - protein, 553 aa, Thioalkalivibrio nitratireducens
MNDLNRLGRVGRWIAGAACLFLASAAHAEPGENLKPVDAMQCFDCHTQIEDMHTVGKHATVNCVHCHDATEHVETASSRRMGERPVTRMDLEACATCHTAQFNSFVEVRHESHPRLEKATPTSRSPMFDKLIAGHGFAFEHAEPRSHAFMLVDHFVVDRAYGGRFQFKNWQKVTDGMGAVRGAWTVLTDADPESSDQRRFLSQTATAANPVCLNCKTQDHILDWAYMGDEHEAAKWSRTSEVVEFARDLNHPLNCFMCHDPHSAGPRVVRDGLINAVVDRGLGTYPHDPVKSEQQGMTKVTFQRGREDFRAIGLLDTADSNVMCAQCHVEYNCNPGYQLSDGSRVGMDDRRANHFFWANVFDYKEAAQEIDFFDFRHATTGAALPKLQHPEAETFWGSVHERNGVACADCHMPKVQLENGKVYTSHSQRTPRDMMGQACLNCHAEWTEDQALYAIDYIKNYTHGKIVKSEYWLAKMIDLFPVAKRAGVSEDVLNQARELHYDAHLYWEWWTAENSVGFHNPDQARESLMTSISKSKEAVSLLNDAIDAQVASR

SEQ ID NO: 20879 - protein, 472 aa, Listeria innocua
MAKQEIGVIGMGVMGRNLALNIESRGHTVSIFNRSTEKTKAVMEENADKKLVPTYSLEEFVESLEVPRRILIMVKAGDATDMMIEAVKPFLNEGDILIDGGNAFFKDTIRRNKELSEEGFNFIGTGVSGGEEGALKGPSIMPGGQRKAYDLVAPILREIAAVADGEPCVTYIGPDGAGHYVKMVHNGIEYGDMQLIAEAYTILKEIGGLSHDELADVFEEWNNGELDSYLIEITKNILKVKDEETGKPIVDVILDKAGQKGTGKWTSQSALDLGVPLSLITESVFARYISALKDERVYASTVLSGPSNYRFEGDKKAFVESVRRALYFSKIASYAQGFAQMRAASEENDWDLQYGEIAKIFRAGCIIRARFLQKITDAYNKDKNLKNLLLDPYFKDIAHNYQGDLRTVVAEAVKAGIPVPTFTAAISYYDSYRSEVLSANLIQAQRDYFGAHTYERVDKPGVFHTEWPQVED

SEQ ID NO: 20880 - protein, 757 aa, Diospyros kaki
MLKTLASVILISSFLSSASSADNGYPRCDCTVEGFLSPESIMQCQKASDLLIAVAYFSIPIELLYFVSCSNLPFKWVLFEFIAFIVLCGMTHLLTGWTYGPHSFHLMLALTVFKFLTALVSFATAITLLTLIPLLLKVKVRELLLKKKAWDLGREVGIIKKRSEAGWCVRMLTQEIRRSLNRHTILDTTLVELSKTLDLQNCAVWMPNEDRTEMVLTRDLGTIGSYMCKASIPIGDPDVREIKGSEQVKMLEPGSALAASSARGCVEFGPVAAIRMPMLTVADFKGGTPQMIQTWYAVLVLVLPGGQDRWWSNEELEVVKVVADQVAVAISHAALLEESQLMRNQLVERNRVLQRARQDAMMASQARNSFQQVMNDGMRRPMHSVLGLLSLMQDEKLSSELQILVKAMVKTSNVLSTVIDDVMDISIKNNGRFPLQMRSFQLHSMIKEAACLARCLCVFRGYEFEIEVEKSLPNHVMGDDRRVFQVILNLLGNLLSGNGGGGCVTFRVSSDRGSRDRNAAKWAMWRPILSDGNVCVRFEIGIRTNDSTLGVQFGGQSYCSDAIEECLSFNVCERLVQLMQGHLFVVSNSDGFDQSITVMLRFHLSPPIEIDLSVTGDSSDHPHSTSLFRGLQVLVVDGDDMNRAVTRKLLKRLGCMVSDVASGYECLNAVGSGVPSFQILLLDLHLQDLDALQIAVAIRKFRTHSWPLIIALTSSAVEDIWGRCLQIGMNGVLRKPVLLEGMAEELRRVLMLPNRDV

SEQ ID NO: 20881 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQDALSYRSNTAVRLQ

SEQ ID NO: 20882 - protein, 95 aa, Oxalis tuberosa
  misc_feature (81)..(81): Xaa can be any naturally occurring amino acid
  misc_feature (89)..(89): Xaa can be any naturally occurring amino acid
LYAGINISGTNGEVMPGQWEYQVGPSVGIEAGDHIWASRYILERITEQAGVVLTLDPKPIDGDWNGAGCHTNYSTKSMRDXGGFEVIKXAILNLS

SEQ ID NO: 20883 - protein, 379 aa, Citrullus lanatus
MAMKCMMSTGESKEMKSKLHRVEFGCSEESMVPENFVWPDEFKAKDGAPELHVPHIDLHKFLNGNESDIEEATRLVDEACRKHGFFVLVNHGVDMELIKGVHECMDEFFTLPFDVKQKSQRKFGENYGYANSFIGRFSNNLPWKETLSLPYVANHNSTSVQDFVSKCVGPELSHQGKVYQECGKALSDLSLKIVELLGLSLGVPKEKFKKFYEDNDSIIRLNYYPPCEKPELTLGTGPHCDPTSITILHQDHVSGLQVYVDDEWHSIPPTKDSFVINIGDTFMALTNGVYKSCFHRAVVNCKEVRKSMAFFLCPAADKVVRAPDEVVEKNPPRKFPDYTWPMLLELTQKFYRADSNTFQAFIPWLEKQKSANTIAPPAL

SEQ ID NO: 20884 - protein, 259 aa, Chlamydomonas incerta
MAFKFPKLPGSTPAGTTKKAGTTATKPAPKATTTKKVAVNTGTRSGGVGYRKYQGDALWLPNTARPEWLDGSLPGDRGFDPLGLSKPSEFVVIGVDENDQNVGKNNKGTVEAIVQASPDEVSSENRLAPYSEVFGLARFRECELIHGRWAMLACLGALVAEATTGVSWVEAGKVELDGASYAGLSLPFSITQLIWIEVILVGGAEFYRNTETDPEKRCYPGGVFDPLKLASEDEERAFRLKTAEIKHARLAMVSFFGYG

SEQ ID NO: 20885 - protein, 296 aa, Unknown
  uncultured bacterium
NSRLCMSSAVAGYMQSLGSDGPPACYDDLEQTDLAFLIGTNTAECHPIVFNRLQKQHKKNRNMKLVVVDPRRTPTAEAADIHLPIRPGTNIDLLHGIANLLMKWGYIDSLFIDECTRGFPEYAEVFQQYEPEQVARRCGIKLSDLEQVARLWGKSDRILSLWSMGFNQYAEGTAKVRTLINLHLITGTIGKPGCGPFSLTGQPNAMGGREAGGLSHILPGYRVVKNPDHRAEVERAWGLPPGSISPQAGRDAWAMIRGLEQDEVGVLWVAATNPAVSMPDLERTKKALDKSPFTIL

SEQ ID NO: 20886 - protein, 290 aa, Unknown
  uncultured bacterium
NSRLCMPSAVSGYIQSFGSDGPPCCYEDLEQTDCAFLIGTNTAECHPIVFNRLHKHCKKNRKVKMIVVDPRRTPTAEAADLHLAIRPGTDIDLLNGIAHLLMRWGKINTLFIDDCTRDFPLYADIIRHYPPELVARKCGIRLDELEKAARYWGDAERVLSLWSMGMNQSSEGTAKVRTLINLHLMTGTLGRPGSGPFSLTGQPNAMGGREAGGLAHILPGYRLVKNPQHRAELEQLWGLKSGQISPEPGLSAWDMILGLETGAVGFLWIAATNPAVSMPDLERTKAALMQ

SEQ ID NO: 20887 - protein, 461 aa, Unknown
  Burkholderia sp. 383
MVSGNESDGLKRGLKNRHIQLIALGGALGTGLFLGIAQTIKMAGPSVLLGYGVAGIIAFFIMRQLGEMVVDEPVAGSFSYFADKYVGHFTGFLSGWNYWVLYILVSMAELSAVGIYVQYWWPGVPTWVSALVFFVAINLLNLASVKSYGETEFWFSIIKVAAIVGMIGFGGWLLASGHAGPEASVRNLWQHGGFFPNGVSGLVMSMAAIMFSFGGLELIGITAAEADDPKRSIPRATNQVIYRILIFYIGALAVLLSLYPWEKVVTGGSPFVLIFHALSSNLVANVLNVVVLTAALSVYNSGVYSNSRMLFGLAKQGNAPKVLCSVNKRGIPLAALGASALATGVCVLVNYFMPGKAFEVLMGLVVSALIINWAMITLIHLKFRQAKRAAGEETSFRSLGYPFTNYLCLAFMAGILVVMYLTPDLRLSVYLIPVWLAVLAVGYRFRQKNAGYAVHDSASAR

SEQ ID NO: 20888 - protein, 502 aa, Arabidopsis thaliana
MGKVAVATTVVCSVAVCAAAALIVRRRMKSAGKWARVIEILKAFEEDCATPIAKLRQVADAMTVEMHAGLASEGGSKLKMLISYVDNLPSGDETGFFYALDLGGTNFRVMRVLLGGKHDRVVKREFKEESIPPHLMTGKSHELFDFIVDVLAKFVATEGEDFHLPPGRQRELGFTFSFPVKQLSLSSGTLINWTKGFSIDDTVDKDVVGELVKAMERVGLDMLVAALVNDTIGTLAGGRYTSPDVVVAVILGTGTNAAYVERAHAIPKWHGLLPKSGEMVINMEWGNFRSSHLPLTEYDHSLDVDSLNPGEQILEKIISGMYLGEILRRVLLKMAEEAAFFGDIVPPKLKIPFIIRTPNMSAMHSDTSPDLKVVGSKLKDILEVQTSSLKMRKVVISLCNIIASRGARLSAAGIYGILKKIGRDATKDGEAQKSVIAMDGGLFEHYTQFSESMKSSLKELLGDEVSESVEVILSNDGSGVGAALLAASHSQYLELEDDSETS

SEQ ID NO: 20889 - protein, 292 aa, Unknown
  Rhodococcus sp. RHA1
MTKWTASDIVDQSGRTFVVTGANSGLGEVAARALGKAGAHVVLACRNTHKGEVVARSIGDNAEVRRLDLSDLASVREFAAGVESVDVLVNNAGVMAVPQRTTADGFEMQIGTNHLGHFALTGLLLDKITDRVATMSSAAHQAGTIHLDDLNWERRKYNRWSAYGQSKLANLLFTYELQRRLSAAGSPVKAVAAHPGYASTNLQAHTESVQDKLMAVGNRIFAQSAEMGALPMLYAATAPDVIGGSYIGPDGLFEQRGHPKVVGSNKKSRDEHTAGALWSLSEDLTGVEFTFR

SEQ ID NO: 20890 - protein, 403 aa, Photobacterium profundum
MSELYDVIIIGGGAGGMSAGVYAARGKMKTLIIEEKRKAGGQAATTDEMENYPGILSATGPELMDAFRAHCDKFGVEFTKGIVNKIDVADDGYLKTLTTTKGEVFQAKSIIIGTGASPLILGVPGENEFRGKGVSYCATCDADFFEELDIVVVGSGNTAVEESLFLTKFVNKITMIVRRDHGILAADRTAQEQAFANDKINFVWNSVLDEITGDELVNGVNVKNIKTGEISHIESDGVFMFVGTVPKTDFIKGLIDLNSHGYIVTNDKQETNIPGIYAVGDVTEKFLRQVVTAAGDGAVAAVAADRYIEEEDNWRKSVVDFDGTALVAFWAPQNQDSIDVINQLEAQNKGQAGKNVVTIDIFKNQKIAKQFNVSEIPVVIRFDAGQEAKRVNVKDLNELETLY

SEQ ID NO: 20891 - protein, 295 aa, Unknown
  uncultured bacterium
NSRLCMSSAVSGYIQSFGSDGPPCCYEDLEQTDYAFLIGTNTAECHPIVFNRLHKHCKKNRKVKMIVVDPRRTSTAEAADLHLAIRPGMDIDLLNGIAHLLMRWGKINTLFIDDCTRDFPLYADIIRHYPPELVARKCGIRLDELEKAARYWGDSERVLSLWSMGMNQSSEGTAKVRTLINLHLMTGTLGRPGSGPFSLTGQPNAMGGREAGGLAHILPGYRLVKNPQHRAELEQLWGLKSGQISPEPGLSAWDMILGLETGAVGFLWIAATNPAVSMPDLERTKAALNSPHLRY

SEQ ID NO: 20892 - protein, 112 aa, Ralstonia solanacearum
MKLIMAIIKPFKLDEVREALSQVGVSGITVTEVKGFGRQKGHTELYRGAEYIVDFLPKVKIEVAVPDDVLERAVEAIEKSARTGKIGDGKIFVTDVEQVIRIRTGETGGDAL

SEQ ID NO: 20893 - protein, 219 aa, Unknown
  uncultured bacterium
NSRLCMSSAVAGYTRSLGSDGPPCCYEDLDDCSVAFLIGTNTAECHPVLFQRLLKRKKRNPKDVTVVVVDPRATDTTKAADHHLAIKPGSDLALLHGIAHLVLEAGGLDADFIEEATEGLADFAQLIAGATPARTAELCGISEAQLRQVAALWAQRDRVLSLWSMGVNQRREGTAVVCGLINLHLLTGQIGKPGAGPFSLTGQPNAMGGREAGGLAQLL

SEQ ID NO: 20894 - protein, 164 aa, Burkholderia thailandensis
MHEARARGIFGRSACPFPGLFFDSTDSRMTDVTDDAPSQPTAFELVGGEARVRELVDRFYDLMDLEPEFAGIRALHPPTLDGSRDKLFWFLCGWLGGPDHYIERFGHPRLRARHLPFPIASSERDQWLRCIAWAMQDVGLDEPLRERLMHSFYDTADWMRNRPG

SEQ ID NO: 20895 - protein, 219 aa, Unknown
  uncultured bacterium
NSRLCMSSAVAGYTRSLGSDGPPCCYEDLDQCSVAILIGTNTAECHPALFQRLLKRKKRDPKGLTIVVVDPRATDTSRIADHHLAIAPGTDLALLHGLARLIVQNNGFDSDFIDEATEGFAAYAKTIRTWTSAKVAALCGISEKELRQVARLWSRSQGVLSLWSMGVNQRREGTAVVSGIINLHLLTGQIGKPGAGPFSLTGQPNAMGGREAGGLAHLL

SEQ ID NO: 20896 - protein, 205 aa, Arabidopsis thaliana
MMMGLLMSGLIVSQANLPTAFASTPVFREYIDTFDGYSFKYPQNWIQVRGAGADIFFRDPVVLDENLSVEFSSPSSSNYTSLEDLGSPEEVGKRVLRQYLTEFMSTRLGVKRQANILSTSSRVADDGKLYYQVEVNIKSYANNNELAVMPQDRVARLEWNRRYLAVLGVENDRLYSIRLQTPEKVFLEEEKDLRRVMDSFRVEKI

SEQ ID NO: 20897 - protein, 180 aa, Bacteroides fragilis
MKAFFSFVAALVLSLSMAAQNKSFYDFTVKTIDGKEYPLSGLKGKKVLVVNVASKCGLTPQYAELQELYDQYKDQNFVIIGFPANNFMGQEPGTNEEIAKFCSVNYDVTFPIMAKISVKGKDMAPLYHWLTEKKLNGKQDAPVQWNFQKFMIDENGNWVGFVAPKESPFSETIISWIEKK

SEQ ID NO: 20898 - protein, 151 aa, Arabidopsis thaliana
MLLCVNVFGNNFYWKNLTNQMDIFSCRSDDLSLANQKTQILKLSGKTKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 20899 - protein, 257 aa, Hordeum marinum
CELDNIMRLTGITGIVNGMDVSEWDPTKDKFLTANYDITTALEAKALNKEALQAEVGLPVDRKVPLVAFIGRLEEQKGPDVMIAAIPEIVKEEDVQIILLGTGKKKFERLLKSVEEKFPGKVRAVVRFNAPLAHQMMAGADLLAVTSRFEPCGLIQLQGMRYGTPCACASTGGLVDTIVEGKTGFHMGRLSVDCNVVEPADVKKVATTLKRAVKVVGTPAYQEMVKNCMIQDLSWKGPAKNWEDVLLELGVEGSEPG

SEQ ID NO: 20900 - protein, 244 aa, Zea mays
  misc_feature (53)..(53): Xaa can be any naturally occurring amino acid
MALAPTSAAVLKTPFLGARRALAKPAPRRALVIAAAAAAKKSWIPAIKSDAEXVNPPWLDGSLPGDFGFDPLGLGKDPAFLKWYREAELIHGRWAMAAVLGIFVGQAWSGIPWFEAGADPSAIAPFSFGSLLGTQLLLMGWVESKRWVDFFNPDSQAVEWATPWSRTAENFANFTGEQGYPGGKFFDPLGLAGTVKDGVYIPDVDKLERLKLAEIKHARIAMLAMLAFYFEAGQGKTPLGALGL

SEQ ID NO: 20901 - protein, 257 aa, Hordeum murinum
CELDNIMRLTGITGIVNGMDVSEWDPTKDKFLAVNYDITTALEAKALNKEALQAEVGLPVNRKVPLVAFIGRLEEQKGPDVMIAAIPEIMKEEDVQIILLGTGKKKFERLLKSVEEKFPGKVRAVVRFNAPLAHQMMAGADLLAVTSRFEPCGLIQLQGMRYGTPCACASTGGLVDTIVEGKTGFHMGRLSVDCNVVEPDDVKKVATTLKRAVKVVGTPAYQEMVKNCMIQDLSWKGPAKNWEDVLLELGVEGSEPG

SEQ ID NO: 20902 - protein, 125 aa, Glycine max
MASATVSSTAGTAGNRAGAGMEATFTGLKCKGGFPTRKTNNDITYIGSNGGRGQCMQVWTPIGNKKCETISYLPDLDDAQLAQEVEYLLRKGWIPRLEFEMEHGFVYREHNRSPGYYDGHYWTMW

SEQ ID NO: 20903 - protein, 257 aa, Hordeum brevisubulatum
  misc_feature (53)..(53): Xaa can be any naturally occurring amino acid
  misc_feature (63)..(63): Xaa can be any naturally occurring amino acid
  misc_feature (185)..(185): Xaa can be any naturally occurring amino acid
CELDNIMGLTGITGIVNGMDVSEWDPTKDKFLAVNYDITTALEAKALNKEALXAEVGLPVDRXVPLVAFIGRLEEQKGPDVMIAAIPETVKEEDVQIILLGTGKKKFERLLKSVEEKFPGKVRAVVRFNAPLAHQMMAGADLLAVTSRFEPCGLIQLQGMRYGTPCACASTGGLVDTIVEGKTGXHMGRLSVDCNVVEPADVKKVATALKRAVKVVGTPAYQEMVKNCMIQDLSWKGPAKNWENVLLELGVEGSEPG

SEQ ID NO: 20904 - protein, 257 aa, Hordeum bulbosum
CELDNIMRLTGITGIVNGMDVSEWDPTKDKFLAVNYDITTALEAKALNKEALQAEVGLPVDRKVPLVAFIGRLEEQKGPDLMIAAIPEIVKEEDVQIILLGTGRKKFEKLLKSMEEKFPGKVRAVVRFNAPLAHQMMAGADLLAVTSRFEPCGLIQLQGMRYGTPCVCASTGGLVDTIVEGKTGFHMGRLSVDCNVVEPADVKKVATTLKRAVKVVRTPAYQEMVKNCMIQDLSWKGPAKNWEDVLLELGVEGSEPG

SEQ ID NO: 20905 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQNSFVCRSVGTIDLQ

SEQ ID NO: 20906 - protein, 257 aa, Hordeum jubatum
CELDNIMRLTGITGIVNGMDVSEWDPTKDKFLAVNYDITTALEAKALNKEALQAEVGLPVDRKVPLVAFIGRLEEQKGPDVMIAAIPEIVKEEDVQIILLGTGKKKFERLLKSVEEKFPGKVRAVVRFNAPLAHQMMAGADLLAVTSRFEPCGLIQLQGMRYGTPCACASTGGLVDTIVEGKTGFHMGRLSVDCNVVEPADVKKVATTLKRAVKVVGTPAYQEMVKNCMIQDLSWKGPAKNWEDVLLELGVEGSEPG

SEQ ID NO: 20907 - protein, 428 aa, Streptomyces coelicolor
MTTLSPYDSMSPVTRAAYRAKSAAADLAPLPRAAKDDALLAVADALEVRTSEIVEANAQDVAKARAAGTSEAIVDRLTLTPERVRAIASDVRDVVALPDPVGEIVRGSTLPNGIDLRQVRVPLGVVGIIYEGRPNVTVDAAALCLKSGNAVLLRGSSSAYRSNTALVRVVRDAVGGAGLPADAVQLVPGESRESVRELMRARGLVDVLIPRGGASLISTVVQESTVPVIETGTGNCHVYVDAHADLDMAVDILINSKAQRVGVCNAAETLLVHQDVAAEFLPRALAALAEAGVTVHADERVMAHAKDSGANVVEATPEDWETEYLSYDIAAAVVDSLDRAVEHIRLWTSGHTEAIVTTSQQAARRFTQLVDSTTVAVNTSTRFTDGGQFGFGAEIGISTQKLHARGPMGLPELTSTKYIVTGDGHVRR

SEQ ID NO: 20908 - protein, 500 aa, Prosthecochloris aestuarii
MNILLLYPEFPDTFWSFKHALTFISRKASLPPLGLLTVSAMLPGTWNRRLVDLNVTSLDAEDLAWADVVFISAMGVQQKSARELISRCSQAGIVTVAGGPLFTSEPECFPEVDHFVLNEAETTLPLFLDDLATGNPGKYYRSDDFPSIKTSPIPDWGVLDMKKYASMAIQFSRGCPFQCDFCNVTALFGHKIRTKSSQQIIEELNGLKENGWQDSVFFVDDNFIANKTYLKKVLLPELIEWQAHNRTTTKFYTECSINIADDAELMDLMVKAGFNQVFIGIETPDNSALEACGKQHNTSRDLLENVKTIQRAGLEVQAGFIVGFDTDTPSIFRQQIEFIQQSGIVTAMVGLLQALPGTRLYERMKREGRLRCSSTGDNVDSTTNIVPVMDLETLQNGYRDMMHYLYSPKNYYHRIQTLLKEYRQPQFKSRFRPGQLVAFARSTVILGIIGEERLQYWKMLLWTLFRKHESLSLAVTLSIYGYHFRKVCALHLKKEASLSP

SEQ ID NO: 20909 - protein, 210 aa, Unknown
  Synechocystis sp. PCC 6803
MPESSTPSLLIPNFPPRAAAVHRVTKETDVRVSLNLMGSGLCHVATGVPFLDHMLHQIASHGLIDLEVNATGDIEIDDHHTNEDVGITLGQALAEALGDRRGINRFGHFIAPLDEALVQVTLDFSGRPHLSYGLQIPTERVGTYDTQLVREFFVAVVNHSQMTLHIRQLDGINSHHIIEATFKAFARAMRMAIEVDPRRADTIPSSKGVL

SEQ ID NO: 20910 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQSVHSNRSDTARNLQ

SEQ ID NO: 20911 - protein, 314 aa, Unknown
  Candidatus Kuenenia stuttgartiensis
MQVGILKDNDMPRKVRCNSILERIGNTPLIRINKITKELQKRNVEIYVKAEWFNPGGSVKDRPALRIVEDAEKSGKLGGDKILIDSTSGNTGIAYAFIGAVKGYEVNLVMPLNVSEERKRIVSAFGTKTIYTDPLLGSDGAMNEAKRLVNETPAKYFYGNQYNNPSNWMSHYETTGVEIWKQTEGNLTHFIACLGTSGTLMGTGKRLKKFNSNIQVISVEPDTSIHGLEGMKHMETSITPGIYNEDFPDRKMYVETEDAYKLVKRLAAEEGFFVGYSSGAALAASLKVADEIKNGMIVTIFPDRGDRYLSTSFW

SEQ ID NO: 20912 - protein, 159 aa, Aspergillus oryzae
MAPKAAEKKPSTGGKAPAGGKAPAEKKEAGKKTAAAASGDKKKRGKTRKETYSSYIYKGVWQRYPSSESRKLTINLVLKQVHPDTGISTRAMSILNSFVNDIFERVATEASKLAAYNKKSTISSREIQTSVRLILPGELAKHAVSEGTKAVTKYSSSAK

SEQ ID NO: 20913 - protein, 374 aa, Streptomyces coelicolor
MAGARQAVGEARRIVVKVGSSSLTTAAGGLDADRVDALVDVLAKMRGADKEVVLVSSGAIAAGLAPLGLPRRPRDLARQQAAASVGQGLLVARYTASFARYGVRVGQVLLTSDDMSRRAHHRNASRTLDKLLAMGAFPIVNENDTVATDEIRFGDNDRLAALVAHLVRADLLVLLSDVDGVYDGDPSRPGTSRLAEVRDMGDLAGVDIGSAGKAGVGTGGMVTKVEAARIAAAAGIPVVLTSAVHAADALAGGDTGTYFHATGRRSADRLLWLQHASAPQGALVLDDGAVRAVVEGRKSLLPAGIAGVEGDFAAGDPVELRDGTGRAVARGLVNFDAKEMPRLIGRSTRELARELGPAYEREVVHRDDLVILHP

SEQ ID NO: 20914 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQTFGDPRSVAEDVLQ

SEQ ID NO: 20915 - protein, 614 aa, Aspergillus nidulans
MTVSTITNNPVDVPLGKFPATQPAELSAADADRVAQTVIDQFNSALTKQDDKSIAALFFKDGYWRDHLCLAWDLYTAKGHDGIASFLDRTRPRAIHVEVDRSSDFRRPTACALDGLGNSYGIQFFTTIDLESGRGRGIVRLAKNDGEWKILTFFTSLLELKGHEEPLNGRRSKGVEHGGRPDRKNWQERREADAEFMDREPSVLIIGAGQGGLTAAARLKMLNVDTLVIDKNSRIGDNWRQRYKQLVLHDPVWYDHMPYLSFPPHWPVFTPKDKLAEWFESYAKILELNVWTRTTLKTPSWDGKQWTVILERRAPDGSLTSRTVHPRHIIQATGHSGEKYIPPIPGIDSFKGDRICHSSDFTGALHEHRGKKAIVIGSCNSGHDIAQDFYEKGYDVTMVQRSTTCVISSEAITDIGLKGLYDEQAPPTEDADLWFWGMPAELLKTQQIGVTAIQNKHDEATIKGLEEAGFKVDNGPNGAGLLIKYFQRGGGYYIDVGASQLIVDGHIKIKQGVEISEIQSHGLKFADGTELEADEIVLATGYQNMRTQTRRLFGDETADAVGDVWGFDEHGEMRGIWRPSGHKGLWFMGGNLAISRYYSRILALQIKAAELRLS

SEQ ID NO: 20916 - protein, 508 aa, Candida glabrata
MKLAYLAGVAAVLSQVDAFSLSGAQDYFYNKSPVQNTLKNIFPAHLDDISFGTRRRSGIKKKKNWDAVVKMEGLEGHQLRVNKIVNPKKLGVDPHVKQLTGYLDNELEDKHFFFWFFESRNDPKNDPVILWLNGGPGCSSLTGLFFELGPSSIDGQKLKPVKNPFSWNSNASVIFLDQPVNVGFSYAGSNSNGGVSNTVAAGKDVYAFLQLFFKQFPQYADGQDFHIAGESYAGHYIPVFASEILAHPQKERHFNLTSVLIGNGLTDPLTQYRYYKPMACGEGSGADPVLSPEECSAMEDSLDRCLSLIDACYQSESVWACVPASIYCNNAQLAPYQRTGRNVYDVRKDCEGGSLCYPELQNIDDYLNMDYVREAVGAEVDHYESCNFDINRNFLFNGDWMKPYHKQVIEILEKGLPVLIYAGDKDFICNWMGNRAWTDELQWKYSSGFAQEPVRNWTASITGEVAGEVKSYENLTFLRLFDGGHMVPYDQPESSLSMLNEWIHKFHL

SEQ ID NO: 20917 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQTPRYVRSRDGNELQ

SEQ ID NO: 20918 - protein, 292 aa, Pseudomonas syringae
MSRIVSVAATQMACSWDLEANIETAEKLVREAAAKGAQIILIQELFETPYFCQKPNPDYLQLATTLESNVAIKHFQKIAKELQVVLPISFFELAGRARFNSIAIIDADGSNLGIYRKSHIPDGPGYHEKYYFNPGDTGFKVWQTRYAKIGVGICWDQWFPECARSMALQGAEILFYPTAIGSEPHDKTISSRDHWQRVQQGHAGANLMPLIASNRIGNEEQDGYDITFYGSSFIANQFGEKVAELNETEEGVLVHSFDLDELEHIRSAWGTFRDRRPNLYGAVKTLDGSLES

SEQ ID NO: 20919 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQDYTNIRSGGVDTLQ

SEQ ID NO: 20920 - protein, 721 aa, Prochlorococcus marinus
MEGQNKSITFDGREIRLTTGLYAPQASGSVMIECGDTSLLVTATKTAKKEPSDFLPLICDYEEKLFAAGRIPGGFMRREGRPPERATLIARLIDRPMRPLFPTWMGDEIQIVASCLSLDERVPADVLAVTGASIATLVGEIPFYGPMAAVRVGLIGDDFILNPSYREIEKGDLDIVVAGSPDGIVMIEAGANQLSEQDTIEAIDFGYEAVTELIKSQEDLLQDLGIKQIKPSEPEEDKTLPSYLEKNCTKPIELVLKKFDLSKEERDLELEKIKTETQSKIDSLKDDNQVKVLTSENEKLLHSDFKKLTKKLMRSQIINDGKRVDGRDLDEVRKISASAGILPKRVHGSALFQRGLTQVLSTTTLGTPSDAQEMDDLNPSTEKTYLHHYNFPPYSVGETRPMRTPGRREIGHGALAERAIIPVLPGKETFPYVLRVVSEVLSSNGSTSMGSVCGSTLSLLDAGVPLKAPVSGTAMGLIKEGKEVRILTDIQGIEDFLGDMDFKVAGTDKGITALQMDMKITGLPVSIISDAIKKARPARIHILEKMQGAIDKPQESLSPHAPRLLSFRIDPELIGTVIGPGGRTIKGITERTNTKIDIEDGGIVTIASHDGAAAEEAQKIIEGLTRKVHEGEIFSGVVTRIIPIGAFVEILPGKEGMVHISQLSEARVERVEDVVRQGDEVTVRVREIDSRGRINLTLRGVGQNNGMSYPEPTPTPVAPLN

SEQ ID NO: 20921 - protein, 461 aa, Zea mays
  misc_feature (171)..(171): Xaa can be any naturally occurring amino acid
MEPRRISASPRPCSGRRVVARKRPRQEAVVSSVRKLQRREISSRRDRTFTMSAAQERFRNIQLQEEFDTHDPKENASLLPYLRKRSKIIEIVAARDIVFALSQSGVCAAFSREANERICFLNGSPDEVIRSLFYNKNNDSLITVSVYGSENFSALRCRTTRIEYIRRGQPXAGFPLFESESLKWPGFVEFDDVNGKVLTYSAQDSTYKVFDLKNYTLLYSVSDKNVQEIKISPGIMLLIYTRTNSSVPLKILSIEDGTVLKSFSHLLHRNKKVDFIEQFNEKLLVKQEGENLQILDVRNFQLTEVSRTEFMTPSAFIFLYELQLFLTFRNRSVAVWNFRGELVTSFEDHLLWHPDCNTNNIYITSDQDLIISYCKADSTDSSSEENAGSINISSILTGKCLAKINPGNSRKQKDPCKQKKVWRFQNTVSEALEDITALYYDEDRDEIYTGNRHGLVHVWSN

SEQ ID NO: 20922 - protein, 95 aa, Oxalis tuberosa
  misc_feature (13)..(13): Xaa can be any naturally occurring amino acid
  misc_feature (28)..(28): Xaa can be any naturally occurring amino acid
LYAGINISGTNGXVMPGQWEYQVGPSVXIEAGDHIWASRYILERITEQAGVVLTLDPKPIDGDWNGAGCHTNYSTKSMRDEGGFEVIKKAILNLS

SEQ ID NO: 20923 - protein, 219 aa, Unknown
  uncultured bacterium
NSRLCMSSTVAGYTRSLGSDGPPCCYEDLDQCSVAVLIGTNTAECHPVLFQRLLKRKKRDPKSLTIVVVDPRATDTSRIADHHLAIAPGTDLALLHGLARLIVQDNGFDSDFIDEATEGFAAYAKTIRTWTSAKVAALCGISEKELRQVARLWSRSQGVLSLWSMGVNQRREGTAVVSGIINLHLLTGQIGKPGAGPFSLTGQPNAMGGREAGGLAHLL

SEQ ID NO: 20924 - protein, 139 aa, Gibberella zeae
MRSIDPVGNVAGVVHRTALPRISIAISDIAIGLLRLLIFHQSLNMSYKVTIKTPNEDYTFNCGSDEYILDVAESNGIKLPYSCRAGVYSSCAGKLVSGTIQQDDQDFLDSDQVEAGYVLLCIAYPTSDCIIKANAEDEL

SEQ ID NO: 20925 - protein, 219 aa, Unknown
  uncultured bacterium
NSRLCMSSAVAGYTRSLGSDGPPACYDDLDHCSVAVLIGTNTAECHPVLFQRLIKRKKRHPGSVTIVVIDPRRTDTAKAADIHLPIAPGTDLALLHGIAHLVMRENGQDVAFIDDHTENYKPFFDVVARWTPRKVARFCGIPEKRLREVAELFHRKEKVLSLWSMGVNQRREGTAVVQGLINLHLLTGQISKEGAGPFSLTGQPNAMGGREAGGLAHLL

SEQ ID NO: 20926 - protein, 219 aa, Unknown
  uncultured bacterium
YSRLCMSSAVAGYTRSLGSDGPPACYDDLDHCSVAILIGTNTAECHPVLFQRLIKRKKRHPGSVTIVVIGPRRTDTAKAADIHLPIAPGTDLALLHGIAHLVMRENGQDVAFIDDHTENYKPFFDVVARWTPRKVARFCGIPEKRLREVAELFHRNEKVLSLWSMGVNQRREGTAVVQGLINLHLLTGQIGKPGAGPFSLTGQPNAMGGREAGGLAHLL

SEQ ID NO: 20927 - protein, 219 aa, Unknown
  uncultured bacterium
NSRLCMSSAVAGYTRSLGSDGPPACYEDLDHCSVAFLIGTNTAECHPVLFQRLLKRKKRNPGSVTIVVVDPRSTDTAKAADIHLPIAPGTDLALLHGLAHLVLRENGQDPAFIDDRTENYDAFFDVAARWTPRKVARFCNIPEKRLREVAELFHRRERVLSLWSMGVNQRREGTAVVGGLINLHLLTGQIGKEGAGPFSLTGQPNAMGGREAGGLSHLL

SEQ ID NO: 20928 - protein, 600 aa, Corynebacterium efficiens
MTASVQDPHALSAEWLNQLSDTTTAGDPDAVADLFEEEGYWRDLLAFTWNLTTAEGVEQIRQMISATHPRCAISDVEVTEAIEESPGVLRVQFTFDTAEFHSRGIARLRDGKCWTLLTSARGLKKHPEPAGRRRPQGAEHGVHPDRKNWHDQRAERRATLGRSEQPYTLIIGGGQGGIALAARLKRLGVPTIVVDKHDRPGDQWRSRYYSLCLHDPVWYDHLPYLPFPDDWPVFTPKDKMGDWLEHYVGIMDLDFWPRTECTSAEFNEETGTWTVHVTRDGEKLELHPTQLVLATGMSGVPNRPHLPGQENFKGEIRHSSEHPGGPGDAGKNVVILGANNSAHDIAADLYENGAHPIMIQRSSTHIVRSESLMREVFGPLYSEDALEAGIDTDTADLLFASWPYAILPDVQRPAFDKIREADAEFYSRLEKAGFLLDFGDDDSGLFLKYLRRGSGYYIDVGASDLVADGSIPVRSGVSIDHVTEDSVVLTDGTELPADVIILATGYGSMNGWAAELISQDVADRVGRVWGLGSDTTKDPGPWEGELRNMWKPTQVDNLWFHGGNLHQSRHYSRYLALQLKARYEGMDTPVYGLAPVHHAS

SEQ ID NO: 20929 - protein, 198 aa, Triticum aestivum
MGWGEVKRVTKETNVHVKINLDGTGVANSSTGIPFLDHMLDQLASHGLFDVYVKATGDTHIDDHHSNEDIALAIGTALLQALGDRKGINRFGHFTAPLDEAAVEVILDLSGRPHLSCGLSIPTERVGTYDTQLVEHFFQSLVNTSGMTLHIRQLAGNNSHHIIEATFKAFARALRQATEYDLRRQGTMPSSKGVLSRS

SEQ ID NO: 20930 - protein, 219 aa, Unknown
  uncultured bacterium
NSRLCMSSAVAGYTRSLGSDGPPCSYEDLDHCTVAFLIGTNTAECHPVLFQRLLKRKRKNPSSVTIVVVDPRRTDTAKAADIHLPIAPGSDLALLHGIAHLVLRDNGQDPAFIDDHTENYDAFFDVAARWTPRRVALFCNIPEKRLREVAALFHRREKVLSLWSMGVNQRREGTAVVQGLINLHLLTGQIGKEGAGPFSLTGQPNAMGGREAGGLAHLL

SEQ ID NO: 20931 - protein, 338 aa, Ralstonia solanacearum
MRISVLGAGAWGTALASHAAQSHDVVLWGRDAALVAQMAATRANERYLPGIPLHASLRFEAEMSAALDHATGEDALVVIASPVAGLADLTRGVAAHGGVRNVIWLCKGFDPESGALPHAIVAGVLAQTGRADLATGALSGPSFAKEVAQGLPCAMTVASASTALCTRTQRAFHHHAMRVYASDDLVGVEVGGAVKNVLAIATGAADGLGLGLNARAALVTRGLAEMTRLGTALGGRPETFMGLTGMGDLLLTATGDLSRNRTVGMQLAQGRSLDEILAHLGHVAEGVRCARAVAALARAKGVDMPITFAVCEVLFDGLAPSRAVDRLLQRDAKAESVR

SEQ ID NO: 20932 - protein, 87 aa, Glycine argyrea
INISGTSGEVMPGQWEYQVGPSVGIEAGDHIWASRYILERITEQAGVVLSLDPKPIEGDWNGAGCHTNYSTKTMREDGGFEVIKKAT

SEQ ID NO: 20933 - protein, 248 aa, Picea glauca
MEHLNAAAAQASSSLYGVSMAEFGDVGVSSMMALMTQHEPHERDSILTTSMPSSFSSFHGHAECLLSAAMFQASQGDHKLKRQPEMDQLVSEQAVMSDSSMPSVKTEGCSSLRNQFEIRREQTGNCYTDQSSNAPVSPLVTSLVPQAGGEARMITSLEADSSHFSGGNEAEAIKAKILAHPQYPSLLGAYIDCQKIGAPPEVVARLDALTHEYENQQHRTTVSIGMDPELDQFMEAYCEMLTKYHEEL

SEQ ID NO: 20934 - protein, 253 aa, Hordeum brevisubulatum
CELDNIMRLTGITGIVNGMDVSEWDPTKDKFLAVNYDITTALEAKALNKEALQAEVGLPVDRKVPLVAFIGRLEEQKGPDVMIAAIPEIVKEEDVQIILLGTGKKKFERLLKSVEEKFPGKVRAVVRFNAPLAHQMMAGADLLAVTSRFEPCGLIQLQGMRYGTPCACASTGGLVDTIVEGKTGFHMGRLSVDCNVVEPADVKKVATALKRAVKVVGTPAYQEMVKNCMIQDLSWKGPAKNWENVLLELGVEG

SEQ ID NO: 20935 - protein, 257 aa, Elymus elymoides
CELDNIMRLTGITGIVNGMDVSEWDPTKDKFLAVNYDITTALEAKALNKEALQAEVGLPVDRKVPLVAFIGRLEEQKGPDVMIAAIPEIVKEEDVQIVLLGTGKKKFERLLKSVEEKFPGKVRAVVRFNAPLAHQMMAGADLLAVTSRFEPCGLIQLQGMRYGTPCACASTGGLVDTIVEGKTGFHMGRLSIDCNVVEPADVKKVATTLKRAVKVVGTPAYQEMVKNCMIQDLSWKGPAKNWEDVLLELGVEGSEPG

SEQ ID NO: 20936 - protein, 258 aa, Brassica napus
RPTRPASDGVGSKDMVILPYKDSLLLFSRYLQQLVMESLGKEFDLDGNTVNQGLTVYGNKGSTDQHAYIQQLREGVHNFFATFIEVLRDRPPGHDWELEPGVTCGDYLFGMLQGTRSALYANGRESISVTIEEVTPRSVGAIIALYERAVGLYASLVNINAYHQPGVEAGKKAAAEVLALQKRVLSVLNEASCKDPVEPLTLDEIADRCHAPEEIEMIYKIIAHMSANDRVLIAEGSCGSPRSVKVYLGECNVDDMYA

SEQ ID NO: 20937 - protein, 257 aa, Elymus glaucus
CELDNIMRLTGITGIVNGMDVSEWDPTKDKFLAVNYDITTALEAKALNKEALQAEAGLPVDRKVPLVAFIGRLEEQKGPDVMIAAIPEIVKEEDVQIVLLGTGKKKFERLLKSVEEKFPGKVRAVVRFNAPLAHQMMAGADLLVVTSRFEPCGLIQLQGMRYGTPCACASTGGLVDTIVEGKTGFHMGRLSVDCNVVEPADVKKVATTLKRTVKVVGTPAYQEMVKNCMIQDLSWKGPAKNWEDVLLELGVEGSEPG

SEQ ID NO: 20938 - protein, 97 aa, Triticum aestivum
  misc_feature (6)..(7): Xaa can be any naturally occurring amino acid
  misc_feature (21)..(21): Xaa can be any naturally occurring amino acid
  misc_feature (23)..(23): Xaa can be any naturally occurring amino acid
  misc_feature (30)..(30): Xaa can be any naturally occurring amino acid
  misc_feature (36)..(36): Xaa can be any naturally occurring amino acid
  misc_feature (39)..(39): Xaa can be any naturally occurring amino acid
  misc_feature (41)..(42): Xaa can be any naturally occurring amino acid
  misc_feature (44)..(44): Xaa can be any naturally occurring amino acid
  misc_feature (54)..(55): Xaa can be any naturally occurring amino acid
  misc_feature (71)..(71): Xaa can be any naturally occurring amino acid
  misc_feature (74)..(74): Xaa can be any naturally occurring amino acid
  misc_feature (83)..(83): Xaa can be any naturally occurring amino acid
RAPGSXXSPACSPRSSGDYGXGXWPYCMYXGFVMSXSVXGXXRXSKPTVEVSVXXVNCTEDAAAFVALAAXVDXSVDACRLFXQRLRKELCQLDLLG

SEQ ID NO: 20939 - protein, 135 aa, Pasteurella multocida
MRILHTMLRVTNLERSIQFYQQVLGMRLLRTSDNPEYKYTLAFLGYDDEENASVLELTYNWGVTEYELGTAYGHIAIGVEDIYATCDAVRQAGGKITREPGPVKGGKTVIAFVEDPDGYKIEFIENKHAQSGLGN

SEQ ID NO: 20940 - protein, 257 aa, Elymus glaucus
CELDNIMRLTGITGIVNGMDVSEWDPTKDKFLAVNYDITTALEAKALNKEALQAEVGLPVDRKVPLVAFIGRLEEQKGPDVMIAAIPEIVKEEDVQIVLLGTGKKKFERLLKSVEEKFPGKVRAVVRFNAPLAHQMMAGADVLVVTSRFEPCGLIQLQGMRYGTPCACASTGGLVDTIVEGKTGFHMGRLSVDCNVVEPADVKKVATTLKRTVKVVGTPAYQEMVKNCMIQDLSWEGPAKNWEDVLLELGVEGSEPG

SEQ ID NO: 20941 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQYPAPFRSVSVGSLQ

SEQ ID NO: 20942 - protein, 123 aa, Oryza sativa
  misc_feature (21)..(21): Xaa can be any naturally occurring amino acid
  misc_feature (37)..(37): Xaa can be any naturally occurring amino acid
  misc_feature (83)..(83): Xaa can be any naturally occurring amino acid
EIEIYYANYMTQRLQKHYPVXIRDSERTYLHRLIIQXGRFKTTAVLEPDDIAYYQTDYGCHAHTMTGPTPDTLNTEPIAHSMXGRLYRVCGALMHVRNSHSMHRMQQSRCETYSHLRVLSHKT

SEQ ID NO: 20943 - protein, 200 aa, Prosthecochloris aestuarii
MSQPDNHSSRSASVSRRTSETDISIDLNLDGTGTHSISSGVVFLDHMLANFSKHAQIDITLTCKGDTDVDDHHSVEDIALVLGSALLQSLGDKKGIKRYGWSMIPMDEALARCALDLGGRSYSVFNATFNRSVVNGFSTEMVEHFFLSLSRTLHANIHISILEGQNTHHKIEAIFKAFAYALKDAISISGTGIPSTKGVI

SEQ ID NO: 20944 - protein, 257 aa, Elymus glaucus
CELDNIMRLTGITGIVNGMDVSEWDPTKDKFLAVNYDITTALEAKALNKEALQAEVGLPVDRKVPLVAFIGRLEEQKGPDVMIAAIPEIVKEEDVQIVLLGTGKKKFERLLKSVEEKFPGKVRAVVRFNAPLAHQMMAGADLLVVTSRFEPCGLIQLQGMRYGTPCACASTGGLVDTIVEGKTGFHMGRLSVDCNVVEPADVKKVATTLKRTVKVVGTPAYQEMVKNCMIQDLSWKGPAKNWEDVLLELGVEGSEPG

SEQ ID NO: 20945 - protein, 635 aa, Saccharomyces cerevisiae
MAPVTIEKFVNQEERHLVSNRSATIPFGEYIFKRLLSIDTKSVFGVPGDFNLSLLEYLYSPSVESAGLRWVGTCNELNAAYAADGYSRYSNKIGCLITTYGVGELSALNGIAGSFAENVKVLHIVGVAKSIDSRSSNFSDRNLHHLVPQLHDSNFKGPNHKVYHDMVKDRVACSVAYLEDIETACDQVDNVIRDIYKYSKPGYIFVPADFADMSVTCDNLVNVPRISQQDCIVYPSENQLSDIINKITSWIYSSKTPAILGDVLTDRYGVSNFLNKLICKTGIWNFSTVMGKSVIDESNPTYMGQYNGKEGLKQVYEHFELCDLVLHFGVDINEINNGHYTFTYKPNAKIIQFHPNYIRLVDTRQGNEQMFKGINFAPILKELYKRIDVSKLSLQYDSNVTQYTNETMRLEDPTNGQSSIITQVHLQKTMPKFLNPGDVVVCETGSFQFSVRDFAFPSQLKYISQGFFLSIGMALPAALGVGIAMQDHSNAHINGGNVKEDYKPRLILFEGDGAAQMTIQELSTILKCNIPLEVIIWNNNGYTIERAIMGPTRSYNDVMSWKWTKLFEAFGDFDGKYTNSTLIQCPSKLALKLEELKNSNKRSGIELLEVKLGELDFPEQLKCMVEAAALKRNKK

SEQ ID NO: 20946 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQCICTDRSATIIKLQ

SEQ ID NO: 20947 - protein, 1004 aa, Pasteurella multocida
MKRMLINATQKEELRVALVDGQRLFDLDIESPGHEQKKANIYKGRITRVEPSLEAAFVDYGAERHGFLPLKEIAREYFPDDYVYQGRPNIRDILSEGQEVIVQVNKEERGNKGAALTTFVSLAGSYLVIMPNNPRAGGISRRIEGDERLELKDALSSLEVPDGVGLIVRTAGVGKSPEELQWDLKVLLHHWEAIKQASQSRPAPFLIHQESDVIVRAIRDYLRRDIGEILIDSPKVYEKAKAHIKLVRPDFIHRVKLYQGEVPLFSHYQIESQIESAFQREVRLPSGGSIVIDVTEALTAIDINSSRSTRGGDIEETALNTNLEAADEIARQLRLRDLGGLIVIDFIDMTPVRHQREVENRIRDAVRQDRARIQISRISRFGLLEMSRQRLSPSLGESSHHVCPRCQGTGKIRDNESLSLSILRLIEEEALKENTKQVHTLVPVEIASYLLNEKRRAIHSIEKRHDVDVIVVPNEGMETPHFGVFRVREGEEVHELSYNLVKLHQEKDEHFVPEESLVSRNIETAALTSENVLESAAVSMAIPAPAPVPEKKVENKPSLLTRILAKLKAIFADKPVVEEKSKGNRPKSNRNRRQQERRNQRRSRAENVERDSNTKRQDEVVEEVIRPRSERNTKRNRKANHAVDTVSVTENTLDTATVESVEVEKVESVAPRRQRRDLRKKVRISDDVHESALPLVETEISMPEAETVVEETVVATELVPETVPVVEEGETEKRRDNNRRRLPRHLRVNNQRRRRQNQEFKAPMPLFAAVASPELASGKVWPDFQPVVVKENQFLSVDELLEQQHQPKESAATIPALDLVAEGSEKGVSPFNGFVVQPANESVEKKVKQSLQRLEEEQALAIMQPLSVADTKIDEAEGETEHKPLNDVSTELSVKEKDENSLPQSPVEEVVEQVEMPAQGDEVKSISRLQRNYQFSGRLGTISAVPHTTSEMTLAKASDEPLEMCQIGVWTESRYYFHGKGSAGHHSAISHVYAGPTKAENKGE

SEQ ID NO: 20948 - protein, 250 aa, Burkholderia xenovorans
MAVTMRQMLEAGVHFGHQTRFWNPKMAPFIFGHRNKIHIINLEKTLPMYNDALKYARQLAANRGTILFVGTKRQSRDTIAEEAQRAGMPYVNARWLGGMLTNFKTLKVSIKRLKDMEAALEAGETERMSKKEALLFEREMAKLQKSIGGVKDMGGIPDAIFVVDVGYHKIAVTEANKLGIPVIAVVDTNHSPEGIDYVIPGNDDASKAVALYTAGVADAIVEGRANAVNEVVQAARGGDGDEFVEVNAEA

SEQ ID NO: 20949 - protein, 388 aa, Arabidopsis thaliana
MLSSIKPSSSSFSTAISGSVRRSIPTTLNFSPLPIIKNCHNQSFHSNVVSHQKPLHISSASNFKREVKVEAYEADRSRPLDINIELPDEQSAQKLKIGIYFATWWALNVVFNIYNKKVLNAFPYPWLTSTLSLACGSLMMLVSWAIRIADAPKTDLEFWKTLFPVAVAHTIGHVAATVSMSKVAVSFTHIIKSGEPAFSVLVSRFFMGETFPLPVYLSLSPIIGGCALAAITELNFNITGFMGAMISNLAFVFRNIFSKKGMKGKSVSGMNYYACLSMMSLVILTPFAIAVEGPQMWAAGWQNAVSQVGPNFVWWVVAQSVFYHLYNQVSYMSLDQISPLTFSIGNTMKRISVIVASIIIFHTPIQPVNALGAAIAIFGTFLYSQAKQ

SEQ ID NO: 20950 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQFRYNRRSGDVTVLQ

SEQ ID NO: 20951 - protein, 106 aa, Pasteurella multocida
MEVLHSTDATFTADVVNSDVPVLLDFWAPWCGPCRMISPILDEIAAEFSGKVKVVKINIDENQATPAQLGVRSIPTLVLFKNGKAVATQVGALPKNQLANFINQNI

SEQ ID NO: 20952 - protein, 1340 aa, Streptomyces coelicolor
MLEPTEPTESSTTTDSESNTPSDTLPPRRRRRAASRPAGPPSGGSEAPAETVAPAGTAPAEAAEAPEPAPEPAAPARPRRRAVRRASAPAGAPEAAEAAETVVSAAPAAETPVPAEETTESVAATESAAPKGRTRRRATRSVTSAAEPTVSEPAAAAAPEPAAAPEPAAAPEPAAAPEPAVAETQEAESEAEAESAAPKGRTRRRATRRVSAPAEAGDSEAAAAPEPARAAESAAPAKAAEAAESGEDAAPRRARRRSTRKAATGFAAPAQTAAAAADEAEAPKRPSRPAVAVFQAPVFAEPQFQTPERAAAEAAAEAAGAETAKPAEESVGAAPEEQSAASRRRRKRRGAAAEEAAEERAASAVTEDEPAADTQAQSPAETEAEAEAEADADESGDEHDDADGYEESGSRRRRRRGGRRRRRGDSADGDLTDGEGEHTADQADQDGSDTAEQADEDAEESEEAAGESGGSSSSRRRRRRRRRAGDGSGEADSATDDPERTVVKVREPRPAREKSEPSDEVQSIKGSTRLEAKKQRRREGREQGRRRVPIITEAEFLARREAVERVMVVRQHGERTQIGVLEDGVLVEHYVNKEQATSYVGNVYLGKVQNVLPSMEAAFIDIGKGRNAVLYAGEVNFEALGMANGPRRIESALKSGQPVLVQVTKDPIGHKGARLTSQVSLPGRYLVYVPEGSMTGISRKLPDTERSRLKSILKKIVPEDAGVIVRTAAEGASEDELRRDVERLQAQWEDIQKKAKSGGSSNAPSLLYGEPDMTVRVVRDIFNEDFSKVVVSGDDAWQTIHGYVSHVAPDLAERLSKWTSEVDVFATYRIDEQLAKALDRKVWLPSGGSLVIDRTEAMVVVDVNTGKFTGQGGNLEETVTRNNLEAAEEIVRQLRLRDLGGIIVIDFIDMVLESNRDLVLRRLLECLGRDRTKHQVAEVTSLGLVQMTRKRVGQGLLESFSETCVHCNGRGVIVHLDQPSSAGGGGGKRRKRARAGAEQPHEHEHEAVAGIETGPTPEQEADTESETEVAAEVAEPVALPAPDFSADEELYSSAAEAEAAATRGRGRRRASRRASAPAGAPRAAKGEAKAESVKAEAAPAGAPTAQDVTVREEVERPVRREPAAEVLAEPAAVEDAVSGAPAPAAAAETAAPAPEEAAPKGRTRRRATRKVSAPAGSPEGAEAAVLTVPETSTTVSEPSAPEPEQAPEAAPAAAEPAETAAPARPRRRAVRKPTTSTASEEAAVVVVPSAPAEEASDAQPEAAPAKKAAARKTAKKAAAKKAATKKTAAKKTTTAKKATAKKAAKTTTAKKATAKKTASKKTAAAAQQAPSSVSAATDEG

SEQ ID NO: 20953 - protein, 552 aa, Oryza sativa
MGNQCQNGTLGSDYHNRFPREHAVGYVQGDSYLDLKKFDDTWPEVNNFKPTAASILRRGLDPTSINVLGRKTADLREHYIIGRKLGQGQFGTTYLCTEINTGCEYACKTIPKRKLITKEDVEDVRREIQIMHHLSGHKNVVAIKDVYEDGQAVHIVMELCAGGELFDRIQEKGHYSERKAAELIRIIVSIVAMCHSLGVMHRDLKPENFLLLDKDDDLSIKAIDFGLSVFFKPGQVFTELVGSPYYVAPEVLHKRYGPESDVWSAGVILYVLLSGVPPFWAETQQGIFDAVLKGHIDFQSDPWPKISDSAKDLIRKMLSHCPSERLKAHEVLRHPWICENGVATDQALDPSVISRLKQFSAMNKLKKLALRVIAERLSEEEIAGLREMFKAVDTKNRGVITFGELREGLRRFGAEFKDTEIGDIMEAAHNDNNVTIHYEEFIAATLPLNKIEREEHLLAAFTYFDKDGSGYITIDKLQRACGEHNMEDSLLEEIISEVDQNNDGQIDYAEFVAMMQGSNVGLGWQTMESSLNVALRDAPQCQAAEATDEPVH

SEQ ID NO: 20954 - protein, 752 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQCSPISRSTVGRVCSK

SEQ ID NO: 20955 - protein, 347 aa, Idiomarina baltica
MSSSRLIERIAVITSGGDAPGMNAALRAVVLAAEHDGIDVVGFRHGYEGLLNNDYMKLGRDEVEHILQYSGTIIKSARSERFKTDEGGIEAAHNLDAQNVDAFIVIGGDGSFRGANHLAKFWQGPIIGIPGTIDNDLFGTDNTIGYDTAVETAMDALDKIRDTAEAMDRVFIVEVMGRNAGYIAISSAMASGAERMILPELQKDKPLTIDALVKHVEGVNRVRGDSSYVMVLCENQWPGGAVRLAEQLEDRLNFPCRPCLLGHVQRGGRPTAMDRILATRLGVYAVQLVQEGITGVMAGIEKNELVTTPLEDTWVKRKVLSQELIDIQTKCFNPIKKDRHKATVDKA

SEQ ID NO: 20956 - protein, 79 aa, Oryza sativa
RDSHRATALEALRRCQYKFPGRQKIIVSRNWGFTPLRREEYVEKRKEGKIKIDGAYVQFLRNKGNLAQNMRRFPDAFEA

SEQ ID NO: 20957 - protein, 906 aa, Enterococcus faecalis
MKTKLHTQTVTLSIDNQEVTVPKGTTILEAAKGLGVEIPTLCHLKELAPDGSCRMCVVEVEGGRRGGLTTACTAHCQEDMVVATHSEKVADSRRFILDLLLSNHKLECFSCGKNGDCQLQQYALDYGIDVTSFTEGKRMPCHQEDTSNPFFSYDPEKCIMCRRCARVCQLRQGRDVLSIANRGFETKMMPSYGQAFDQSICESCGNCVSSCPTGALTAKDTKEYRKWETQKIPTTCPHCGTGCQMNLLVKNNRLVGVEPLDGPANKNLLCVKGKFASYKFVGSGDRLTEPLIKRNGIFEPASWEEALTLVSSKFNEIKAENGPDALAGFSCSRATNEDNYVFQKMVRAAFGTNNVDNCARVCHSASVHGLAQTLGSGAMTNPIADITEDVDMILLVGSNPEEAHPVIGAQIRQAIQRGTQVVVVDPRKINLVKDSALHLQVQAGTNVAFANGMMHVILKEGLADRHFIEERTEGFLDLEKMVADYTPEKVAEICHIHPEDLIQAARMYAKAEKAPIIYCLGVTEHSTGTEGVMSMSNLAMLVGKVGKPGCGVNPLRGQNNVQGACDMGCMPYDFPGYQKVNNPEVIDKFEKAWHVPLNRNTGLTSTKVLPAATAGSVKGLYIFGEDPIVTDPDTGHVRQALESLDFLVVQELFMTETAAYADVVLPGISYAEKDGTFTNTERRVQRVRKAVEPRGQAREDYEIFCEVMTRMGYPCAYESAKEIMEEISAVTPSFGGINYERLEKESLQWPCRSLTDPGTPIMHVGSFARGKGLFKAIPYKQAQELPDEEYPYLMSTGRMLYHYNTRAMTGRTEGINQIANHSYIEINAVDAQALGIQEGDKVEVHSRRGKIETYAAVGNRVFPQEVFMTFHFPDGNVNEITNAVFDDIATIPEYKVCAVAIKPVNK

SEQ ID NO: 20958 - protein, 95 aa, Oxalis tuberosa
  misc_feature (12)..(12): Xaa can be any naturally occurring amino acid
LYAGINISGTNXEVMPGQWEYQVGPSVGIEAGDHIWASRYILERITEQAGVVLTLDPKPIDGDWNGAGCHTNYSTKSMRDEGGFEVIKKAIFNLS

SEQ ID NO: 20959 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQNIHGPRSGKKVNLQ

SEQ ID NO: 20960 - protein, 583 aa, Securigera parviflora
MCGILAVLCAENSQAKRVRVLELSRRLKHRGPDWSGLHQHGDCYLAHQRLAIVDPASGDQPLFNEDKSLIVTVNGEIYNHEELRKQLPNHKFRTGSDCDVIAHLYEEHGENFVDMLDGIFSFVLLDTRDNTFIVARDAIGVTSLYIGWGLDGSVWISSEMKGLNDDCEHFECFPPGHLYSSKDRAFRRWYNPPWFSETIPSAPYDPLALRHAFEKAVIKRLMTDVPFGVLLSGGLDSSLVASITSRYLATTKAAEQWGSKLHSFCVGLEGSPDLKAAKEVADYLGTVHHEFTFTVQDGIDAIEDVIYHVETYDVTTIRASTPMFLMSRKIKSLGVKWVISGEGSDEIFGGYLYFHKAPNKEEFHRETCRKIKALYQYDCLRANKSTFAWGLEARVPFLDKEFINVAMNIDPENKMIKRDEGRMEKYILRRAFDDEEHPYLPKHILYRQKEQFSDGVGYSWIDGLKEHAAKHVTDKMIFNAANIFPHNTPTTKEAYYYRMIFERFFPQNSARLTVPGGASVACSTAKAVEWDAAWSNNLDPSGRAALGVHLSAYDNQNNLANKPVEFEKIIPMEAPSLGVAIQS

SEQ ID NO: 20961 - protein, 411 aa, Wolinella succinogenes [sequence omitted]

SEQ ID NO: 20962 - protein, 95 aa, Oxalis tuberosa
LYAGINISGTNGEVMPGQWEYQVGPSVGIEAGDHIWASRYILEGITEQAGVVLTLDPKPIDGDWNGAGCHTNYSTKSMRDEGGFEVIKKAIFNLS

SEQ ID NO: 20963 - protein, 553 aa, Salinibacter ruber
MYTLLTNRVCVPSRPWAAHRGGAARTNATEPPKKFRSERTWKRLRFGVVPAFISTPRPFLQAVSSFPMEGSNATPQANGQAESSDGFFGEVNQMFDEAAARTDHPRGVLHQIRACDNIIRFEFPIERDDGSIQVIRGYRGEHSHHMQPTKGGIRYAPSVNVDEVMALSALMSYKCAIVDVPFGGAKGGVCIDARNYSTTELERITRRYTFELERKDFIGPGTDVPAPDYGTGPQEMAWIMDTYNQIGDEDLNALACVTGKPVGQGGVRGRTEATGRGVYYGIREACAYPKDMKRLGLEMGLEGKSVVIQGLGNVGYHAARFLEDGGAKIVGIAEIEGAIHDPDGLDVDDVVAHREETGSILGFADAENIETSAAALELPCDILIPAALEGVITTENAPDIQASIIAEAANGPVTSEADEILQEKNAMIIPDVYLNAGGVTVSYFEWLRNLSHVRHGRMSRRFEERNAERILRAVDELTAEDFSEDLLESLIEQVGFGAGERDLVHSGLEDTMSHAYDEIRAIREKKGVDMRTAAFVSAIDKIAGSYDQMGIFP

SEQ ID NO: 20964 - protein, 360 aa, Unknown
  Halobacterium sp. NRC-1
MRGAAPDAVLDAVQSGDPLPGTGGFAGELPDGRLARDVLGRRLCYVDGDEWSHDPRDLAAPTLLPAGHVRAPGATGSGRPVWSLPEPAPTGDEPVERVRDAVAGALGGVPAGDDLAVAFSGGVDSALAAAALDAPLYVVGYADSSDIAAARESAAAMGRADDLRVHEVTLADIEAAVPTVARAIGRTNAMAVQIALPLFLVAARAAADGYSRLVVGQGADELFGGYAKVAKAPTDPRTDADTVRGARRETVQSLPAQLERDLRALRAAGVEPVTPLLHDDVVRAALALPGEWLVSGDTRKRALREAARSWLPDAVADRDKKAVQYGSLVAREVDRLARQAGFKRRMDDHVTQYVEARIEE

SEQ ID NO: 20965 - protein, 452 aa, Mycobacterium smegmatis
MPTLLWFRRDLRCADHPAVLDAAQGDADVLACYVLDPRLTGSSGDRRLAYLYGALRDLREQLGGKLLVTRGRPEQRIPELAAAIGAASVHVSGDFSPFGLRRDEAVRAALADLPGDVGLYATGSPYLVTPGRITKDDGNPYRVFTPFFRAWRDHGWRAPADSGPGSARWIDPSEVPGGAEIPEPPTDLELPAGETAARAQWRAFVRESLRDYSSNRNRPDLDATSRMSAHLKFGTIHPRTMAADLERDGAGDGAAAYLRELAFRDFYAAVLHHWPDSAWWNWNRTFDAIETDEGPDAQRLFDAWKAGMTGFPIVDAGMRQLAATGFVHNRVRMIVASFLVKDLHLPWQWGARWFLDQLVDGDIANNQHGWQWTAGCGTDAAPYFRVFNPTKQGEKFDPDGVYIRRWVPELADPATVPDVHRIDGSRPADYPEPIVDHAQERAEALRRYGRLS

SEQ ID NO: 20966 - protein, 219 aa, Unknown
  uncultured bacterium
NSRLCMSSAVAGYTRSLGSDGPPCCYEDLDHCSLAFLIGTNTAECHPVLFQRLLKRKRKNPGSVTIVVVDPRRTDTAKAADIHLPIAPGSDLALLHGIAHLVLRENGQDPAFIDDHTENYDGFFDVAARWTPRRVALFCNIPEKRLREVAALFHRREKVLSLWSMGVNQRREGTAVVQGLINLHLLTGQIGKEGAGPFSLTGQPNAMGGREAGGLSHLL

SEQ ID NO: 20967 - protein, 2272 aa, Cryptococcus neoformans
MPMFRRSASSHSTSDAAAPPTLTNVTEGSPVASGTLTRQKRSRSHGGGGSPASTFSSRFGIPRYLPHQHQQSHEQEQGEAPRPDKPATKEIPVSSEPEVYGSEAGEESNFGQEPADEQLVPETGSWSPQSRHSSRKLSVQTVEPSSDDEVRSPEERRVSPLIKRLGEEPPFMLPHPSRADSTYQEYPGVVIGSFAGGGPDTLFGNGMQLEGTMDDILDPNAARQEDRGNQAPAGANIAPWLMDDSPPSPSENPSPASPATQERPVKGPAAALREKDLRKASTVLNHFSSVPSLPKIRRHGRAQTTTPDQTPRGSTHSQSNLASSSSSLNNESRESRAGSDDSIQTTLTQKGRRQSPGEWGQASAVPPPSKGTRPGRFGSTASIISGTGSVGEKKKGLFGGLLKRKTNPNLSLNPISHDFTTSEHRGSAGSIPLSASSSKLSSCSLSSLPTKSPSFTSPPEAFSRQFLPANYVHEGAVSPLQEISESPFHLDMNLDDMEGIIDPTKTGLPSTVAYRPSASSEVTTDSSASESMRLEEALNQTSSFGTSVSGASRGSDGTKMPSRIVLGEAERLPAPFTGMDPFQQHRESASTTGSDGKPFSPPSPHTLSPKHHIPPASANQPRRPSALRNVETGQVDETSQLSASEGSIQPISPSWARDSGMITVFNDPFSTSRQKQEQPPNSASLSHSTTAYPSAVTLPGPSTARFPTTTGSTTPSAAWAAPESWGVEADEAPAEETTSSDEDDWTGAGVDEVASASPTSDTLPSPSTSPRASSLSSPKRAPPFGFKSQQRAKPGTSGTTDSTTTATGRRKGKRVGSSGRPATGRPGTSGSAYSPSSLHWIRIYRADKSYMLYNLPLNTSTGELLALLAAQAEQGMVRGKNVAINMKLYICERGQDRMLLPSEKPLTIQHRRLLQLGHTEADHLDELGKNDMAVLCRFIYQAPILPIMDPEEESSYDSFEFIDIANRDLQTIPIFLHLHAHDIIILNISKNPMTDIPLDFIQACTSLKELRMSNMALKRVPISIRASTTLARLDVSCNRIADLESVALHEVETLVSLKVQNNKLTSMPSYFAQMKSLKYLNISNNKFETFPSVVCEMSNLVDLDVSFNNIAELPAKMSDLKSLEKLGLYSNDISNFPESFSTLANLRILDVRRNKITDLSAVYALPNLATLQADNNNIVTLDAQLGANVRQFSVPHNSVTRFTLAPPPNMAVVTYMLTNLDLSHGKISTLADEAFSGLTNLITLNLNFNQFTKLPATLDRLTSLEVFSCTDNMLNLVPAGFGKLRRLRVINLHNNNLKSLPEDLWACGALEIFNASSNLLDSFVPPPADIESVVGRVGSGTSQTSNGRKKHSVPPIGLSIRKLFLADNRLNDDIFHWISLMPSLRIINLSFNDIYEVPPFTLCKCERLEALYLSGNKLTSLPSEDLEKLQSLKVLHLNGNKLQTLPSELGAIKTLQHLDVGSNVLKYNIANWPYDWNWNWNTSLRYLNLSGNKRLEIKPTSAHEMNHASSFRKELSDFTALTQLRVLGLMDVTLRIPSLPDESDEKRVRTSFSDINNMAYGISDMLGSIDNLAMFDLVVPHFRGKENECLFGMFGRATTTLQGGKIAKHVQEIFAETLTAHLHKLEPGEEPSEALRRTFLWGDRKAFEFFSGKLQLEKERKPSWTSFASFDSMFRGWTPGVNSVLRTGASGAVVYLVDKVLHVGSIGDTLVVLSRKGDAELLSKRHDPTDREESARIRKAEAWVSTKGFVNDDKDLDISRAFGYWHECPAVNAAPEIRTRRLQESDEFVIIGNHALWQFCSYQTAVDIARTERDDPMIAAQKLRDFAISYGAEGNVMVMVVNVSDLFLGKGGRARGPSEQTAADASTDVEGYTVAKRQVRRRYDEVGDRTLNRLQQEIEPPVGQVAIVFTDIVNSTHLWETNPAMPTAIKMHHNLMRRQLRLDGGYEVKTEGDSFMVSFQSVTAALLWCFNCQIGLLQQEWPRELLEAHDGKVVHDSNGTIVQRGLRVRMGVHWGAPECEKDPITRRMDYYGPMVNRAARINASADGGQLMASQDVLNEIAPLMEYLNSSDEQVLNDLQGDLKREVMELRRIGLEVRDMGDRKLKGLEVPERLHLLYPKTLAGRLEISNEIRAEVEVNDARKSAERQRSVDIDQVCQLSDIALRLEAVCSYNPTPSSPGDTPTAGVMRLHPPASYLGPSIREDMNDEELWTIIESLVGRIENAMSTLYLKNFGEFSTVLAALESATKIDQKLIVHALALMNEAMENAEENAI

SEQ ID NO: 20968 - protein, 373 aa, Synechococcus elongatus
MARDFYEILGVSRSADAEELKRAYRRLARKYHPDVNKEPGAEEKFKEINRAYEVLSDPQARANYDRFGEAGVSGVGAAGFSDFGIGDMGGFADIFETFFGGFTTSSRRQQGPTRGEDLRYDLKLEFREAVFGGEKEIRINHLETCKTCQGTGAKPGTRPVTCSTCGGVGQVRRSARTPFGSFTQLTTCPTCGGSGVVIEDRCESCGGQGHIQVSKKLKITIPAGVDNGTRLRVSGEGDAGLRGGPPGDLYVYLFVQPDPEFQREGNNILSRIKISYLQAILGCRISVSTVDGEAELKIPAGTQPGTVLVLEGRGVPRVGNPVARGDHLITVDVEIPTHITHEERELLEKLAKIRGERLGKGGLEGFLGSLFGG

SEQ ID NO: 20969 - protein, 219 aa, Unknown
  uncultured bacterium
NSRLCMSSAVAGYTRSLGSDGPPCSYEDLDHCTVAFLIGTNTAECHPVLFQRLLKRKRKNPSSVMIVVVDPRRTDTAKAADIHLPIAPGSDLALLHGIAHLVLRENGQDPAFIDDHTENYDAFFDVAARWTPRRVALFCNIPEKRLREVAALFHRRQKVLSLWSMGVNQRREGTAVVQGLINLHLLTGQIGKQGAGPFSLTGQPNAMGGREAGGLAHLL

SEQ ID NO: 20970 - protein, 219 aa, Unknown
  uncultured bacterium
NSRLCMSSAVAGYTRSLGSDGPPCSYEDLDHCTVASLIGTNTAECHPVLFQRLLKRKRKNPGSVKIVVVDPRRTDTAKAADIHLPIAPGSDLALLHGIAHLVLRENGQDPAFIDDHTENYDAFFDVAARWTPRRVALFCNIPEKRLREVAALFHRREKVLSLWSMGVNQRREGTAVVQGLINLHLLTGQIGKQGAGPFSLTGQPNAMGGREAGGLAHLL

SEQ ID NO: 20971 - protein, 440 aa, Schizosaccharomyces pombe
MPPKEDWEKYQKPVDTEEENDKNPPPLDEGDIELLKSYATGPYARELAAIKEDTEAVLKRINDTVALGIKESDTGLAPISFWDVAADRQRMSEEQPLQVARCTKIIENEQSAEKNAYVINLKQIAKFVVSLGERVSPTDIEEGMRVGCDRNKYAIQLPLPPKIDPSVTMMQVEEKPDVTYGDVGGCKEQIERLREVVELPLLSPERFVKLGIDPPKGIMLYGPPGTGKTLCARAVANRTDATFIRVIGSELVQKYVGEGARMVRELFEMARTKKACIIFFDEIDAIGGARFDDGAGGDNEVQRTMLELITQLDGFDPRGNIKVLFATNRPNTLDEALMRPGRIDRKVEFGLPDLEGRAHILRIHAKSMAIDKDIRWELIARLCPSQTGAELRSVCTEAGMFAIRARRRVATEKDFLDAVQKVVKGNQKFSSTADYMNMSS

SEQ ID NO: 20972 - protein, 219 aa, Unknown
  uncultured bacterium
NSRLCMSSAVAGYTRSLGSDGPPSCYEDLDHCSVAFLIGTNTAECHPVLFQRLLKRKKRNPGSITIVVVDPRRTDTAKAADIHLPIAPGSDLALLHGIAHLVLRENGQDSAFIDDHTENYDAFFDIAARWTPRRVARFCNIPEKRLRDVAQLFHRRERVLSLWSMGVNQRREGTAVVQGIINLHLLTGQIGKEGTGPFSLTGQPNAMGGREAGGLSHLL

SEQ ID NO: 20973 - protein, 219 aa, Unknown
  uncultured bacterium
NSRLCMSSAVAGYTRSLGSDGPPCSYEDLEHCTVAFLIGTNTAECHPVLFQRLLKRKRKNPGSVKIVVVDPRRTDTAKAADIHLPIAPGSGLALLHGIAHLVLRENGQDPAFIDDHTDNYDAFFDVAARWTPRRVALFCNIPEKRLREAAALFHRRQKVLSLWSMGVNQRREGTAVVQGLINLHLLTGQIGKQGAGPFSLTGQPNAMGGREAGGLAHLL

SEQ ID NO: 20974 - protein, 384 aa, Thermoanaerobacter tengcongensis
MPKKDLYEILGVDRNASQEEIKKAYRRLAKKYHPDLNPGDKEAEQKFKEINEAYEILSDPQKRAQYDQFGHAAFEQGGSQQGGFGDFGEGGFDFDFGGFGDIFGDIFSDFFGTGRRKAEKGPKKGADIRYDLTLTFEEAAFGTEKEIEVERFEVCDVCHGTGVKPGSRPETCPVCHGTGEIRQTQNTPFGRIVNIRTCPRCHGEGKIITDPCQKCGGTGKIRKRRKIKVTIPAGIDEGQMLTLRGEGEPGLRGGPNGDLYIVIHVKPHEIFKREGYDVYVKIPISFADAALGGEIKIPTLDGMVSFTIPEGTQTGTKFKLRGKGIPHIGGRGRGDQIVEVYVEVPKRLSEKQKELLREFKRLEGENTAEHKSFFQRMRDAFGGS

SEQ ID NO: 20975 - protein, 257 aa, Elymus lanceolatus
CELDNIMRLTGITGIVNGMDVSEWDPTKDKFLAVNYDITTALEAKALNKEALQAEVGLPVDRKVPLVAFIGRLEEQKGPDVMIAAIPEIVKEEDVQIVLLGTGKKKFERLLKSVEEKFPGKVRAVVRFNAPLAHQMMAGADLLAVTSRFEPCGLIQPQGMRYGTPCACASTGGLVDTIVEGKTGFHMGRLSVDCNVVEPADVKKVATTLKRAVKVVGTPAYQEMVKNCMIQDLSWKGPAKNWEDVLLELGVEGSEPG

SEQ ID NO: 20976 - protein, 327 aa, Rhizobium leguminosarum
MSENIAVVGSGAFGTALAAVIALAGRSAVTLVGRDPSLIADLKAERLHDAVLPGILLPDTLEFSAEADAITGASIVLFAMPSQAQADAARQYGPYLCKDAVVVTCAKGIERATGNLLTDMLERELPDHSIAVLSGPGFAADIAKGLPTAMAIAAADMETAERLAQAISGRTFRLYASNDRIGVQLGGALKNVLAIACGIVEGRGIGDSARAALIARGLAEMSRFVVAKGGQADTVRGLSGLGDLVLTATSHQSRNLRFGIALGRGEKTDPLQGALVEGAFAASVASRLAAELKVSMPITDAVSAIIDGKLDISEAIEQLMTRPITTE

SEQ ID NO: 20977 - protein, 460 aa, Helicobacter hepaticus
MLVANSSYADMYFTFFHSEFGAFFSDSHFKVSLQDFINDVLMSFFFLLVGLEMKREMLYGELAGFKKVSFSFLAAFGGIICPVMIYSYFNSGTAYESGFGVAMSTDTAFALGLIMLLGDRVPKILKIFLVTLAVADDLGAISVIAIFYSDNINMQWIYASLILVAVLIYLNYRDTKYLSLYFLAGILLWFCVHHSGIHVTIAAVILAMAIPGRTRVNKKYFINMLKEFERMKVATNDWNDVVYARESEKVGFWRGSFKNIRSFIFGNQDVEKKIDMAKTSQLVHMLDTIGTYSRYAQNPLIRLEIALQPICAYFFVPLFAFANAGVTLEGNIDISLNSVMLGTILGLVVGKPVGVLLFCFLGEKLNLATRPKDLNYLHILSVGMISGIGFTMSMFVANLAYKDDIMSIDMSKISILVASSIAAVLGLLVVYLSTIKQDNQLENINEEDEIQKLKETQSII

SEQ ID NO: 20978 - protein, 257 aa, Elymus lanceolatus
  misc_feature (178)..(178): Xaa can be any naturally occurring amino acid
CELDNIMRLTGITGIVNGMDVSEWDPTKDKFLAANYDITTALEAKALNKEALQAEVGLPVDRKVPLVAFIGRLEEQKGPDVMIAAIPEIVKEEDVQIILLGTGKKKFERLLKSIEEKFPGKVRAVVRFNAPLAHQMMAGADLLAVTSRFEPCGLIQLQGMRYGTPCACASTGGLVDTXVEGKTGFHMGRLSVDCNVVEPADVKKVATTLKRAVKVVGTPAYQEMVKNCMIQDLSWKGPAKNWEDVLLELGVEGSEPG

SEQ ID NO: 20979 - protein, 124 aa, Triticum aestivum
  misc_feature (102)..(102): Xaa can be any naturally occurring amino acid
  misc_feature (110)..(110): Xaa can be any naturally occurring amino acid
MSEPEFEQARKEGGSTLEASSLFSKNPEYKKALEVVSVPERIIQFRVVWENDKGECQVQKGYRVQFNSALGPYKGGLRFHPTVNLSILKFLDFEQIFKNAVXTALNMGRXGKGGMRTSDPKGKS

SEQ ID NO: 20980 - protein, 444 aa, Helicobacter hepaticus
MAAKQNRISEALSSFIRAESFSGIFLFFCAVSAMIVANSPFSDIYKNFWEQPFGFSFAGGFYGFSIHDWINDVLMSIFFLMVGLEIKRELLFGDLSGFQKAAFPVIGAVGGMIVPGVIYYVLNMNTPSYHGFGIPMATDIAFALGVILLLGKRVPLALKVFLVTLAVADDLGAIVVIAVFYPSPEGLHFIYLGVAAGLLILLTGINHLGVRHLGVYIGIGILLWFCVHHSGIHATIAAVALAFCIPVKPKIESKEFIQVVQQMIEIFESKDKERKNILLDTQQMSAIDEAGRDFAKVQNPLLRLEHALQPLCAFIIMPLFAFANAGVDIRAEVNFHIDHIMLGVILGLVVGKPLGILSLTFLCEKCKIASRPAGVSWSHIFGAGMLAGIGFTMSMFVSNLAFDAPQASDVSKIAILLASSIAGIVGSLYLIINYKINSRAKVKS

SEQ ID NO: 20981 - protein, 257 aa, Elymus riparius
CELDNIMRLTGITGIVNGMDVSEWDPTKDKFLAVNYDITTALEAKALNKEALQAEVGLPVDRKVPLVAFIGRLEEQKGPDVMIAAIPEIVKEEDVQIVLLGTGKKKFERLLKSVEEKFPGKVRAVVRFNAPLAHQMMAGADLLAVTSRFEPCGLIQLQGMRYGTPCACASTGGLVDTIVEGKTGFHMGRLSVDCNVVEPADVKKVATTLKRAVKVVGTPAYQEMVKNCMIQDLSWKGPAKNWEDVLLELGVEGSEPG

SEQ ID NO: 20982 - protein, 476 aa, Bacillus cereus
MQNKIIVMFQKDFRLYDNPALFKATQSGEVVPVYVHDETFSMGSASKWWLHHAIIDVKKQLEALGSTLIIRKGSTEEEILSLIEQLGITAVYWNICYDPDRLQFNQNMKMMLEDKGITCKEFNSHLLLEPWMIKKKDNTEYKVFTPFYNAFQKQVISKPISKVQSIKWGSSLPESLSVTELHLLPTIPWTSHIESIWDPTEEGAYKTCKKFFSSKLASYSEGRDFPNQNAHSMLAPYLSFGQISVRWMYHYLINKSTERQCSLFEKQVNSFIRQLIWREFSYYLLYHYPFTVYKPLNKNFEHFPWNNEEELLTVWQKGETGYPFIDAGMRELWQTGFMHNRARMAVASFLVKHLLIPWQEGAKWFMDTLLDADIANNTMGWQWVAGSGADASPYFRIFNPITQGEKFDKDGEYIRKWVPELKDMPNKYIHKPWEAPEHILQKANIKLGDTYPLPVVDHKAARERALCAYKSMKEFV

SEQ ID NO: 20983 - protein, 257 aa, Elymus trachycaulus
CELDNIMRLTGITGIVNGMNVSEWDPTKDKFLAVNYDITTALEAKALNKEALQAEVGLPVDRKVPLVAFIGRLEEQKGPDVMIAAIPEIVKEEDVQIVLLGTGKKKFERLLKSVEEKFPGKVRAVVRFNAPLAHQMMAGADLLAVTSRFEPCGLIQLQGMRYGTPCACASTGGLVDTIVEGKTGFHMGRLSVDCNVVEPADVKKVATTLKRAVKVVGTPAYQEMVKNCMIQDLSWKGPAKNWEDVLLELGVEGSEPG

SEQ ID NO: 20984 - protein, 429 aa, Unknown
  Halobacterium sp. NRC-1
MAQTPPPESAPSTDSEPETALETARRQLQAAAEHVDIADGVIERLTHPTRVVQVSVPVERDDGTVTVYDGYRAQHDDVRGPYKGGLRYHPGVSAEECVGLSMWMTWKCAVMDLPFGGAKGGVVVDPKTLSADEHERLTRRFAAELRDEVGPSQDIPAPDMGTDAQTMAWFMDAYSMQQGETVPGVVTGKPPVAGGSHGRAEAPGRSVAIATREAINYYDIPIDDATVAVQGYGSVGANAALLLDDWGARVVAVSDVNGGVLDTDGLDTHAIPSHGNQPAAVMRHDAPNTLTNEELLELDVDVVIPAAVGNVITAANADRIQADIVVEGANGPTTSAADRILEERAVPVIPDILANAGGVTVSYFEWLQDINRRTWSPERVRDELESEMLSAWNAVRSEVDDGDLSWRDAAYVVALQRIGRAKEARGLWP

SEQ ID NO: 20985 - protein, 727 aa, Brassica napus
MEDEIDRSRAFAKDVKRIVVKVGTAVVTGKGGRLALGRLGAICEQLAELNSDGFEVILVSSGAVGLGRQRLRYRQLVNSSFADLQKPQTELDGKACAGVGQSSLMAYYETMFDQMDVTVAQMLVTDSSFRDKDFRKQLSETVKAMLKMRVIPVFNENDAISTRKAPYKDSTGIFWDNDSLAALLALELKADLLILLSDVEGLYTGPPSDPKSKLIHTYVKEKHQEEITFGEKSRLGRGGMTAKVKAAVNAAYGGIPVIITSGYAAENIAKVLKGLRVGTLFHQDAHLWARVVDTTSRDMAVAARESSRKLQALSSEDRKNILLDIANALEANEKIIKAENDLDVAAAQEAGYEESLVARLVMKPGKISSLAASIRQLAEMEDPIGRVLKKTEVADGLILEKTSSPLGVLLIVFESRPDALVQIASLAIRSGNGLLLKGGKEARRSNAILHKVITDAIPKTVGGKLIGLVTSRDEIPDLLKLDDVIDLVIPRGSNKLVSQIKNSTKIPVLGHADGICHVYVDKSCKVDMAKRVVSDAKLDYPAACNAMETLLVHKDLEQNGVLNELIYALQANGVTLYGGPKASGKLNIPEVKSFHHEYSSKACTVEIVEDVHGAIDHIHQHGSAHTDCIVTEDSEVAEIFLRQVDSAAVIHNASTRFCDGFRFGLGAEVGISTSRIHARGPVGVEGLLTTRWIMRGKGQVVDGDNGVAYTHKDLPVLERTKAVQNGH

SEQ ID NO: 20986 - protein, 480 aa, Zea mays
NNITGDVSSLMNCFSLNILNVSYNNLAGAVPTDNNFTRFSHDSFLGNPGLCGYWLGSSCRSTGHRDKPPISKAAIIGVAVGGLVILLMILVAVCRPHHPPAFKDATVSKPVSNGPPKLVILHMNMALHVFDDIMRMTENLSEKYIIGYGASSTVYKCVLKNCKPVAIKKLYAHYPQSLKEFETELETVGSIKHRNLVSLQGYSLSPVGNLLFYDYMESGSLWDVLHEGSSKKNKLDWVTRLRIALGAAQGLAYLHHDCSPRIIHRDVKSKNILLDKDYEAHLTDFGIAKSLCVSKTHTSTYVMGTIGYIDPEYARTSRLNEKSDVYSYGIVLLELLTGKKPVDNECNLHHLILSKTASNEVMETVDPDVGDTCKDLGEVKKLFQLALLCTKRQPSDRPTMHEVVRVLDCLVNPEPPPQPQQQQQKAHAHHQLPPQPSPPAYVDEYVSLRGTGALSCANSSSTSDAELFLKFGEAISQNMV

SEQ ID NO: 20987 - protein, 322 aa, Thermus thermophilus
MRVAVLGAGAWGTALAVLLASKGVPTRLWARRKAQAEALKAMRENRDYLPGVALPAYLYPTHDPEEALEGAELAVLAVPSKALRETVAGLPPAPWYVSATKGLFYGEEGVRTPAEVVEALTQRPVVALSGPNHAEEVARFLPTASVAAGPEDLARRVQALFSGPTFRVYTSRDRRGVELGGAVKNVLALAAGMVDGLRLGDNAKAALLTRGLKEMVRFGTALGGEEATFYGLAGLGDLLATAYSLHSRNRMAGESLVRGVDREALEARGVVEGLYAVKAMVAWGKEQGVELPVAEAVHRVAHEGLDPLAALKALMAREPKEE

SEQ ID NO: 20988 - protein, 95 aa, Oxalis tuberosa
LYAGINISGTNGEVMPGQWEYQVGPSVGIEAGDHIWASRYILERITEQAGVVLTLDPKPTDGDWNGAGCHTNYSTKSMRDEGGFEVIKKAIFNLS

SEQ ID NO: 20989 - protein, 208 aa, Symbiobacterium thermophilum
MTDCSRNETGALAERVGQVARKTRETDIAVTWRLDGAGRADVDTGVPFFDHMLDQIARHSLTDLTARAVGDLEIDAHHTVEDTGIALGQALRRALGDGRSIRRYGSAFVPFDETLAFAAVDVSGRPYLVFDAALPAQKVGNFDTELAEEFFRALAMNAGITLHLKVHYGRNTHHMIEGLFKAFARALGDAVARDPRVLGVPSTKGALF

SEQ ID NO: 20990 - protein, 727 aa, Unknown
  Bradyrhizobium sp. BTAi1
MVVAQGPGGGEVGPDGRPKQQPQGQPQRPGPGAPPPHQAAPPPPPAPPPAAAPRPAPPPPAPPPAAAPRPAPAPPPPPPPPRAEPPRPAPPPPPPPPRAEPPRPAAPPPPPPPPRAEPPHAAPPPSRAEPPAPPPSRPAPPVAAPPVHTPPPPAPPPASPHEPARPATPPAPPPAAAPVRPTPPTPPAATPAPPPPSSSAPNQRPGTPPSPVTPPPSPPAAGNAPPPAHTPPRSAAPSPQPTPAPTPPGGPGQRPPIQPGAGAPPPGAPQGAPPPRGAPTPPAGTVAPGPGTPPSPATPPAAQTPPPNAQPGTPSPGPRPGTPPTPPPAAGPGPAAGPGAAGPGPGTAAPGPGGPAATPAPGPGSGPGAGAQGAVPPAGPPAMTNRPPPQVAAPIPAPPPPSPQQLTPIAPGAPLVGPQRLEDFRGQRREVQEGGRTLIYEPGRVIVRDPGGQEFVRHDELERFRYGARDIRVMREDRGETRTVVIRPDGSQIVTITAPDGRLLRRIRRDIGGREIIIIDNTYRDPQAVGGFYVDLPPPEIRIPYNRYIVDAEEAPPDVIYDTLVAPPVERVQRRYSLDEVRYSPSVRQLMPSIDLNTITFETGSWEIGPDQVAKLQVIADGLNQAIQRNPREVFLIEGHTDAVGNETDNLSLSDRRAESVATLLTQQFGVPAENLTSQGYGEQYLKEQTQGPSRINRRVTVRRITPLLNGGQAALPPPPPGIAPPR

SEQ ID NO: 20991 - protein, 95 aa, Oxalis tuberosa
LYAGIDISGTNGEVMPGQWEYQVGPSVGIEAGDHIWASRYILERITEQAGVVLTLDPKPIDGDWNGAGCHTNYSTKSMRDEGGFEVIKKAIFNLS

SEQ ID NO: 20992 - protein, 95 aa, Oxalis tuberosa
LYAGINISGTNGEVMPGQWEYQVGPSVGIEAGDYIWASRYILERITEQAGVVLTLDPKPIDGDWNGAGCHTNYSTKSMRDEGGFEVIKKAIFNLS

SEQ ID NO: 20993 - protein, 1247 aa, Unknown
  Oceanospirillum sp. MED92
MKHRLVIIGNGMATGRLLQLIADSAADRFDISVFGEEPGGSYNRVLLSPLLGEEISLEQVMTLDLDWYKNNNVTLYSGDPVVHIDASLKQVISHKNLRVSYDSLIIATGSNPSAVPVEGSSLPGVMNFRTLQDVETMQQVAATKKNAVVIGGGFLGLEAAEGLRLQGMNVTLLHRSDYLLNKQLDKPAAQMLLNNLQKRGIDFRLNANTQAFLGDTQVEAVELDSGEVIPADLVITAIGVSPNSQLAEASGLTVKRGILVDKQMRTSDLNIYAFGECCQFEEYTYGLVAPIWQQAEVVLSSLIGETSNYREEPVATQLKISGVELFSCGELIDADDRDTLIYQDFKKNEYRKLWLKENRLVGAVLYGDVREGQWYFEQLKENNDLSACRQQLLFGSPLCAQDTQTENMGITSMTTESNKRQLVVIGNGMVGHHFVENFVNSNVAGDYEIHILAEESRAAYDRVHLSEYFSGSSYEDLCLVEENLYEKHGVHLHLSEGATQIDRDAKQVITEQAVYSYDTLVMATGSYPFVPPIPGNDGEACFVYRTLEDLDKIQACAEDAKVGVVVGGGLLGLEAANALKSLGLKSHVVEFAPRLMPVQLDEDGGELLKKKIEALDVDVHCEKATTEIVAGEEHTYRMNFSDGSFLETDLILFSAGIRPQDTLARSSELEIGERGGILVNDQCLTSDENIYAIGECALWNNQIFGLVAPGYTMAKTAVAAIAGDEAAFTGADMSTKLKLLGVDVGSIGDAHGKTPGSISYRYLDEDEQTYYRIIVSEDKKKLLGAVLVGDNSKYDTLLQYALNGIDLPEKPQGLILPSMDGSAAPALGPDALPDEATICSCLNVTKGQICCSIDEGATSVADVKDATKAASGCGGCAAMLKSVVDNELSKRGVEVNTDLCEHFAYTREELYHIIRVEGIRSFSELLEKHGKGLGCEICKPAAGSILASCWNEHIQEKPLVSLQDTNDTFMANMQKNGTYSIVPRVPGGEITPDKLIVIGQVAKKYNLYTKITGGQRVDLFGAQLHELPLIWEELVNAGFETGHAYGKSLRTVKSCVGSTWCRFGVNDSVGMAINLENRYKGLRAPHKIKFAVSGCTRECAEAQCKDIGVIATENGWNLYVCGNGGMKPRHADLFATDLDDETLVKYIDRVLMFYIKTADRLQRTSVWMENLEGGLDYLKEVVIDDKLEIGEELEAQMAHIVSTYECEWKATLEDEEKLKRFRTFVNTEDQVDPQIVHILERDQVRPV

SEQ ID NO: 20994 - protein, 553 aa, Wolinella succinogenes
MVENQKFNNEHLGEDEDFASMLEESWEKSENETITKGTIVAINDDTVLVDVGEKIEGRINIAEILDEEGKPKYKAGDELPIIITGNRNERPMISHQKAIRREKLKEKIAAFGEDYRDVVVEGVITKKNRGGYVIESEGLEYFMPKFMSALKEDAKNLGKTIKACIINIKPEDDTIVVSRKRFFELDNKVKKEGAAKLLEATEPLPGVVKKITSFGMFVEVDGVEGLVHYTEISYKGPVNPSKIYQEGDQVSVKAIAYDEEKKRLSLSIKATVDDPWREIENELEVGDAINVTVSNVEPYGAFVDLGNDIEGFLHISEISWDKNIKHPGEYLKSGQEIDVEVIEIDTKKRRLRVSLKKLLEKPFEQFMKTHKEGDVIKGAVATLTDFGAFIRIGAIDGLLHNEDAFWEKNGKCKEVMKEGDEVEVKIVKIDKDKERVSLSRKSLIASPAEDFAKNHQIDDSVIGKIRDIKDFGVFINLEDGIDALIRIEDLAPLKKEELNIGDEIEGVISLIDKENNKIRVSVRRLERKKEKESMKAFNSDDKMTLGDILKDQI

SEQ ID NO: 20995 - protein, 172 aa, Lactobacillus sakei
MATETAIFAGGCFWCMVHPFDQQPGILKVVSGYTGGHVANPTYEQVCSHTTGHTEAVEITFDPAVISYAELVEIYWRQTDPTDAMGQFQDRGDSYRPVIFVNSDQQRSIAEASKEKLIASGRFNEPIVTQIEAAKPFYPAEDYHQDFYKKEPWRAELGEVKRKAFIREKWSD

SEQ ID NO: 20996 - protein, 110 aa, Thermus thermophilus
MAKPIEVTDQNFDETLGQHPLVLVDFWAEWCAPCRMIAPILEEIAKEYEGKLLVAKLDVDENPKTAMRYRVMSIPTVILFKDGQPVEVLVGAQPKRNYQAKIEKHLPATA

SEQ ID NO: 20997 - protein, 717 aa, Zea mays
MATADQSRIFMKDVKRVIIKVGTAVVTRGDDGRVSTGNFGVLCEQVKEINALGYEVIIVSSGAVGVGKQRLNYRKLVNSSFADMQKPQTELDGKACAAVGQSGLMALYDMLFTQLDVSSSQLLVTDSDFENPNFRERLRETVESLLDLKVVPIFNENDAISTRKAPYEDSSGIFWDNDSLAGLLAIELKADLLVLLSDVDGLYSGPPSEPGSKIIHTYIKDKHYSGITFGDKSRVGRGGMTAKVKAAFVASNSGTPVVITSGFASQSIVRVLQGEKIGTLFHKDASLWEPSKDVSAREMAVAARECSRRLQNLSSDERKKILLDIADALEQNEDLIRTENEADVSAAQDAGYQKSLVDRLTLKPEKIASLAKSIRTLANMEDPINQILKRTEVAEDLVLEKTSCPLGVLLIVFESRPDALVQIASLAVRSGNGLLLKGGKEAMRSNTVLHKVITGAIPDNVGQKLIGLVTSRDEIADLLKLDDVIDLVIPRGSNKLVSQIKASTKIPVLGHADGICHVYIDKSADMNMAKRIVMDAKTDYPAACNAMETLLVHKDLIKAPGLDDILLSLKTEGVAIYGGPVAHEVLCIPKADSFHHEYSSMACTIEFVDDVQSAINHIHRYGSAHTDCIITTDDKVAETFLRQVDSAAVFHNASTRFSDGARFGLGAEVGISTGRIHARGPVGVEGLLTTRWIMRGSGQVVNGDKNVAYTHKNLPLQ

SEQ ID NO: 20998 - protein, 718 aa, Mycobacterium smegmatis
MSDPTASPPAPMNMVWPGEAYPLGATYDGAGTNFSLFSEVAERVELCLIAKDGTETRINLDEIDGYVWHAYLPTISPGQRYGFRVYGPWDPSKGLRCDPSKLLLDPYGKSFHGDFDFSQALYSYDLEADPPGSGTPPRVDSLGHTMTSVVINPFFQWGSDRAPKTPYHDTVIYEAHVKGMTQTHPGVPEALRGTYAGLSHPVIIEHLQSLNVTAIELMPVHQFMHDHRLLDLGLRNYWGYNTVGFFAPHFQYAATRNAGGAVAEFKTMVKAFHDAGIEVILDVVYNHTAEGNHLGPTINFRGIDNAAYYRLLDGQPEFYKDFTGTGNSLNARHPHTLQLIMDSLRYWVLDMHVDGFRFDLASTLAREFYDVDRLSAFFDLVQQDPVVSQVKLIAEPWDVGEGGYQVGNFPGLWTEWNGKYRDTVRDYWRGEPATLGEFASRLTGSSDLYEATGRRPSASINFVTCHDGFTLNDLVSYNEKHNEANGEDNRDGESHNRSWNCGVEGPTDDPEILALRAKQMRNIMATLMLSQGTPMIAHGDEIGRTQLGNNNVYCQDSELSWMDWSLCETNADHLEFTRKVVAFRKQHPVFRRRRFFEGKPIRSGDQVRDIAWLTRAGTEMTPEDWGAGLGTCVAVFLNGEAIPTPDARGERVVDDSFLLCFNSNDHPEDFVTPNGDYAAEWTADLDTADPVGNSDLVVKAGEKISIQPRSVLVLRKTA

SEQ ID NO: 20999 - protein, 142 aa, Thermus thermophilus
MWYSGGTAGGFRARRRNVELEAGTVVEGRVVRVVSFGAFVELAGGEQGLVHISQIAHEYVTNVRDYLNEGDIVQVLIKGRDAKGRLDLSIKDLTPAPEGGAPPPRPRRLPKQSPEFENKLKSFLRGTGGFGGKGKKGGRKKR

SEQ ID NO: 21000 - protein, 441 aa, Chlamydophila pneumoniae
MIENDFPEASNFESSHFYRDKVGVIILCGGEGKRLSPLTNCRCKPTVSFGGRYKLIDIPISHAISAGFSKIFVIGQYLTYTLQQHLFKTYFYHGVLQDQIHLLAPEARQGDQIWYQGTADAIRKNLLYFEDTEIEYFLILSGDQLYNMDFRSIVDTAIRTHVDMVLVAQPIPEKDAYRMGVLDIDSEGKLIDFYEKPQEKEVLKRFQLSSEDRRIHKLTEDSGDFLGSMGIYLFRRDSLFSLLREEEGNDFGKHLIQAQMKRGQVQTLLYNGYWADIGTIESYYEANIALTQKPHAEKRGLNCYDDNGMIYSKNHHLPGAIITDSMISSSLLCEGCVINTSHVSRSVLGIRSKIGENSVVDQSIIMGNARYGSPSMPSLGIGKDCEIRKAIIDENCCIGNGVKLQNLKGYIKYDSPDKKLFVRDNIIIVPQGTHIPDNYIF

SEQ ID NO: 21001 - protein, 566 aa, Pseudomonas putida
MAMFRLAIVSGSQRKLSRMQSAYTVLILLTLVSLSKLVGRVIPLPLPLVQIAAGALLAWPTLGLHVALDPELFLFLFLPPLLFADGWRIPKRELWRIRGPVVALAVGLVLFTVVGAGYFIHWLLPSIPLPVAFALAAVLSPTDAVAVSAIAQDRLPTPLMHMLQGEALMNDASGLVTFKFALAAAITGVFSLADASFSFVLVALGGLAVGVVLSWLIGRLRMWMITRGWDDPATHVVFMLLLPFAAYVLAERLGVSGILSAVAAGMMQSWLDLLPRQTSTRLLNRSVWSLLEFAFNGLIFLLLGLQLPDIIKAVVSHEATLWPTLAYRCLDVVAIFAALIMLRFIWVQSIWRSIGVVRRWRGKPALVLMPTARSCWLLTLGGVRGAVTLAGVMSIPLLIGAGTAFPERDLLIFIAAGVILLSLISACIALPILLRGVTKSPDERLHQEVQEAWRRTAEAAIHALEAEEVIDSNAPQDAAQATLATELKARLMAEYRDELESYDDSAEAKALAAQMDLLERRLRLRALRAQRLELYNLHRQHLVGDEVVRQVLGELDMSEANLGSVK

SEQ ID NO: 21002 - protein, 157 aa, Nostoc punctiforme
MTKKLHEPLLVVEDSNEDFRMLQRLMRLMSVQNPIHRCTNGDEVLEFLYQQGSDAHSKGENLPNSKVALRPSVILLDLNLPGIDGRDILDRLKQDKSFKEIPIVVFTTSSNPKDIELCYQKGANGYLVKPMDAQELKKTIQAFVDYWLDANMPPVLD

SEQ ID NO: 21003 - protein, 219 aa, Unknown
  uncultured bacterium
NSRLCMSSAVAGYSRSLGSDGPPCSYDDLDHCSVAFLIGTNTAECHPVLFQRLLKRRKRNAGSVKIVVVDPRCTDTAKAADIHLAIAPGSDLALLHGLAHLVLLNGGQDQAFIWDHTDNFDDFSNVVSRWTPTLTAQFCGIPERDLREVADLFHRQERVLSLWSMGVNQRREGTAVVGGLINLHLLTGQIGRQGSGPFSLTGQPNAMGGREAGGLSHLL

SEQ ID NO: 21004 - protein, 219 aa, Unknown
  uncultured bacterium
NSRLCMSSAVAGYTRSLGSDGPPCSYEDLDHCSVAFLIGTNTAECHPVLFQRLLKRKRKNPGSVKIIVVDPRRTDTAKAADIHLPIAPGSDLALLHGIAHLVLRENGQDPAFVDDRTENYDAFFDVAARWTPRRVARFRNIPEKRLREVATLFHRREKVLSLWSMGVNQRREGTAVVQGLINLHLLTGQIGNEGAGPFSLTGQPNAMGGREAGGLAHLL

SEQ ID NO: 21005 - protein, 436 aa, Prochlorococcus marinus
MANIFEVPNPGNDLLEKADKVRLASIKISQTENIDRIKALNFMADCLEKNSKEILEANSADYSSAEKKGISRALLSRLKLSKAKLNSGIEGVRKVGELADPVNQIQIKRELSNGLILERKTVPIGVLGVIFESRPDAVMQISSLAIRSGNGVILKGGSEANLTNTSIVKALQEGLDESGLDKNAICLLTSRKDSMAMLNLEKYINLIIPRGSNELVKFIQENTRIPVLGHADGICHLFIDIEANLEMALSVALDSKIQYPAACNAIETLLVHKDIAPAFLEKAIPLFNSNDVKLIGDRKSVELGLEHEASAEDWQTEYLDLILSIKIVDDLDEAIIHIQKYSSKHTDGIITENLKTANRFMNVVDSAGVFHNCSTRFADGFRYGFGAEVGISTQTLPPRGPVGLEGLVTYKYFLKGDGNIVDDFSLGKAIYTHKDL

SEQ ID NO: 21006 - protein, 270 aa, Sulfolobus solfataricus
MGIKVELAQIRSYPGDVYRNYKKHLEIIESSSADCVIFPELSLTGYIIKDLTYEIYKDAEEATQKIAEKVNKCVVFGTIRQVRKGILRNSAAVIINGKLDYIYKFYLPTYGLFEERRYFQRGDPLKDLKIFEYKDLKFGVVICEDAWHPEPIEALSLMGADAIFIPSASPMRKLRENLAIEESWDSLLKAHSLMNTVWTVFTNVVGSQEEEYFWGGSRVVSPLGDVKLKLKLFYEDRGTIEITENELLRARFFSSYRDHIREFHSILDKL

SEQ ID NO: 21007 - protein, 303 aa, Solibacter usitatus
MPAISMKELLEAGVHFGHQTKRWNPKMKEYIFGERNGIYIIDLQKTLKMFKDAARFVGEMAAQGKNVLFVGTKRQAQEAIAEEANRCQMYYVNQRWLGGLLTNMLTVQKSIKRLKELEAMASVEGGYAGRPKKEVIRLERERKHLDQNLSGIKDMPGLPDVLFVIDSNKEGIAVKEARRLGIPVVAIVDTNCDPDEVDWVIPGNDDALRAIRLFASKIADAVVEGRALATEQDFTADKIISDETPAEEGMMEYTEYVDPKYAEKIMAESLSMAEEPAPPSQRKGPASETAEPVAEPAVTESGS

SEQ ID NO: 21008 - protein, 409 aa, Methanothermobacter thermautotrophicus
MCGDIMKARAEKIADGLYWTGVLDWDIRNYHGYTLQGTTYNAYLVFGDEGVALIDNSYPGTFQELMARMEDAFNREGREMRVDFIVQNHVERDHSGVLVELHRRFPEAEIHCTEVAVEGLLKHYPALEGTEFRTVKTGDSIDLGGRTLTFLEAPLLHWPDSMFTFLDTGILFSNDAFGQHLCYPQRLDTEIPEYILMDAAKKFYANLITPLSKLVLRKFDEVKELGLLDKIGMIAPSHGQIWTEPMKIIEAYTAWATGKVKKKVTVIYDTMHHSTAMMAHAIAEGAMSEGADVRVYYLHEDDRSEIVKDILDSHAIALGAPAIYDEPYPSVGDLLMYLRGLKFNRTGQRRAMVFGSMGGRGGATGTMQKLLADAGFDVMEADEIYYVPNNEELDACFEAGRRLAGDLNE

SEQ ID NO: 21009 - protein, 305 aa, Coprinopsis cinerea
MQIFVKTLTGKTITLEVESSDTIDNVKAKIQDKEGIPPDQQRLIFAGKQLEDGRTLSDYNIQKESTLHLVLRLRGGMQIFVKTLTGKTITLEVESSDTIDNVKTKIQDKEGIPPDQQRLIFAGKQLEDGRTLSDYNIQKESTLHLVLRLRGGMQIFVKTLTGKTITLEVESSDTIDNVKAKIQDKEGIPPDQQRLIFAGKQLEDGRTLSDYNIQKESTLHLVLRLRGGMQIFVKTLTGKTITLEVESSDTIDNVKAKIQDKEGIPPDQQRLIFAGKQLEDGRTLSDYNIQKESTLHLVLRLRGGF

SEQ ID NO: 21010 - protein, 219 aa, Unknown
  uncultured bacterium
NSRLCMSSAVAGYTRSLGSDGPPCSYEDLDHCTVAFLIGTNTAECHPVLFQRLLKRKRKNPGSVKIVVVDPRRTDTAKAADIHLPIAPGSDLALLHGIAHLVLRENGQDPAFIDDHTENYEAFFDVAARWTPRRVALFCNIPEKRLREVAALFHRREKVLSLWSMGVNQRREGTAVVQGLINLHLLTSQIGKQGAGPFSLTGQPNAMGGREAGGLAHLL

SEQ ID NO: 21011 - protein, 450 aa, Cryptococcus neoformans
MAPKADWEKYDKKVTDEKEEKIVALDESDIQILKTYGQGPYSLHLKKIENQIKDIQKRVNEKIGVRESDTGLAPANLWDIPADKQRSGRPLQVARCQTIIKAANPPSGDQPLNPQDGAGAGNPEGDRYVISIKQVAKFVVGLGDEVSPTDVEEGMRVGVDQVTYKIMLPLPPKIDPSVTMMQVEERPSITYADVGGCKEQIEKLREVVELPLLEPERFVSLGIEPPKGVLLYGPPGTGKTLCARAVANRTDSTFIRVIGSELVQKYIGEGARMVRELFEMARSKKACIIFFDEVDAIGGARFDDGAGGDNEVQRTMLELINQLDGFDPRGNIKVIMATNRPDTLDPALLRPGRLDRKVEFSLPDNEGRTHILKIHGKSMSVERDIRYDLIARLCPNATGAELKAVATEAGMFAIRARRKVATERDFLDAVEKVIRQGSKFSSTALYAQYN

SEQ ID NO: 21012 - protein, 219 aa, Unknown
  uncultured bacterium
NSRLCMSSAVAGYTRSLGSDGPPCSYEDLDHCTVAFLIGTNTAECHPVLFQRLLKRKRKNPGSLKIVVVDPRRTDTAKAADIHLPIAPGSDLALLHGIAHLVLRENGQDPAFIDDHTENYDAFFDVAARWTPRRVALFCNIPEKRLREVAALFHRREKVLSLWSMGVNQRREGTAVVQGLINLHLLTGQIGKQGAGPFSLTGQPNAMGGREAGGLAHLL

SEQ ID NO: 21013 - protein, 617 aa, Ananas comosus
MDGAAASAAATASIRVPYRHLNEAELELVRLDGEPNGEAEVAPSRAVHVPSSSPSSSSSPSAPAMAKPRSSVKTLVLSCTVAAGVQFGWALQLSLLTPYIQTLGIQHAFSSFIWLCGPNYRLCGATMCWYLGVINALSKYGTEAAFLFLLGVSRYRFAVTLIRLFLQTLDTFLGDTSEHCSTYKGTRYRAAVFFIIGFWMLDLANNTVQGPARALLADLSGPDQCSSANAIFCSWMAVGNILGFSSGASGHWHRWFPFLTTRACCEACGNLKAAFLIAVIFLLSCMLVTLYFAKEVPLEANHSRQLSDSSPLLHNQGTERHESSHSNYEKLTNGRHSESNIESSNSHFDYSEDINSNISRDNSEHFNDGPGAVLVNILTSLRHLPPGMHAVLLVMALTWLSWFPFFLFDTDWMGREVYHGDPNGDSTERQYYENGVREGAFGLLLNSAVLGVSSFLIDPMCRFIGARLVWAACNFIVFICMAATTILSWVSISNYSNGIQHVIGANKAVKNVALVVFSLLGFPLAITYSVPFSVTAELTAGTGGGQGLATGVLNLAIVVPQMVVSIGAGPWDALFGGGNIPAFALASIFSLAAGILAVLKLPRLTNSYSSVGFHGFG

SEQ ID NO: 21014 - protein, 219 aa, Unknown
  uncultured bacterium
NSRLCMSSAVAGYTQSLGSDGPPCCYDDLDHCKVAFLIGTNTAECHPVLFQRLLKRKKRNPGSLKIVVVDPRQTDTAKAADIHLAVAPGSDLALLHGIAHLVMRENGQDPTFIDNCTDNYDSFFDVVARWTPRRVALFCGIPEKRLREVAQLFHRREKVLSLWSMGVNQRREGTAVVGGIINLHLLTGQIGKEGAGPFSLTGQPNAMGGREAGGLSHLL

SEQ ID NO: 21015 - protein, 464 aa, Haloarcula marismortui
MLVSLTKCMHVFWHQRDLRIPDNRGLTAAAADDEVLPVYVLDTDLLANIGKRQKAFLLAGVRALKQAYRDHGGELLVKKGTAVDVLSNVVDEYDADRVYYNEHYRPARRNRQRRVDEALPTKSLTDLVLVDPAGLDSQYENHSRFYDDWQAHHKLPPVGSPDSGSLVDVSDPTTAPTIETEMDLPTPGYEGARQRYDDFLTGGIETYNDTRDDMQAAVERPTSAVSRMSPYLAAGMIGIREMWRDASDRHTEATGDAQRNIQKYRYELSWREQSYHLLYYNPTLLSENYKTFPNRIEWENDEDNFEAWKHGETGYPFIDAGMRQLEQEGYIHNRPRQNVASFLTKHLLVDWREGARHFRKRLVDHDPANNAASWQWTASTGTDSVDVRIFDPVAQMSKYDSGADYVTEYVPELRGVPSTKIVDWPTLSDGEREELAPDYYHPIVDRNAAYERAQRVFETALGKR

SEQ ID NO: 21016 - protein, 657 aa, Legionella pneumophila
MEICYRIWDKLIRGRKTNNLSLFSALWRERMLFQYIKKFFLFLWVQAVSISFLLAMASVSFAQLTAQDHAAHHQGEKESEGMGGMMKNIGTPSKELYPSLMNLPTLSPEKRLAIQQKAHQRITSGMALMKGGLNELLLASNNNDYAKMQEALEKLREGIAQYESALAALRALSEGKNPRDIALQWFKREMNLLPSTPQAKNVLGGPFFHLTIIALFGLFFLVMIWMYFFKMRRAAALLDRLTKQNATVSSETPPQFSKAPEPTPSLTSVEPIKSSQVSKVPSETAPTTPPTCPAHKCPVPQFPVMRSLTEPEEKWEGQLRVCRIFQEAPGIKTFHLASTHEVALPFTYYPGQFITLTALINGKTVRRSYTMASTPTQLHYCAITVKREEQGVFSRYLHDEIKEGDLLEVMGPNGKFTFTGEEAKSIVLICGGVGITPMMSIIRYLTDIGWHNDIYLLYCCRTTSEFLFREELEQLQERYLNLHVYASMLRSEGTIWMGLQGLFTKNIISHLVPDIASHRIHVCGPPAMMAAILGILKELKVPADLILTEAFGPEKKPEIIQEDLEAIKADTRSMISFRKSEKMVPILPDRTLLEIAEANGIAIDNACRTGQCGLCKVKLLSGEVTMACEDALSKEDKQQRLILACQAKATQNIEVDA

SEQ ID NO: 21017 - protein, 666 aa, Bacteroides fragilis
MKMNYLAFIGVTAATAVVSCTPAKKEYASYELYPVRSGSLTEMEYSPESTKFTLWAPTADEVRLMLFDSGEGGHAYETIPMEPGEEGTWMATVSKDLMGKFYTFNVKVNDKWMGDTPGINAKAVGVNGKRAAIINLKSTDPQGWETDQRLPLKSPADAIIYEMHHRDFSVDSTSGIQHKGKFLALTEHGTMNSAKLLTGIDHLIELGVTHVHLLPSYDYASVDETKLDENKYNWGYDPQNYNAPDGSYATDPYDPAVRIREFKQMVQALHKAGIRVVLDVVYNHTYNTDGSNFERTVPGYFYRQKPDGSLANGSACGNETASNRPMMRKYMIESVLHWIREYHIDGFRFDLMGIHDIETMNEIRKAVSAVDPSIIIYGEGWAAEAPQYPGDSLAMKVNTCKMPGIAAFSDEMRDALRGPFNDNHKGAFLAGIPGEEESIKFGIVGAVSHPQVNNDSVNYSKAPWASQPTQMISYVSCHDDMCLVDRLKSSIPGITPEQLVRLDKLAQTAVLTSQGIPFIYAGEEVMRDKKGVHNSFESPDSINAIDWNRKTTHEDVFAYYKRLISIRKAHPAFRMGDAEMVRKHLEFLPVDGGNLVAFRLKDRANGDTWDNIIVALNARSVPAKLAIPEGKYTVVCRDGVIDERGLGSLYGPEVTVPAQSALIIHQ

SEQ ID NO: 21018 - protein, 497 aa, Methanosarcina acetivorans
MCGIAGVFGTPDSNLKVKKMLAALGHRGPDACGIHTAGDLSIGNTLLKITGDMPQPLTGKGALVLNGEIFNFRELAAEIGIKIDSDTELLFSLIETGVKEGSTPIDAVCSALSKVNGDYALAYACGGELVLARDPSGVKPLFYCSGTEGEKPEIAFASEKKALAFISRKAKPFPQGGILGFNTESGKITEKIPEGYLEIKSPEKRIYTEHEALSQLKETLEKAVELRLTPTTGIAFSGGIDSTFLAALAKRIDPGVSLYAVGLPDSHDITQAERAAEAIGMRKNLKVHFLSPEEIEAAVPRVVYATESTDPMTVAIGIPLYIVAKTAKEDGKRVLLTGQGADELFGGYRRHEEFLKKGAEVLDREIYSDLATISKINLERDDMVTMANSVELRVPFLDKEVIKTGLAIRPELKVLKKDGYYEDGYYERKYILRKAAKGLIPPEILWKEKKAMQYGTGVQKVLDRLARDSGFSKKQESHIEKYLMQIASEKGFEFVNN

SEQ ID NO: 21019 - protein, 708 aa, Debaryomyces hansenii
MATSIPVQMTMGNNGHKQANGSIPVPSPQPVAPPTNPSNILMETTAGTWLAIGSLAESLGDVEKALASYDSALRHSPNNPEILTKLANMYRSKDVFFKAAELYEQALNFHPENGETWGLLGHCYLMLDDLQRAYAAYQRALYYLDNPNVPKLWHGIGILYDRYGSLEYAEEAFVRVLELDPNFDKSNEIYFRLGIIYKHQGKLQSALECFQYILTNPPHPLTQPDVWFQIGSVLEQQKDWNGAKEAYEKVLQVNPQHAKVLQQLGCLYSQAEPAPSGNSNQQPFQQDLNIALKYLLQSLEIDQSDAHSWYYLGRVHMIRGDFNAAYEAFQQAVNRDSRNPTFWCSIGVLYYQISQYRDALDAYTRAIRLNPYISEVWYDLGTLYETCNNQISDALDAYRQAERLDPSNPHIKARLDQLIKYQQDGNTQPPQPPPVSQQPKLPQGMILESTQMQQQGPQQPQLLPGHPPPPPSAQQQSQLHQQPPLLQPHQQGPPPPHSLPQPHQISQPNQPAVSPIPPVHQPPPLAQSNPQTSYLPSIPQPSSQIQSSTHTPNQASVKPPSPPPQSSLPPPQNSPPQKSTSIPSIQQNNGTKRDLEDKKDTKVTKKQSKKSAKSQQNSSLNSLANAANNASSAKSETPKTDEREPKSTKQSPKADKESSKSKTEVPQFSSNVTGKKEDEEEETEEKKSSEPVEPPLRRVDEDENYDDD

SEQ ID NO: 21020 - protein, 257 aa, Elymus virginicus
CELDNIMRLAGITGIVNGMDVSEWDPTKDKFLAVNYDITTALEAKALNKEALQAEVGLSVDRKVPLVAFIGRLEEQKGPDVMIAAIPEIVKEEDVQIVLLGTGKKKFERLLKSVEEKFPGKVRAVVRFNAPLAHQMMAGADLLAVTSRFEPCGLIQLQGMRYGTPCACASTGGLVDTIVEGKTGFHMGRLSVDCNVVEPADVKKVATTLKRAVKVVGTPAYQEMVKNCMIQDLSWKGPAKNWEDVLLELGVEGSEPG

SEQ ID NO: 21021 - protein, 613 aa, Bacillus licheniformis
MCGITGWVDFKKPLVREQSIMEKMTDTLSKRGPDDTNIWGKRHVLFGHKRLAVVDLEGGRQPMTRTHQGYDYTICYNGELYNTEDLRKELRRRGHQFKSHSDTEVLLHSYMEWKEECIDRLNGIFAFAVWDEKRDLLFAARDRLGVKPFFYTEQGSSFLFGSEIKAILAHPEVKAKVDRSGLAEIFGLGPSRSPGSGVFKGVKEIRPGHAMIFSKDGLTVWRYWNVKSEKHTDSFDETVENVRSLFQDAVTRQLVSDVPVCTFLSGGVDSSAITATAAKHFEREGKAPLHTFSIDYEDNEQYFTSSSFQPNADGPWIKKMSDAFGTVHHNCVISQEELAAYLEEAVLVRDLPGMADVDSSLLWFCREIKKDFVVSLSGECADEIFGGYPWFHSAEDVKGFPWMRSMEERIGLLQDGWQKKLNLSEYVKAKYEETVKETPLLEGETGAEKRRRELFYLNMLWFMTTLLDRKDRMSMGASLEVRVPFADHRLVEYVWNIPWDVKMHGSREKGIFRKALEGILPDEVLYRKKSPYPKTHHPAYTKAVIRWLESLLEQKDSALYAFLEKKKLERLIETEGASFQVPWYGQLMKGPQLIAHLAQIHTWFESYRIDIEE

SEQ ID NO: 21022 - protein, 236 aa, Morus indica
MTRRYWNINLEEMMDAGIHFGHGTRKWNPKMAPYISAKRKGIHIINLTRTARFLSEACDLVFDAASRGKQFLIVGTKNKAADSVAQAAIKARCHYVNKKWLGGMLTNWYTTETRLHKFRDLRTEQKTGRLKRLPKRDAAVLKRQISHLQTYLGGIKYMTGLPDIVIIVDQQEEYTALQECITLRIPTICLIDTNCDPDLADISIPANDDAIASIRLILNKLVFAICEGRSSYIRNS

SEQ ID NO: 21023 - protein, 792 aa, Oryza sativa
MHLRLLLLLVGVAAAAADADADADALLAAKAAMSDPTGALASWGGNGTRTNTTAAAAAHCAWAGVTCSSRGAVVGLDVSGLNLSGALPAELTGLRGLMRLSVGANAFSGPIPASLGRLQFLTYLNLSNNAFNGSFPAALARLRGLRVLDLYNNNLTSPLPMEVVQMPLLRHLHLGGNFFSGEIPPEYGRWGRMQYLAVSGNELSGKIPPELGNLTSLRELYIGYYNSYSGGLPPELGNLTELVRLDAANCGLSGEIPPELGKLQNLDTLFLQVNSLAGGIPSELGYLKSLSSLDLSNNVLTGEIPASFSELKNLTLLNLFRNKLRGDIPDFVGDLPSLEVLQLWENNFTGGVPRRLGRNGRLQLLDLSSNRLTGTLPPELCAGGKMHTLIALGNFLFGAIPDSLGECKSLSRVRLGENYLNGSIPKGLFELPKLTQVELQDNLLTGNFPAVSGAAAPNLGEISLSNNQLTGALPASIGNFSGVQKLLLDRNSFSGVVPPEIGRLQKLSKADLSSNALEGGVPPEIGKCRLLTYLDLSRNNISGKIPPAISGMRILNYLNLSRNHLDGEIPPSIATMQSLTAVDFSYNNLSGLVPGTGQFSYFNATSFVGNPGLCGPYLGPCRPGVAGTDHGGHGHGGLSNGVKLLIVLGLLACSIAFAVGAILKARSLKKASEARVWKLTAFQRLDFTCDDVLDCLKEENVIGKGGAGIVYKGAMPNGDHVAVKRLPAMGRGSSHDHGFSAEIQTLGRIRHRHIVRLLGFCSNNETNLLVYEYMPNGSLGELLHGKKGHRCI

SEQ ID NO: 21024 - protein, 764 aa, Bacillus licheniformis
MGKQRLVLIGNGMAGVRTAEEISLHGGSRFEIVIIGSEPHPGYNRILLSSVLQGETDWNDVMTKSRSWYEENGITLYTGETAVAIDTVNQTVATDQNREIAYDKLIIATGSSPFILPVHGADKEGVYGFRTIDDCRAFINASKRFKKAAVIGGGILGLEAARGLANLGMKVDVVHHSSSIMQTQLDPPASAMLQKELERQGIHFLLEKDTEAILGTSRAEGVRFKDGTKISADLVVMAAGVRPNIELAKASGISTNRAIIVSDYMETNVPNVYAVGECAEHNGTVYGLVKPLYEQGKVLAKHICGLECSGYQGSVQSAALKMSGIDVFSAGKITEDDSTTAIKLLDEAAGVYKKAVFQGDKMAGVILYGDTSGSQRLLESIIKQRDITVVKKELFQSEEDSSVASMAVRETICQCNAVSKGMIMEAIQTHGLKTAEEVKRCTKASGSCGGCRPLVEELLLHTAEHDGHISAAEQPMCACTSFTEDEVVNEIQMRNLSSVHEVISALGWKNSSGCRICVPALHYYLKMIRPDIAYEEHEEETDAIIPQMYGGRTNAEELKRIAGVIEKYQIQEVYMTHHQRLKLAGIKPEHIERVKEELGMPYCLPQQQRIAAVKTCPCGSPQIQTLAADLEKAAESLLIPAKVSIGVSGCLDDCVYASVHDIGLLKVNGGWEIYAGGQGGQHASPGELLSVADSAEEAGELMKGLLQYYRETANYLEKIGHWIERAGIIHIREVLFDNGLRGQLFERLEKEKRLAQQEMIKGLM

SEQ ID NO: 21025 - protein, 159 aa, Burkholderia xenovorans
MTSIYSFSARTLGGEEVSLEQYSGKVLLIVNTASECGFTPQYAGLQKLYETYAARGLAVLGFPCNQFGKQEPGDAAQIGSFCEKNYGVTFPMFDKVDVNGANAHPLFRYLTGEAPGVLGLEAIKWNFTKFLIDREGNVVKRYAPLTKPEAITEDIEKLL

SEQ ID NO: 21026 - protein, 719 aa, Bacillus licheniformis
MTERLLKYFRTKQKEVQSEKTYDTQCPFCSMQCKMQLIEQTIVTRKKYTAVGKDNPTTKGRLCMKGMNAHQHAFHSERITHPLIKKNGEFVRVSWEEALQYIKEQVTAIQHEDGRDALSVYGSASITNEEAYLLGKFARVALKTKHIDYNGRLCMSAAATAANQTFGMDRGLTNALSEIPHARVIILAGTNIAECQPTIMPYFEEAKQNRAYIIVIDPRETATAKIADLHLKIKPGTDAALANGMLKIIIEEQLTDGAFIRDRAEGFEEVKRHVASLSLEDISAKTGIQIEQIKKAAVKFAREETGMLFTARGVEQQTDGTAAVRNLLNILISTGKIGKYACGYGAVTGQGNGQGAREHGQKADQLPGYRSIENEADRAYIADVWGIKAEDLPGKGVSAYEMMKKVHEGEITGMFLMCSNPVVSSPTAGFVKSALGKLKFFAAVDLFLSETAILADVVLPASSYLEDEGTMTNLEGRVTLREASKPCPGEARHDWQIICDIAKALGKGRYFSYRSAEDVFNELRKASRGGIADYSGITYERLRKEGGILWPCPEEGHPGTQRLFESSFSHPDKKARMCVVPNEPKVKKDVPTEEYPLILTTGRVMSHYLTGVQTRRSAALKARHFESFMEIHPKTAEKYNIGDRVLVRVESKRGSIIVRSKWSEAIRPDTVFVPIHWADSQNVNDLIAETLDPSCSMPGFKVCSVKIRPSVDNFVNKLS

SEQ ID NO: 21027 - protein, 489 aa, Unknown
  Oceanospirillum sp. MED92
MSGSDKLNIFSFTGKMKILHMSWIAFFITFFVWFNHAPLLGAIAESLGLTKAEVKTLLILNVALTIPARIIIGMLTDKYGPRITYASLLFIASIPCFAFALSTDFAQAAISRFLLGFIGAGFVVGIRMVSEWFPANELGTAEGIYGGWGNFGSAAAAMSLPTLALIFGGEDGWRYAVGLTGLMSLIFSYIWYKNVSDTPKGSTYFKPKKIGGMEVTSKGDFYFMLVMKIPMYAALSLLTWKLSPAGVSILSESAAIAIYVSLAFILIYDCYSAYNVNKEIFVKPVPEVEQYKFKQVAVLNVLYFATFGSELAVVSMLPLFFSEVFELDMVYAGLLASAYAFMNLMSRPGGGWISDRFGRKKTLLILTAGLAAGYATMSMIDSSWPLFLAVAAAMACSFFVQAGEGAVFAVVPLIKRRLTGQIAGMTGAYGNVGAVFYLTVLSMVDYSTFFTVIAATAVLGFVALLMLEEPKGHMAEVNEDGTVELIKVN

SEQ ID NO: 21028 - protein, 257 aa, Elymus wawawaiensis
CELDNIMRLTGITGIVNGMDVSEWDPTKDKFLAVNYDITTALEAKALNKEALQAEVGLPVDRKVPLVAFIGRLEEQKGPDVMIAAIPEIVKEEDVQIVLLGTGKKKFERLLKRVEEKFPGKVRAVVRFNAPLAHQMMAGADLLAVTSRFEPCGLIQLQGMRYGTPCACASTGGLVDTIVEGKTGFHMGRLSVDCNVVEPADVKKVATTLKRAVKVVGTPAYQEMVKNCMIQDLSWKGPAKNWEDVLLELGVEGSEPG

SEQ ID NO: 21029 - protein, 329 aa, Anabaena variabilis
MAQDRKSTVIVTGASSGVGLYAAKALAKRGWHVVMACRNLEKAEQAAQEVGIPKDSYTIIHIDLGSLDSVRQFVNDFRATGKSLDALLCNAAIYMPLIKEPLRSPEGYELTMTTNHLGHFLLCKLMLEDLQKSSAADKRLVILGTVTHNPDELGGKIPPRPDLGNLEGFAQGFKPPISMIDGKKFEPVKAYKDSKVCNVLTMRELHRRYHESTGITFTSLYPGCVAETPLFRNHYPLFQKIFPLFQKYITGGYVSQELAGERVADVIAAPEYKQSGAYWSWGNRQKKDGKSFVQKVSPQARDDEKAERLWDLSEKLVGLESQKPVALNS

SEQ ID NO: 21030 - protein, 104 aa, Enterococcus faecalis
MTQAITDKDFATETDEGLVLIDFWATWCGPCRMQAPILEQLSEEYDEDEVKIVKMDVDENPATPASFGIMSIPTLLLKKDGEVVEKAVGVHTKDQLQAMIAKHL

SEQ ID NO: 21031 - protein, 313 aa, Pseudomonas syringae
MIGTPRSLDCEDAMTLQYQTIADCVGNTPLVRLQRMAGNTSNTLLLKLEGNNPAGSVKDRPALSMITRAELRGQIHPGDTLIEATSGNTGIALAMAAAIKGYRMILIMPDNSSAERKAAMTAYGAELISVSKDQGMEGARDLAERMQAEGRGKVLDQFANGDNPEAHYTSTGPEIWRQTGGTVTHFVSSMGTTGTIMGTSRYLKEQNPEVQIVGLQPMEGASIPGIRRWPHEYLPKIYQSDRVDRIIDMGQTEAEDTMRRLAREEGIFCGVSSGGSVAGALRISQEVENAVIVAIICDRGDRYLSTGVYDSPN

SEQ ID NO: 21032 - protein, 387 aa, Oryza sativa
MLPAVKLSPGPVAFAGTNLRSRSASVSSVSSLKPSKFVVSPLRPLYLAPLDGPRAAGQKAQRQPLEFRCAASAADDKESKTEVVPVRSEAAQKLKISIYFATWWALNVIFNIYNKKVLNAFPYPWLTSTLSLACGSAMMLVSWATRLVEAPKTDLDFWKVLFPVAVAHTIGHVAATVSMSKVAVSFTHIIKSAEPAFSVLVSRFLLGETFPVPVYLSLLPIIGGCGLAAVTELNFNMVGFMGAMISNLAFVFRNIFSKRGMKGKSVSGMNYYACLSIMSLVILTPFAIAMEGPQMWAAGWQKALAEVGPDVVWWVAAQSVFYHLYNQVSYMSLDEISPLTFSIGNTMKRISVIVSSIIIFHTPVRPVNALGAAIAILGTFLYSQAKQ

SEQ ID NO: 21033 - protein, 560 aa, Unknown
  delta proteobacterium MLMS-1
MAGLATTFGSGAMTNSVNEIEAADVILLSGSNTTEAHPQVARRIISAQDRGARLIVIDPRRTEMAARADVHLGLKPGSDIPLLNAIQRIILDENLADELFIEMRTENFATLRDQLFRLELSATIASCGLEPAAVRQAALLYGRARKAVICYCLGVTQHVCGTANVEALANLAMLTGNVEKQECGVDPLRGQNNVQGACDMGGLPAMLPGYQPVADEECRRRFEQAWGVEIPTRPGKTLLEMTHGRLPPDHRRPAAGRQQPATPLRGLFIMGENPLLSDPDLTRVRKNLAGLELLAVSDIFLTETAARAHVVLPAACFAEKDGTFTNTERRVQLIRQAVAPPGQARPDGEIIAALARRLGYEMAGSPAHEIMEEIALLTPIYGGIYHDRLASGAGLQWPCWDRRHPGTPYLHKYYFTRGKGRFVVAAQEEPAEAPDADYPLLLNSGRLYHHYHTGAMSRKSPLLEREAGVARLQVNPADAESRGIRDGERVRLRSRRGQVELAAELTTMVPPGMVYGTFHFQEAPINRLTIAACDQRAKCPEYKICAVELSRADAQGRGNE

SEQ ID NO: 21034 - protein, 515 aa, Kluyveromyces lactis
MCGILAYFGKSFGSTLTDEFQELYEKDLTGPIQSCNSNTLFNELIPYIVRRGPNYASLRSLSEINAMLFSSVLSLRTPFTKQSVMVQDRYLLQYNGELYNDDTVENCEHSDTEYISSLLEKHSVEEVVRKCYGEFAYAITDLQERKVYFGRDSIGKRSLSYILLDDELYITSVSGRCDGFQNCLAGVIYIFDINTKQLTGSVKIHDEPYIVSDQIDNDFQLLEEYKIKLYECLRRSVYQRIVTIHPMHLENGNISILFSGGLDCSVITALLCEQLIKINRNSETIIELLNVGFENPRTGKMPSDSPDRILAIKSAQLLSELYPQVNIKLIEVDVPYTDYLSHKDTVIDLMYPKNTEMDLSIAIAFYFASRGRGKVTENGESKPYNRSGIVMFSGLGADELYGGYHKFSNKSNEELVIELQKQIAQIHDRNLNRDDKVISNHGIEVRYPFLDERVVQFSVDLPLNYKVNKHILRVMAKDILRLDFISEEPKRAIQFGARSAKMTKDSNKRGTDLLK

SEQ ID NO: 21035 - protein, 245 aa, Pseudomonas putida
MSQVNMRDMLKAGVHFGHQTRYWNPKMGKYIFGARNKIHIVNLEKTLPMFNDALSFVERLAQGKNKILFVGTKRSAGKIVAEQAARCGSPYVDHRWLGGMLTNYKTIRASIKRLRDLETQAEDGTFAKLTKKEALMRSRDLEKLDRSLGGIKDMGGLPDALFVIDVDHERIAITEANKLGIPVIGVVDTNSSPEGVDYIIPGNDDAIRAIELYMTSMADAVIRGRNNVAGGTEVYAEEAAAPAAE

SEQ ID NO: 21036 - protein, 343 aa, Oryza sativa
MFNCAAREKAMVINLEFIRAIVTADEILLLDPLTIDVIPFVEQLTHHLPLKNLVCGNGQPGGDDHGEKHDDSHGDQVPRLNEATGAEHELPFEFQVLELALETVCSSFDVNVSGLERRATPVLEELTKNVSTRNLDRVRTLKSDLTRLLAHVQKVRDEIEHLLDDNEDMAHLYLTRKQLQNQQVEALISSAASNSIVPGGTSLSRLNNSFRRSVSIATSMHLDNDVEDLEMLLEAYFMQLDGIRNRILSVREYIDDTEDYVNIQLDNQRNELIQLQLTLTIASFGIAVNTFIAGAFAMNIQSKLYSIDDGSFFWPFVGGTSSGCFMICIVLLWYARWKKLLGP

SEQ ID NO: 21037 - protein, 137 aa, Brassica napus
  misc_feature (10)..(10): Xaa can be any naturally occurring amino acid
  misc_feature (12)..(12): Xaa can be any naturally occurring amino acid
MRGPRPEDFXPXPSTPITGQPTPTYPAGARKKGVGVRTWLVLCARGQAQTTEVGKHAIMRRTGLPARDLRILDPLLSYPSTVLGRERAIVINLEHIKAIITAQEVLLLNSKDPSVAPFIDELQRRILCHYRATKPKE

SEQ ID NO: 21038 - protein, 875 aa, Unknown
  Oceanospirillum sp. MED92
MHKLTTCPYCGVGCGVDAELGEGVVAKVQGDKEHPSNYGRLCVKGSSLHEVLGTNGRLLSPLVDGQRVSWADALDRVAEELLCTIKEHGPDSVAFYLSGQLLTEDYYVANKLIKGFIGTANVDTNSRLCMSSAVAGYKRAFGSDTVPCCYDDLEQTDLLVLVGSNTAWNHPILFQRMQAAKRKNPDLKVVVVDPRRTATCDLADLHLAIKPGTDSELFSGLLSYISSEDLVNRAYVTQFTEGFNEAISAASEQFNSRAELAEYCGIDLATLEQFYQLFSATDKVISFYSQGVNQSSSGTDNSNAIINCHLATGRIGYPGAGPFSITGQPNAMGGREVGGLANQLAAHMDFSSAEAIDRVGRFWDAPNIAQANGLTAVNLFQAVEKGEIKAVWVMGTNPAVSLPNTNQVSRALEECPLVVVSDCMASTETIRYADICLPATGWSEKNGTVTNAERRISRQRGLLPPSGEAKHDWWIISEVAKRMGYAEAFDYQHPYQIFAEHAELSGFENDGKRDFDISLFSDITETAYDALKPVQWPVTNDAPYGTARMFADGRFYTPSGKARFIPVTANKPKQLPTPELPYVMNTGRLRDQWHTMAMTGRTSRLFSHRDEPFVELCQADAQKEGIVEGELVKLSHPQGEYIGRARITDDQRPGELFVPMHWNGEFSAKARMGVLLEPVTDPISGQPESKHGRVAIEALNPKWQGWFICQAEMKPDFPVTYWTRVPKKETEFYYLADTAELDDPLQWCRDKFGEVDIWLEDKAEQSFRAAGLQGEKLQWAFFIMPYGQIPSTGWLEEMFAETELSLDQRRFLLSVTGCEIEDPGSIICSCYQVGSNAIEDAISQGCCSAEALGEKLKCGTNCGSCIPELNALIAK

SEQ ID NO: 21039 - protein, 450 aa, Methanothermobacter thermautotrophicus
MRVVIVGGGAGGLSTASNIRKHDKDADIKVITRDKHVAYSPCAIPYVMCGEVECFDDIVMHRPEDYRERNIDILTETEVEAIDPQKKTVTYRGKDGLREIPYDVLVLATGGSPFIPPVEGTDLEGVFTIRTLTDGERITEWASKSKRAVVVGAGLIGLEIAYGLLRMGLEVTVTEMLPQIVPRSLDPDMAAIVQGYLEEKGIRVILGKALDRIVGDERVEGVVVGDECLEADLVVLATGVRPETKLARMAGCEIGQWAVKVNDRMQTSVPDIYAVGDCVEVYDAVTGFRTQSPLGSTAVRQARVAAKNIVGMDARFRPVLNAMVSKIGELEFGAVGLTEVMALQNGIKVVSGKKRALTKARYYPGAERIDVKMICDLRGRIIGCQMVAKERVAERVDTMSLAISQGLTCSELSETEFSYAPPVSMVIDPIILAAEDACEKLKRVNGRPQD

SEQ ID NO: 21040 - protein, 95 aa, Oxalis tuberosa
  misc_feature (75)..(75): Xaa can be any naturally occurring amino acid
LYAGINISGTNGEVMPGQWEYQVGPSVGIEAGDHIWASRYILERITEQAGVVLTLDPKPIDGDWNGAGCHTNYSXKSMRDEGGFEVIKKAIFNLS

SEQ ID NO: 21041 - protein, 85 aa, Arabidopsis thaliana
  misc_feature (12)..(12): Xaa can be any naturally occurring amino acid
  misc_feature (27)..(27): Xaa can be any naturally occurring amino acid
WLPPPLSYAAEXTWAGYDTMVAPFTGXKSYAEFPVTPKTNKDITSIASNGGRVSCLKAWPPIGKKKTETPIYLPDLSDPKTAKEA

SEQ ID NO: 21042 - protein, 164 aa, Triticum aestivum
  misc_feature (78)..(78): Xaa can be any naturally occurring amino acid
  misc_feature (92)..(92): Xaa can be any naturally occurring amino acid
  misc_feature (99)..(99): Xaa can be any naturally occurring amino acid
  misc_feature (108)..(108): Xaa can be any naturally occurring amino acid
  misc_feature (116)..(116): Xaa can be any naturally occurring amino acid
  misc_feature (128)..(128): Xaa can be any naturally occurring amino acid
  misc_feature (133)..(133): Xaa can be any naturally occurring amino acid
  misc_feature (137)..(137): Xaa can be any naturally occurring amino acid
  misc_feature (140)..(140): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVXDYLIRSKWVPCLRXNKLGHLXVEHNASPGXYYDGRYWXMWKLPISGCTDXQVINXVEEXKKXTLYFSRQMLQVGSHFNNRVQDPEG

SEQ ID NO: 21043 - protein, 433 aa, Corynebacterium efficiens
MCGGDTRKFYPLFYCRSAHAGLNCDSQHQLSMSLDSSLDSHSSRLTFPQKAEAPMTTTSAASSTASSTTTAKILPHPLNAWYVAAWDHEVTSKGIISRTIANKPLALYRTQDGRAVALADACWHRLAPLSKGKLTGRDGIQCPYHGLVYNSAGRCMSMPAQETLNPSAAVASFPVVEQYRYIWVWLGDPTLADPTTVPDMHQMTHPEWTGDGKTIAAACNYQLVLDNLMDLTHEEFVHSSSIGQDELSEADFEVTHTEDSVTVSRWMRDIDPPPFWQKNMNDKFPGYEGKVDRWQIIHYYYPSTICIDVGVAKAGTGAPEGDRSQGVNGYVMNTITPETDRSSHYFWSFQRNYRLDSQLITTQLRDGVHGVFGEDEEMLTAQQEAIDANPDYEFYNLNIDAGGMWVRRILEKALEAENRLHIPTTSAPVRKES

SEQ ID NO: 21044 - protein, 219 aa, Unknown
  uncultured bacterium
NSRLCMSSAVAGYTRSLGSDGPPCSYEDLDHCTVAFLIGTNTAECHPVLFQRLLKRKKRHPGSVTIVVIDPRQTDTAKAADIHLAVAPGSDLALLHGIAHLVMRENGQDPTFIDNCTDNYDSFFDVVARWTPRRVALFCGIPEKRLREVAQLFHRREKVLSLWSMGVNQRREGTAVVGGIINLHLLTGQIGKEGAGPFSLTGQPNAMGGREAGGLSHLL

SEQ ID NO: 21045 - protein, 461 aa, Pseudomonas putida
MSGNNSNDLAQGLKQRHVTMLSIAGVIGAGLFVGSGHAIAAAGPAVLLAYAAAGTLVVLVMRMLGEMAVASPDTGSFSTYADRAIGRWAGFTIGWLYWWFWVLVIPLEANAAAAILHAWFPAVDLWAFSLIITLALTLTNLCSVKNYGEFEFWFALLKVLAIIGFIAVGCAALFGFVPNSQVSGASHLFDTQGFMPNGLGAVLAAMLTTMFSFMGTEIVTIAAAESKDPGKQISRATNSVIWRICLFYLVSIFLVVALVPWNDPALAETGSYQTVLSRIGVPNAKLIVDIVVLIAVTSCLNSALYTSSRMLFSLSKRGDAPAIAQRTTKAATPHVAVLLSTAAAFLCVFANFVAPAQVFEFLLASSGAIALLVYLVIAVSQLRMRAQREARGEKITFKMWLFPGLTWATIAFIVAILVVMALREDHRAEIIATALLSIGVVAAGLLVHRKREAAGRVALDN

SEQ ID NO: 21046 - protein, 540 aa, Hordeum brevisubulatum
MGWGLGDPPADYGSIMAVGLFVALMCICIIVGHLLEENRWMNESTTALLLGLGAGTVILFASSGKNSRLMVFSEDLFFIYLLPPIIFNAGFQVKKKQFFRNFMTITLFAVVGTLISFSIISLGAMGLISRLNIGALELGDYLALGAIFSATDSVCTLQVLSQDETPFLYSLVFGEGVVNDATSVVLFNAIQNFDLGNFSSLKFLQFIGNFLYLFGASTFLGVASGLLSAYVIKKLYFGRHSTDREVAIMMLMAYLSYMLAELLDLSGILTVFFCGIVMSHYTWHNVTESSRVTTKHAFATLSFISETFLFLYVGMDALDIEKWKIVSETYSPMKSITLSSIILALVLVARAAFVFPLSYLSNLTKKTAGEKISIRQQVIIWWAGLMRGAVSIALAYNKFAKSGHTQLPSNAIMITSTIIIVLFSTIVFGLLTKPLIRLLIPARHLTREVSALSEPSSPKSFLEQLTVNGPETDVENGVSIRRPTSLRMLLASPTRSVHHYWRKFDNAFMRPVFGGRGFVPFVPGSPTESSVPLLAHGSEN

SEQ ID NO: 21047 - protein, 289 aa, Oryza sativa
MAMAKELQETSSSSSSSAASTSSCSSAVTDAWSSPARPNAVAGGKRKKEVVGEADEAAGGGAGEEEEEEAEAAAAGKSSAATKKRKRSSDGKHPVYRGVRMRAWGKWVSEIREPRKKSRIWLGTFPTADMAARAHDVAALAIKGRAAHLNFPDLAGVLPRAASASPKDVQAAAALAAAFTTSPSSSPSSSLSADDVAPCVVHADADEQPAAAAKNDDDDGSTTAPVAAAAAAAAADEQQLFDLPDLLFDIQDGPFGFPAMWAPLADVDEVNAELRLEEPLLWDLGVTDA

SEQ ID NO: 21048 - protein, 219 aa, Unknown
  uncultured bacterium
NSRLCVSSAVAGYTRSLGSDGPPCCYDDLDHCSVAFLIGTNTAECHPVLFQRLLKRKKRNPGSVTIVVVDPRRTDTAKAADIHLPIAPGSDLALLHGIAHLVLRENGQDPTFIDDHTENYEAFFDVVARWTPRRVARFCNLPEKRLREVAQLFHRRENVLSLWSMGVNQRQEGTAVVCGLINLHLLTGQIGKEGAGPFSLTGQPNAMGGREAGGLSHLL

SEQ ID NO: 21049 - protein, 137 aa, Oryza sativa
  misc_feature (57)..(57): Xaa can be any naturally occurring amino acid
  misc_feature (89)..(89): Xaa can be any naturally occurring amino acid
YILEKQPPCHIQLNHGDLTSFARTFLNGPLGLTQMSASRIERLSANYSKEAATPSSXVKGSGASLLSMSATSAPAMALVGERISTEGTXGLSLAVSNILLGWILLGVFALIWSLYTIYTSDIEEEVESAGRSALESL

SEQ ID NO: 21050 - protein, 219 aa, Unknown
  uncultured bacterium
NSRLCMSSAVAGYTRSLGSDGPPCSYEDLDHCAVAFLIGTNTAECHPVLFQRLLKRKKRHPGSVTIVVVDPRQTDTAKAADIHLAVAPGSDLALLHGIAHLVMRENGQDPTFVDNCTDNYDSFFDVVARWTPRRVALFCGIPEKRLREVAQLFHRREKVLSLWSMGVNQRREGTAVVGGIINLHLLTGQIGKEGAGPFSLTGQPNAMGGREAGGLSHLL

SEQ ID NO: 21051 - protein, 193 aa, Hedera helix
PGDYGWDTSRGLSADPETFAKNRELEVIHSRWAMLGALGCVFPELLARNGVKFGEAVWFKAGAQIFSEGGLDYLGNPSLVHAQSILAIWATQVILMGAVEGYRIAGGPLGEVVDPLYPGGSFDPLGLAEDPEAFAELKVKELKNGRLAMFSMFGFFVQAIVTGKGPLENLADHLADPVNNNAWAYATNFVPGK

SEQ ID NO: 21052 - protein, 591 aa, Helianthus annuus
MCGILAVLGCSDDSQAKRVRVLELSRRLKHRGPDWSGLYQHGDNYLSHQRLAIIDPASGDQPLFNEDQTIVVTVNGEIYNHEELRKRLTAAGHKFRTGSDCDVIAHLYEEHGEDFVDMLDGMFSFVLLDTRNNTYIAARDAIGITSLYIGWGLDGSVWISSELKGLNDDCEHFEVFPPGHLYSSKTGGFKRWYNPLWFAETIPSTPYDPLVLRCAFENAVIKRLMTDVPFGVLLSGGLDSSLVASITARYLAGTKAAKQWGAQLHSFCVGLEGSPDLKAAREVADYLGTVHHEFHFTVQDGIDAIEDVIYHIETYDVTTIRASTPMFLMSRKIKSLGVKMVISGEGSDEIFGGYLYFHKALNREEFHQETCRKIKALHQYDCLRANKSTSAWGLEARVPFLDKEFINVAMSIDPEAKMINMDQKRIEKWVLRRAFEDEEHPYLPKHILYRQKEQFSDGVGYSWIDGLKAHAELHVTDKMMLHAEHIFPHNTPVTKEAYYYRMIFERLFPQNSAKLTVPGGASIACSTAKAIEWDASWSNNLDPSGRAALGAHNAAYKKNMGPVGQVKLGPNIIDNVPRMMDISASELVIQG

SEQ ID NO: 21053 - protein, 961 aa, Streptomyces coelicolor
MTAHRTPLSELEQAMPFEQRHIGPDHEARAKMLAQVGYGSLDELTAAAVPDVIKNADRLDLPGARSEAEVLAELRSLADRNQVLDSMIGLGYYGTFTPPVILRNVMENPAWYTAYTPYQPEISQGRLEALLNFQTMVAELTGLPTSGASLLDEGTAAAEAMALSRRMGKNKKGLFLVDADALPQTVAVIRTRAEPTGVEVVVADLSEGIPAEVAEREINGVLLQYPGASGAVRDIKPVIDRAHELGALVTVAADLLALTLLTSPGELGADIAVGTTQRFGVPMGFGGPHAGYMAVHEKFARSLPGRLVGVSVDADGNKAYRLALQTREQHIRREKATSNICTAQVLLAVMAGMYAVYHGPEGLRAIARRTHRYATITAAGLAAGGVEIVHGSYFDTVTARVPGRAAGIVHAARENGINLRLVDADHVSFACDETTTRAQVGGVWHAFGVEGDIESLDAEAGETLPEALLRTDDFLTHPVFHQHRSETAMLRYLRRLADRDYALDRGMIPLGSCTMKLNATTEMEPVTWPEFGALHPFAPAEQAQGYLTLIRELEERLAEVTGYDKVSLQPNAGSQGEFAGLLAVRGYHRANGDEQRTVCLIPSSAHGTNAASAVMAGMKVVVVKTAEDGEIDVEDLRAKIDKHRDELAVLMITYPSTHGVFEEHVADICAQVHDAGGQVYVDGANLNALVGLAKPGHFGGDVSHLNLHKTFCIPHGGGGPGVGPVGVRSHLAPYLPNHPLQPAAGPQTGVGPISAAPWGSAGILPISWSYVRLMGGEGLKRATQVAVLSANYIAKRLEPHFPVLYNGPGGLVAHECIIDLRPLTKATGVSVDDVAKRLIDYGFHAPTMSFPVAGTLMIEPTESEDLAELDRFCEAMIAIRAEIEKVGSGAWPADDNPLRGAPHTADALGGEWDHAYTREEAVFPAGVSAADKYWPPVRRIDQAYGDRNLVCSCPPLDAYED

SEQ ID NO: 21054 - protein, 558 aa, Helianthus annuus
MCGILAVFGCVDCSQAKRARILELSSRLRHRGPDWSGLHSEEDCYLAHQRLAIVDPASGDQPLYNEDKSIIVTVNGEIYNHKEFREQLKSHKFNTGSDCEVIAHLYEEHGEDFVHMLDGMFSFVLLDTRNKSYIAARDAIGITPLYIGWGLDGSVWFASEMKALSDDCEQFMSFLPGHIYSSKNGGLRRWYNPPWWSELVPSTPYDPLVLRNAFEKAVIKRLMTDVPFGVLLSGGLDSSLVAAVASRHLVDSEAYCQWGSQLHTFCIGLKGSPDLVAAREVADYLGTRHHEFYFTVQEGIDALEEVIYHIETYDVTTIRASTPMFLMSRKIKSLGVKMVLSGEGSDEIFGGYLYFHKAPNKEEFHEETCRKIKALHLYDCLRANKSTSAWGLEARVPFLDKEFINVAMSIDPKWKMIDRDNGRIEKWVLRNAFDDDEKPYLPKHILYRQKEQFSDGVGYSWIDGLRDHANKQVTDSMLANANFVYPENTPATKEAYYYRKIFEKFFPKNAARLTVPGGPSVACSTAKAVEWDASWSKNLDPSGRAALGVHAAAYEDAK

SEQ ID NO: 21055 - protein, 219 aa, Unknown
  uncultured bacterium
NSRLCMSSAVAGYTRSLGSDGPPCSYEDLDHCTVAFLIGTNTAECHPVLFQRLLRRKKRHPGSVTIVVIDPRQTDTAKAADIHLAVAPGSDLALLHGIAHLVMRENGQDPTFIDNCTDNYDSFFDVVARWTPRRVALFCGIPEKRLREVAQLFHRREKVLSLWSMGVNQRREGTAVVGGIINLHLLTGQIGKEGAGPFSLTGQPNAMGGREAGGFSHLL

SEQ ID NO: 21056 - protein, 1304 aa, Arabidopsis thaliana
MAGDDLVETKKGSSKNSKDSNESKLKQKSPAEFFAENKNIAGFDNPGKSLYTTVRELVENALDSAESISELPEVEVTIEEIVKSKFNSMIGLIDRERVDTQLYDDYETEKARGKRLAKEARASEIQAKNLASGKKNKEPGVSKVLKARGEASYYKVTCKDNGKGMPHDDIPNMFGRVLSGTKYGLKQTRGKFGLGAKMALIWSKMSTGLPIEISSSMKSQNYVTFCRLDIDIHSYESFGFSTPYNCLQMVKIFRNIPHIHLHEKKGNKEKWHGAEIQVVIEGNWTTYRSKILHYMRQMAVITPYAQFLFRFISETPEKNVTIKFTRRTDVMPPIPIETKHHPSSVDLLLIKRLITDTSKKTLLQFLQNEFVNINKTLAARLIGEMGPDFGPSMAVKSVTSQQMVRIHQLFRQAKFDDPSGDCLSPAGEYNLRLGIIKELHPDMVATYSGSAQVFEGHPFIVEAGVSLGGRDVKQASHILLLFIHVSSSSHRFKGINIFRFANRIPLLFEQGADVVTRTALKRINWNSYKINQTQDKIGVFVSIVSTKIPFKGTGKEYIGDDISEIATAVKSAIQQCCIQLKSKIVKRLQAREQQERKRSLSRYIPDATGAVYEVLKQMTEEHKTKRKRYGEEDIVMLDKVSKQIITKETLKEKLAEHVEQVDYEMALEYATQSGVTMMFNEMGMCGNMDFFSSGSLGEVDFCPVPQAEPDSIVEDDYTDDEIDVDELERRMWRDKMRLKRLKEQDKGKEGVDAAKQRQSQEQARRKKMSRAQDGILKYMLKMMEVCKAQGFVYGIIPENGKPVTGASDNLREWWKDKVRFDRNGPAAITKYQAENNIPGIHEGNNPIGPTPHTLQELQDTTLGSLLSALMQHCDPPQRRFPLEKGVPPPWWPNGKEDWWPQLGLPKDQGPAPYKKPHDLKKAWKVGVLTAVIKHMFPDIAKIRKLVRQSKCLQDKMTAKESATWLAIINQEESLARELYPESCPPLSLSGGSCSLLMNDCSQYDVEGFEKESHYEVEELKPEKVMNSSNFGMVAKMHDFPVKEEVPAGNSEFMRKRKPNRDLNTIMDRTVFTCENLGCAHSEISRGFLDRNSRDNHQLACPHRDSRLPYGAAPSRFHVNEVKPVVGFPQPRPVNSVAQPIDLTGIVPEDGQKMISELMSMYDRNVQSNQTSMVMENQSVSLLQPTVHNHQEHLQFPGNMVEGSFFEDLNIPNRANNNNSSNNQTFFQGNNNNNNVFKFDTADHNNFEAAHNNNNNSSGNRFQLVFDSTPFDMASFDYRDDMSMPGVVGTMDGMQQKQQDVSIWF

SEQ ID NO: 21057 - protein, 806 aa, Bacillus licheniformis
MKKKQLVLVGNGMAGVRAIEEILKISNEEFQITIFGSEPHPNYNRILLSKVLQGDTDVKDITLNDWDWYEENGIQLYTGEEVVKVDPESKTVITDTGRVQPYDELILATGSLPFILPLPGADKEGVTAFRDIKDTDIMLEASKTYKKAAVIGGGLLGLEAARGLLNLGMDVTVVHLAPYLMERQLDAAAGRLLQKELEKQGMKFLLEKQTEEIYGETRVEGLKFKDGSTLEADLVVMAVGIKPNVQLGKDCGLPVNRGIVVNDYMETEVPNIYAVGECAEHRGIAYGLVAPLYEQAKVLAKKICGVETAPYEGSVLSTQLKVSGVEVFSAGDFNEDDGEDKKALKVFDEQDGIYKKIVLRGNQVIGAVLFGDSSEGNRLFSMIQKGADISDTSKISILQPLNQEEGMSLTAAMSDDEIVCGCNGVSKGMIIQAIKEQGCTSTDEIKACTGASRSCGGCKPLVAEILQHTLGSEFDASAQKEAICGCTDLSRDELVAEIREKGLTHTKEVMNVLGWKTAEGCSKCRPALNYYLGMINPKEYEDERESRFVNERMHANIQKDGTYSVVPRMYGGVTNSNDLRRIADVVDKYEIPLVKMTGGQRIDLIGVKKEDLPKVWADLDMPSGFAYGKTLRTVKTCVGEQFCRFGTQDSMALGIDLEKKFEGLYTPHKIKMAVSACPRNCAESGIKDIGVVGIDGGWEIYVGGNGGTHLRAGDLLMKVKTAEEVIEITGAYLQYYRETANYLERTSAWIERVGLSHVQSVLNDKEKRKELNDRINQALSVHKDPWKDFLEDGKTTRQLFENVVTS

SEQ ID NO: 21058 - protein, 555 aa, Oryza sativa
  misc_feature (114)..(115): Xaa can be any naturally occurring amino acid
NMLFFTRRRRVVDDGVDFRQIDTEWDWDNMVIMQTLIAAVLVTSRVFPATSDLSAWDLRGWAIAVVLHVAVSEPAFYWAHRALHLGPLFSRYHSLHHSFQATQALTAGFVTPLXXLILTLVAWPHLQGLHGGTRLRELVYGHISSSTTPVHGVQQRRGHLTQDFQDFPFLRYLIYTPSYLSLHHREKDSNFCLFMPLFDALGGTLNPKSWQLQKEVDLGKNHRVPDFVFLVHVVDVVSSMHVPFAFRACSSLPFATHLVLLPLWPIAFGFMLLQWFCSKTFTVSFYKLRGFLHQTWSVPRYGFQYFIPSAKKGINEMIELAILRADKMGVKVLSLAALNKNEALNGGGTLFVRKHPDLRVRVVHGNTLTAAVILNEIPGDVAEVFLTGATSKLGRAIALYFCRKKIRVLMLTLSTERFMNIQREAPAEFQQYLVQVTKYQAAQNCKTWIVGKWLSPREQRWAPAGTHFHQFVVPPIIGFRRDCTYGKLAAMRLPEDVEGLGTCEYTMGRGVVHACHAGGVVHFLEGWDHHEVGAIDVDRIDAVWNAALRHGLTPA

SEQ ID NO: 21059 - protein, 486 aa, Bacillus licheniformis
MGNGKVYFVGAGPGDSGLITLKGRTLIEAADVILYDRLVNSRLLEHAKASCEFVYCGKLPDRHYMRQSEINALLIEKGLKGLKVVRLKGGDPSVFGRVGEEAAAVSEHGIPYEMVPGITSGIAAPLYAGLPVTHRDFASSFAVVTAHDKSGKPEMNWEGLAKGVQTLVFYMGIKNLGYICEQLMKHGKSPLVPAMAIQWGTWGRQRSVKGTLQNIREKITEHQIKNPAIIVIGDIVSFRQNSWFEEKPLIGLNIMAVKSCEEEQIPVEALREQGAEVVEWPKWKSAETVPDDALLGRIACFDSLLFTSSASLRRFFSRLAALKIDVREMRGRLYASDQHVKAALEERGFEAFLQTEMPVSGSCLLIGSREAVQNYPHSGCEVLITHDRVIDSRFTSIIKREIDEFPIDIVLFSNRTCVELFVNEAETVGLHPEKTAARLQAFCLTEEAGERAAAVGFQRVHAVNDRDRLPDVIKEINRTAEFVCQS

SEQ ID NO: 21060 - protein, 216 aa, Oryza sativa
  misc_feature (59)..(59): Xaa can be any naturally occurring amino acid
  misc_feature (192)..(192): Xaa can be any naturally occurring amino acid
MAGVSGRRARSVRASLFSPKPATPKDARPAKVQEMFVYEINERDRAEDEEEARGLLGSXTLLVKGTEIAEGVLRLLGLWFLQLYSGSLDKRLGISAGICILIQHVPERNGDRYEAIYSFYFGDYGHISVQGPYLTYEESYLAVTGGSGVFEGAYGQVKLNQIVFPFKIFYSFYLKGIPDLPRELLCTPVPPXSPTVEPTPDAKATETHAWLNNFIN

SEQ ID NO: 21061 - protein, 256 aa, Elymus glaucus
ELDNIMRLMGITGIVNGMDVSEWDPTKDKFLAVNYDVTTALEGKALNKEALQAEVGLPVDRKVPLVAFIGRLEEQKGPDVMIAAIPEIVKDEDVQIVLLGTGKKKFERLLKSVEEKFPGKVRAVVRFNAPLAHQMMAGADVLAVTSRFEPCGLIQLQGMRYGTPCACASTGGLVDTIVEGKTGFHMGRLSVDCNVVEPADVKKVATTLKRAIKVVGTPAYQEMVKNCMIQDLSWKGPAKNWEDVLLELGVEGSEPG

SEQ ID NO: 21062 - protein, 1218 aa, Oryza sativa
MDDDGETPMPSLELHKLPTLAGAAIPNPIARHPLYHPSPSFFISPTDVVLRDILFDASPASAAGERRRRHVAAYHRAGPRREVAFDPATVRAAIFTCGGLCPGTNTVVRELVVGLSELYGVRGGVFGVRNGYRGFYSDEVVPLDPAAVEHWHKAGGAALGTSRGGFDLARIVDAIERHGFNQVYAVGGDGTMRGAARIHREVRRRGRLAVAVAGIPKTVDNDVGVVDRSFGFHTAVEAAQQAIAAGHVEAESAANGVGLVKLMGRSAGHIALHATLSSRDVDCCLIPEEDFYLRGAGGLFDFLYRRIKDNGHAVVVVAEGAGQRLIPRTTTTSASGACAGADESGNETFLDVGAWLKAEMRAWWEEEHAGEVFTVKYIDPTYMIRAVPANAGDNLYCTLLAHAAIHGAMAGYTGFVSGTINGNYAYIPMDEVAEAKNPVDTKDHKWAWSFVVYLGGHSHGRGGAALASSQERAKNSHHEFLGSFLGSKEKARDAIFYSYTKYITGSPATLEEEEAMEISKHPSVISVFPNRGHRLHTTRSWEFLGMEKDGRIRANSIWAKARFGEGVIIGNLDTGVWPEAGSFSDDGMGPAPVRWRGICQDQASDDAQVPCNRKLIGARYFNKGYLSTVGQAANPASTRDTDGHGTHTLSTAAGRFVPGANLFGYGNGTAKGGAPGAHVAAYKVCWRPVNGSECFDADIIAAFDAAIHDGVDVLSVSLGGAPAGYLRDGVAIGSFHAVRRGVTVVCSAGNSGPGAGTVSNTAPWLVTVGASTMDREFPAYLVLGNNKKIKGQSLSPVRLAGGKNYPLISSEQARAANATASQARLCMEGSLERGKVEGRIVVCMRGKNARVEKGEAVRRAGGAGLVLANDEATGNEMIADAHVLPATHVTYSDGVALLAYLNSTRSPSGFITVPDTALDTKPAPFMAAFSSQGPNTVTTQILKPDITAPGVSILAAFTGQAGPTGLAFDSRRVLFNAESGTSMSCPHVAGVAGLLKALHPDWSPAAIKSAIMTTARVKDNMRRPMSNSSFLRATPFSYGAGHVQPGRAADPGLVYDMNDTDYLGFLCALGYNSSVIATFMASGSGAQPPYACPPARRPEDLNYPSFALPHLSPSGAARTVTRRVRNVGAAPAAYVASVAEPRGVSVAVRPSRLEFTAAGEELEFAVTFRAKKGSFLAGEYEFGRLVWSDAAAGGRHRVRSPLVVRVVDKKGKNGLPIS

SEQ ID NO: 21063 - protein, 546 aa, Bacillus licheniformis
MKSSVVSAWDMLWRSHREAKRLLLFAMPVRAGKDAGLKINSEQTMKEEKPPSYKTPQKIGLLLGPALFFAVLLFFFPEGLSYEGRMVLATTLWVAVWWITEAVPIPAASLLPIVLLPLTGALEGAAVTSSYGDPIVFLFLGGFLIALAMERWNLHKRIALNIISVVGTSTSRIVLGFMAATGFLSMWVSNTAAVMMMLPIGTAIIHQVSAVIKSERKDLAAEEAKFSKALIFSIGYAGTIGGLGTLIGTPPNIILAANIKKLYGVEVSFGGWMAFAVPVVVILLVAVWLYLTKVAHPIKMKELPGGKELILEEKRKLGKMSFEETMVLLVFGFAAFMWVTRTFLWDDKIPGIDDTMIAIFAASLLFLIPSLNKGGRVLDWSVSKDLPWGILLLFGGGLALATGFKETGLAEWIGGRLTVLDGFNFVVIVIISTALVLFLTEITSNTATATMILPVLASLALALNVHPYALMVPAAMAANCAFMLPVGTPPNAIIFASGKLKISEMVRTGFVINIFTLILIVGAVFYILPHLWGVDLTVFPDNLKSN

SEQ ID NO: 21064 - protein, 257 aa, Elymus glaucus
CELDNIMRLTGITGIVNGMDVSEWDPTKDKFLAVNYDVTTALEGKALNKEALQAEVGLPVDRKVPLVAFIGRLEEQKGPDVMIAAIPEIVKDEDVQIVLLGTGKKKFERLLKSVEEKFPGKVRAVVRFNAPLAHQMMAGADVLAVTSRFEPCGLIQLQGMRYGTPCACASTGGLVDTIVEGKTGFHMGRLSVDCNVVEPADVKKVATTLKRAIKVVGTPAYQEMVKNCMIQDLSWKGPAKNWEDVLLELGVEGSEPG

SEQ ID NO: 21065 - protein, 416 aa, Helicobacter hepaticus
MDYSIKEQDFEVFELIEKELERQNEHLEMIASENFTFPSVMEAMGSILTNKYAEGYPFKRYYGGCEFVDKIEEIAIERAKKLFGANFVNVQPHSGSQANAAVYAAILKPYDKILGMDLSHGGHLTHGAKVSTSGQLYQSFFYGVELNGRIDYDKLALQAQVVKPNVLVCGFSAYTRELDFKRLREIADSVGAYLMGDIAHVAGLVVAGEYPNPFPHCHIVTTTTHKTLRGPRGGAILTNDEELYAKINKAVFPGIQGGPLMHIIAGKAVGFKENLKPEWKIYAKQVKSNIQALAEVLIKRNYELVSGGSDNHLILMSFLNKDFSGKDADLALGNAGITVNKNTIPGEIRSPFITSGIRIGSPALTARGMKEKEFEWIGEKIADILDDINNTNLQEHIKAQVKNFSRDFRIYDRPIF

SEQ ID NO: 21066 - protein, 539 aa, Unknown
  Polaromonas sp. JS666
MTLATQDSHPTQTDYDAVVVGAGFGGLYMLHKLRNELGMNVRVFDKAGDVGGTWYWNRYPGALSDTESFVYCYSFDKALLQEWQWDTRYVTQPQILSYLNHVADRLDLRRDIEFNTGVTGARFDEKRNLWEIQTDTDKTVTARYLITALGLLSATNVPNIKGIETFQGAQYHTGAWPEGVDFKGKRVGVIGTGSTGLQVITALAPQASHLTVFQRSPQYSVPVGNGPVSPDYVKSVKQNYEQIWKDVRSSVVAFGFKESSVPAMSVSEEERRAVYQKAWDTGGGFRFMFETFCDIATSEEANETAAAFIRGKIAEIVKDPETARKLTPTDLYAKRPLCDSGYYAIYNRDNVALVDVKATPITEITPRGIKTSDGVEHELDVLIFATGFDAVDGNYTKIDLRGRNGKTIKDKWKAGPTSYLGVASADYPNLFMILGPNGPFTNLPPSIETQVEWISDLIKHMNDTGRQLVEATHEGEDGWTATCNEIAGYTLFPKADSWIFGANIPGKARTVMFYLAGLGAYTQKLNEVTSTGYPGFEIR

SEQ ID NO: 21067 - protein, 546 aa, Prosthecochloris aestuarii
MKILMLQPNYHSGGAEIAGNWTPSWVAYIGGALKKVGFTQIRFVDAMADDLPDETIEEIIRTNEPDVVLTTNITPSIFKAQDIMKLAKKVNPKIRTIMGGIHSTFMYPQVLSEAPETDYVIRGEGEEIAVNLIKAIAAGTDLQDRENITGIAYINEEGKVHATPAHPVIEDLDDLTPDWSLYDWDKYIYTPLNCRLAVPNFARGCPFTCTFCSQWQFWRRYRARSPKHFVDEIEILVKKYDVGFFILADEEPTINKQKFVSLCQELIDRDLGVTWGINTRVTDIMRDEDLLPFYRKAGLVHVSLGTEAASQMNLNRFRKETTIEENKYAIKLLQKNGIVAEAQFVMGLEHETPQTIEETYQLCKDWDPDMANWTIYTPWPFSDLFKELGDRVEVRDYSRYNFVSPIIKPDNMEREDVLKGVLKSYGRFYARKTFFSYPWIKDPYVRKYMLGCLKAFAQTTLTKRFYDIDRVSTKNRKIEIDLGFDKSRILTQAEVKNLKELRPEMVADMSFGLKEAGYQREHDEHDWGEFDESTIKDRNSSTVRNC

SEQ ID NO: 21068 - protein, 586 aa, Ashbya gossypii
MVSGLSKKKTTAKQLSKLTINTMSEITLGRYLFERLRQIEVQTIFGLPGDFNLSLLDKIYEVEGMRWAGNANELNAAYAADGYARLKGMSCLITTFGVGELSALNGIAGSYAEHVGVLHVVGVPSISAQAKQLLLHHTLGNGDFTVFHRMSANISGTTAMISDITSAPAEIDRCIRTCYITQRPVYLGLPANMVDLKVPASLLETPIDLNLKPNDPEAEAEVVETVLEMIAAAKNPVILSDACASRHDVKAETMKLIDVTQFPAFVTPMGKGSIYEQHPRFGGVYVGTLSSPEVKEAVESADLVLSVGALLSDFNTGSFSYSYKTKNVVEFHSDHIKIRNATFPGVQMKYVLRKLVDNVAEVIKSYVPVPVPSKPANNEEIDSATPLKQEWLWNQVGKFLREGDVVITETGTSAFGINQTHFPNNTYGISQVLWGSIGFTTGACLGAAFAAEELDPNRRVILFIGDGSLQLTVQEISTMVRWGLKPYLFVLNNDGYTIERLIHGETAQYNDIQPWQHLNLLPTFGAKDYEAVRVSTTGEWDALTQDKAFNENSKIRMIEVMLPVMDAPSNLVKQAELTAATNAKQE

SEQ ID NO: 21069 - protein, 256 aa, Elymus hystrix
ELDNIMRLTGITGIVNGMDVSEWDPTKDKFLAVNYDVTTALEGKALNKEALQAEVGLPVDRKVPLVAFIGRLEEQKGPDVMIAATPEIVKDEDVQIVLLGTGKKKFERLLKSVEEKFPGKVRAVVRFNAPLAHQMMAGADVLAVTSRFEPCGLIQLQGMRYGTPCACASTGGLVDTIVEGKTGFHMGRLSVDCNVVEPADVKKVATTLKRAIKVVGTPAYQEMVKNCMIQDLSWKGPAKNWEDVLLELGVEGSEPG

SEQ ID NO: 21070 - protein, 363 aa, Triticum aestivum
  misc_feature (76)..(76): Xaa can be any naturally occurring amino acid
  misc_feature (357)..(357): Xaa can be any naturally occurring amino acid
MAAILRCCLLLALVAGLLLGNAAALPHHGPAKHDYRDALTKSILFFEGQRSGRLPPSQRVSWRRSSGLSDGSSVKXDLTGGYYDAGDNVKFGFPLAFSSTMLAWSVLEFGGMMKGELQHARDAVRWGADYLLKATAHPDTVYVQVGDAGKDHACWERPEDMDTPRTVYKVDPSTPGSDVAAETAAALAAASLVFRKSDPAYSSRLVARAKRVFEFADKHRGVYSAKLSSYVCPYYCSCSGYQDELLWGAAWLHRATKSPVYLSYIKVNGQLLGADEQDNTFGWDNKHAGARILLSKSFLVQKLGALQEYKAHADSFICSMVPGTPTDQTTYTRGGLLFKLSDSNMQYVTSSSFLLLXYAKYLV

SEQ ID NO: 21071 - protein, 785 aa, Zea mays
MTKILLLLLLLALPLPAALALTAEGLALLTFKAAATDDPHSALSRWSESDQDPCRWPGVICANASSSAPSAAPRVVGLAVAGKNISGYIPSELGSLLFLRRLNLHGNRLSGVIPAALSNASSLHSLYLYGNRLTGGLPVALCDLPHLQNLDVSGNALSGELPLDLRGCRSLQRLVLARNAFTGELPAGVWPEMPNLQQLDLSSNAFNGSIPPDLGELPRLAGTLNLSHNHFSGVVPPELGRLAATVTLDLRFNNLSGAIPQTGSLASQGPTAFLNNPGLCGYPLQVPCRAVPPPTESPTPPATTTPLPSTASSDQHQPIRTGLIALISVADAAGVALVGVILVYMYWKVKDRKGRRDGGGDDSSKSGLCRCMLWRHGGSDSSDASSGDGDGEGKYSGGEGELVAMDRGFRVELDELLRSSAYVLGKGGKGIVYKVVVANGTTPVAVRRLGGGGGGADRCKEFAAEARAVGRVRHPNVVRLRAYYWSADEKLVVTDFVGNGNLTTRAARFGGGANGTKGISFPCIHANEPLAWEIPYLARRPGQTVLSWSARLKIAKGAARGLAYLHESSPRRFVHGEVKPSNILLDADFTAHVADFGLARLLAVAGCAPDGPPSTGGAGLLGGAIPYVKPPAPGTGPDRFGAGGGYRAPEARAPGAKPTQKWDVFSFGVVLLELLTGRGPAADHASPSTSASFSAPVSGSTATDRSGSGEHGGGAVPEVVRWVRRGFEEDVRPLAEMVDPALLRGPALPKKEVVAAFHVALQCTESDPELRPRMKAVADSLEKIG

SEQ ID NO: 21072 - protein, 243 aa, Ralstonia metallidurans
MDAMTTLQRWTRPTALKLASLAVLMVAAAMWELPAISAEAAVKIPAPAVDEKAGTSHTETAVFAGGCFWGVQGVFQHVRGVTRVTSGYSGGSASNAQYEMVGTGMTGHAESVEIRYDPTQISYGKLLQIFFSVAHNPTQLNYQGPDHGTQYRSAIFPRSPVQRSIAEAYITQLDTSKAYRAPIVTRVEDYKGFFPAENYHQDFLVKNPSYPYIVINDLPKIGNLKTMFPDVYRNDAVLVSKGG

SEQ ID NO: 21073 - protein, 448 aa, Enterococcus faecalis
MDAKQYVKNIQEKIHQLDQGQTEYLQAVDEFLPTVEGFLEKNPQYIEANVLGVLIEPERIFQFRVPWQDDQGNWHVNRGYRVQYNSAIGPYKGGLRFHPSVNLSVMKFLAFEQIFKNSLTGLPIGGGKGGSDFDPKGKSDAEVMRFCQSFMTELQKHIGPSTDVPAGDIGVGAREIGYLFGMYKRLRNYDAGVLTGKPLGYWGSQARTEATGYGTVYFVKHLLADKNDTFEGKKVAVSGSGNVAIYAMEKATELGATVITCSDSSGFVYDPEGIDVALVKELKEKNRERISKYVETRKGATYYDKESVWNFETAYDIALPCATQNEINEKQAAILVKNGVKVVAEGANMPCTLEAVAVFAKSAVIYCPGKAANAGGVAVSALEMSQNAERLAWSFEKVDGMLDQIMQNIYETCRDTANEYQARDNFVLGANIAGFEKVAAAMLSQGLV

SEQ ID NO: 21074 - protein, 422 aa, Streptomyces coelicolor
MTSQPTLTKPEEGPAGPSGPDTGLQAGLKNRHLSMIAIGGVIGAGLFVGSSSGIATAGPGILLSYALVGTLVVLVMRMLGEMSAANPTSGSFSAHADRALGPWAGFSIGWLYWFFWVVVLAVEATAGAKILEGWIPAVPQWGWALIVMVVLTATNLASVGSYGEFEFWFAGIKVVAIAAFIVVGGLAVFGVLPGVDSDRAGLGNLTEHGGFLPHGAGAVLTGVLLVVFSFMGSEIPTLAAGESEDPQRAVTKATNSIIWRIAVFYLGSIFVVVALLPWDSQSIVDQGSYVAALDSLGIPNAGEIMNFIVLTSVLSCLNSGLYTASRMAFSLGRRGDAPKAFARTTRRGVPQAAILSSVVFGFVAVFFNYKFPDTVFLFLLNSSGAVASSSGWPSASRSCGCGRSSRPRRRRSWSCGCGCTRI

SEQ ID NO: 21075 - protein, 470 aa, Listeria monocytogenes
MHNLKLSEEIKRAINELGYTEATPVQKAVIPVALTGEDIVAKSQTGSGKTAAFAIPIAEQVEWEENKPQALIIVPTRELAMQVKTECTNIGRFKRVKAAAIYGQSPFAKQKLELSQKNHIVVGTPGRLLDHIEKGSLNVDKVAHLVLDEVDEMLSMGFIDQVEDILSRLPKQRQNLFFSATMPEEMQGLIKRYQDDPMVIEMASEKTNPILHVEIQTDNKEKTLKDVLITENPDSAIIFCNTKNQVDELTDLLDVKASKIHGGLRQEDRFRAMDDFKSGKSRFLIATDVAGRGIDVDNVSLVINYDLPIEKENYVHRIGRTGRAGKSGKAISFVKTNENPLLRDIEEMLDVTIEKKRKPTVIEVKANEDAFRKKQQKRPTIKKARGEKLNKNIMKLYFNGGKKKKIRAVDFVGTISKLEGITAEDIGIITIEDHVSFVEILNGKGPAVLEMMRSRKVKGRRLKVNEARKR

SEQ ID NO: 21076 - protein, 461 aa, Streptomyces coelicolor
MSNSTTAKAPRQPADASLSHGLKQRHLSMIALGGVIGAGLFVGSGAGIAAAGPSIVVAYTVSGLLVMLVMRMLGEMSAAYPSSGSFSAHAERAIGPWAGFTAGWAFWVLLCTAVGLEGIGAAQIVHGWLPGTPEWAWVALFMVVFCGTNLAAVKNFGEFEFWFAALKVGAISLFLVLGVLAICGVLPGTDSPGTSHLGDFLPHGGNGLIIGLLASVFAYGGLETVTIAAAESENPVRGVASAVRTAMWRIALFYIGSMAVIVTLVPWDSPEVVEKGPYVAALDELGIPGAGQLMNIVVLVALLSAMNANIYGASRIGYSLVERGQGPKVLGRVSGGVPRVAVLVSSLFGFGCVLLSYWRPDDVFSWLLNMIGAVILVVWIFIAAAQLRLRRRLEREAPEKLVVRMWAFPWLTWVALAGMAAVFVLMAREPDTRVQLYSTGGMTLVLAAVGYARQRRGAARD

SEQ ID NO: 21077 - protein, 475 aa, Oryza sativa
MAGSGRPPAAQKKILQSLRPPLPFAASSRSPFAAPNDYHRFPAGGAAAAAASGSGGIGAGGAGGGGDIEEGLVIRTPQKRKAPEESDVAESSDCMITSPGFAVSPMLTPVSGKAVKTSKSKTKNNKAGPQTPTSNVGSPLNPPTPVGTCRYDSSLGLLTKKFINLLKQAPDGILDLNNAAETLEVQKRRIYDITNVLEGIGLIEKTLKNRIRWKGLDDSGVELDNGLSALQAEVENLSLKEQALDERISDMREKLRGLTEDENNQRWLYVTEDDIKGLPCFQNETLIAIKAPHGTTLEVPDPDEAGDYLQRRYRIVLRSTMGPIDVYLVSQFDEKFEDLGGGATPSGHANVPKHQPTEVFNTTNAGVGQCSNSVAVDNNIQHSQTIPQDPSASHDFGGMTRIIPSDIDTDADYWLISEGDVSITDMWKTAPDVQWDESLDTDVFLSEDVRTPSSHNQQPSAVGGPQMQVSDMHKP

SEQ ID NO: 21078 - protein, 255 aa, Escherichia coli
MFNSDNLRLDGKCAIITGAGAGIGKEIAITFATAGASVVVSDINADAANHVVDEIQQLGGQAFACRCDITSEQELSALADFAISKLGKVDILVNNAGGGGPKPFDMPMADFRRAYELNVFSFFHLSQLVAPEMEKNGGGVILTITSMAAENKNINMTSYASSKAAASHLVRNMAFDLGEKNIRVNGIAPGAILTDALKSVITPEIEQKMLQHTPIRRLGQPQDIANAALFLCSPAASWVSGQILTVSGGGVQELN

SEQ ID NO: 21079 - protein, 485 aa, Wolbachia endosymbiont
MVDIGLKSDGRILIKELGCNDEVIIGSKIRVYVERIEDYHGNVVLSREKAIRDEKWNKLEEDTVTRAEVSGVIKRSIKCGFIVDLGDGISAFLPLSHVDLKQVKDAKHLIETEQKFIVLKMDKKQGNIVVSRKLVLEKLHAGEKIKFLESLNEGDIIEGKIKSITHYGVFVGIHESDVVGVIDGLLHITDISWSRVSHPSAVFTCGQTIKVKIIKIDKENAKISLGVKQLEDSPWQDAESKYPVDSVHKGYVTSIEDYGLFVELRPGIEGLVHSSEITWVKSNLPVSSLVTRGQEVYVKILSIDIAKSRMSLSMKRCVDNPWQVFINKYPPGSIVSGEVKNNTGSYVSVAFGDSEIDENVEGTIYVKDFSWSKNGSDEIKKYNVGDKIEAKVIRANVNRARIYLGIKQIEYDPLEELIKKVKVGDKIQVIVGKREDNGLVVEVENDVTLLIDQEHLPENKKFSISEKIEVEVLGVEEYNIALSAK

SEQ ID NO: 21080 - protein, 300 aa, Mycobacterium smegmatis
MMTTLAAVSANFTRDLEQNFALIADLAEQAREKGVDFLVLPEAAIGGYLSSLGNHGDTVRATSRSLPPAIRLDGPEIARVQQIVGDLVVAIGFCELADDGETRYNAAAVLDRFDVYGSYRKVHQPLGEGMSYSAGSDYGVFDTPVGRVGLQICYDKAFPEAARLMALGGAQIIASLSAWPAARTATAQNLQDDRWTYRFNLFDMARALDNQVFWVASNQSGSFGSLRYVGNAKVVDPGGNVLATTLLDSGMAVAEVDIDETFRTMRAGMFHLRDRRPDVYAPLTDSDGPRTAKWRELAHA

SEQ ID NO: 21081 - protein, 430 aa, Arabidopsis thaliana
MSKAWKLKLLLLLQLLLLSQHDVDSASVISYLPGFEGLLPFHLETGYIGVGEGEKVQLFYYFIKSENNPEEDPLIIWLTGGPACTALSALAFEIGPLTFKTEGYNGGLPSLVSTSYSWTKVASIIFLDQPVGTGYSYSTTPLSYKPSDTGEAKQTYEFLQKWLVENPQFVSNPIYVGGDSYAGIVVPAIVQQISIGNEHGYKPQINLKGYILGNPSTDLDSDHNSKIPYAHRMGLISDELYESLKRTCQGNYVKVDPTNTKCLKLMEDYGKTLVQSDLSLPTPDCYMYRYLLASHWANDEDVRRELHVVKGSIGKWMRCNWDLPYEKDIKSSVPYHRNNSIIGDYRSLVYSSDHDMMVPYIGTEAWIKSLNYSITDDWRPWFVNNQVIGYTRTYANNMTFATIKGGGHTAEYKPEESFMMFQRWISGRPL

SEQ ID NO: 21082 - protein, 95 aa, Oxalis cf.
LYAGINISGTNGEVMPGQWEYQVGPSVGIEAGDHIWASRYILEGITEQAGVVLTLDPKPIDGDWNGAGCHTNYSTKSMRDEGGFEVIKKAILNLS

SEQ ID NO: 21083 - protein, 448 aa, Streptococcus thermophilus
MSKQLVSIIDVPKHIGEEITIGAWVANKSGKGKIAFLQLRDGTAFFQGVAFKPNFIEKFGEEEGLEKFDTIKHLSQETSIYVTGMVKEDERSKFGYELDINDIEVIGKSQDYPITPKEHGTDFLMDNRHLWLRSRKQMAIQQIRNAIIYATYDFFDKNGFIKFDSPILSSNAAEDSTELFETDYFGTPAFLSQSGQLYLEAGAMALGRVFDFGPVFRAEKSKTRRHLTEFWMMDAEYSFLSHDESLDLQEAYVKALIQGAIDRAPQALEILERDVDLLKKYIAEPFKRVSYDEAIDLLQAHENDEDTDYEHLEHGDDFGSPHETWISNYFGVPTFVVNYPASFKAFYMKPVPGNPERVLCADLLAPEGYGEIIGGSMREDDYDALVAKMEELGMDRSEYEFYLDLRKYGSVPHGGFGIGIERMVTFVAGTKHIREAIPFPRMLHRIKP

SEQ ID NO: 21084 - protein, 831 aa, Streptomyces coelicolor
MKAVVMAGGEGTRLRPMTSSMPKPLLPVVNRPIMEHVLRLLKRHGLNETVVTVQFLASLVKNYFGDGEELGMELTYANEEKPLGTAGSVKNAEEALKDDAFLVISGDALTDFDLTDLINFHKEKGSLVTVCLTRVPNPLEFGITIVDEEGKVERFLEKPTWGQVFSDTVNTGIYVMEPEVFNYVDPDVPVDWSGDVFPQLMKEGKPIYGYVAEGYWEDVGTHESYVKAQADVLERKVDVDIDGFEISPGVWVAEGAEVHPDAVLRGPLYVGDYAKVEAGAEIREHTVIGSNVVVKSGAFLHKAVVADNVYVGPHSNLRGCVVGKNTDIMRAARIEDGAVIGDECLVGEESIIQGNVRVYPFKTIEAGAFVNTSVIWESRGQAHLFGARGVSGILNVEITPELAVRLAGAYATTLKKGSTVTTARDHSRGARALKRAVISALQASAIDVRDLENVPLPVARQQTARGSAGGIMIRTTLGVPDSVDIMFFDGQGADLSQGSQRKLDRVFARQEYRRAFPGEIGDLHFPSSVFDSYTGSLLRNVDITGIAESGLKVVVDASNGSAGLVLPSLLGKLGVDSLTINPGLDEARPTESADMRRSGLVRLGEIVASSRAAFGVRFDPVGERLSLVDEKGRIIEDDRALLVMLDLIAAERRSGRVALPVTTTRIAEQVAAYHGTQVEWTTTSPDDLTRVGGEEGAIFGGDGKGGFIVPEFSSVYDGTAAFVRLIGLVARTQLTLSQIDARIPRAHVLKRDLATPWAVKGLVMRRVVEAAGDRFVDTTDGVRVVETDGRWVMVLPDPAEAVTHLWAEGPDDASAQALLDEWAAVVDSAGR

SEQ ID NO: 21085 - protein, 275 aa, Prochlorococcus marinus
MTDFLVAALQITSTSNVEANFIEAEEQIELAARRGAELIGLPENFAFLGGDDEKLRLASELSEKCANLLKTMSQRYQVFLLGGGYPVPAGDDSHTFNRSALFGKDGQVLAKYDKIHLFDVDLPDGNLYKESSTILSGKEYPPVVDIPGLCKIGLSICYDVRFPELYRYLSSNGAELIMIPAAFTAFTGKDHWQILLQARAIENTAYVVAPAQTGIHYGRRQSHGHAMVIDPWGTVLSDAGKTQGAAIAPADKERVKKIREQMPSLKHRKNKLFSK

SEQ ID NO: 21086 - protein, 379 aa, Salmonella enterica
MAKRDYYEILGVSKTAEEREIKKAYKRLAMKYHPDRNQGDKEAEAKFKEIKEAYEVLTDAQKRAAYDQYGHAAFEQGGMGGGFGGGFNGGADFSDIFGDVFGDIFGGGRGRQRAARGADLRYNMDLTLEEAVRGVTKEIRIPTLEECDVCHGSGAKAGTQPQTCPTCHGSGQVQMRQGFFAVQQTCPHCQGRGTLIKDPCHKCHGHGRVEKSKTLSVKIPAGVDTGDRIRLAGEGEAGEHGAPAGDLYVQVQVKQHPIFEREGNNLYCEVPINFAMAALGGEIEVPTLDGRVMLKVPSETQTGKLFRMRGKGVKSVRGGAQGDLLCRVVVETPVGLSEKQKQLLKDLQESFGGPTGEKNSPRSKSFFDGVKKFFDDLTR

SEQ ID NO: 21087 - protein, 257 aa, Elymus lanceolatus
CELDNIMRLTGITGIINGMDVSEWDPTKDKFLTVNYNVTTALEGKALNKEALQAEVGLPVDRKVPLVAFIGRLEEQKGPDVMIAAIPEIVKDEDVQIVLLGTGKKKFERLLKSVEEKFPGKVRAVVRFNAPLAHQMMAGADVLAVTSRFEPCGLIQLQGMRYGTPCACASTGGLVDTIVEGKTGFHMGRLSVDCNVVEPADVKKVATTLKRAIKVVGTPAYQEMVKNCMIQDLSWKGPAKNWEDVLLELGVEGSEPG

SEQ ID NO: 21088 - protein, 301 aa, Dehalococcoides ethenogenes
MVAKVIVNPVAGAKSTEQKWPHISRLMCDMGFSYDFQYTESQGHAIEIARDAALNGYPYLVAVGGDGTINEVVNGILTASHDQKTLMGVVDTGTGNDFVRSLGLDGNYLHSCQHLLSPKHTLVDAGLVTFQKDGRQVSRFFVNGAGVGFDAEVAATTEHMPKALGGTIPFVMALAKTLLGYRNKTVDIGLDEDNYTRRVLSVIVANGSYFGGGMKVAPSALITDSRFDVITLGDVNKLEILQTFPKIYKGTHITHPKVKTEHARFVSISSEEGLYLQADGELLGKTPATFEVLPQALTMVF

SEQ ID NO: 21089 - protein, 178 aa, Glycine max
  misc_feature (62)..(62): Xaa can be any naturally occurring amino acid
  misc_feature (75)..(75): Xaa can be any naturally occurring amino acid
  misc_feature (122)..(122): Xaa can be any naturally occurring amino acid
  misc_feature (125)..(125): Xaa can be any naturally occurring amino acid
MASSMISSPAVTTVNRAGADMVAPFTDLKSMAGFPDQKTNNDITSIASNGGRVQCMQVWPPXGKKKFETLSYLPXLNNTQLAKEVEYLLRKGWIPCLKFKLKHGFIYQEHNKSPKYYNGHYXTMXKLPMFDCTDASQVLKELQEAKTAYPNNFIHIIKFHNIHQMQYISFITYEPPSF

SEQ ID NO: 21090 - protein, 658 aa, Pseudomonas syringae
MCGITGFFGVKNKNLDETTVIKNMLSMIEHRGPDQAGYYVNNSMGLGTMRLSIIDLAAGIQPLSDGTGQYWISYNGELYNYIELRRRLQVLGHHFSTESDTEVVLRSWMEWGDEALEKFNGAFAFAIYDTVKDEVFIARDRFGKRPLFYTQTDGGYLFASEMKCFFGFPGFEFKFDEMSLSSILAHWTPLPSQTPFQGIRQLPPGSIMTLRGAQCEIRPYYALDFRAVDFDGTENEAKEEIRNTLEQAVKLRLRSDVPMGLYLSGGVDSSVLTSIAARIIKQKPLRTFSVEFEDKNLDESSDQQLVSALFSTKHERLIINHKDIVDNFSATVFHAEMPLFRTAPVPMYMLSKHVRSTGIKAILSGEGADEVFLGYNIFKETLLRSQWDTTDHDEKKRLLAKLYPYMKSFSEDNDSNLMGFYNAYAKEKIPGLFSHEIRFQNGRFASRLLKTKNDPFAGIQAWVAKDPVYSALSPTQKAQWLEFNTLLSGYLLSSQGERMGLAHGIENRCPFLDINVQKLASSINLRFDDGFTEKYMLRMAYDGILPGRIIHKAKTPYRAPDSGPFVEHALDYLNHLCESNALDAIELINPVFAKALIKKVVERTLAGGEDITVRDNQAFVYLMSLIELDKWFVKRQGAAYINPCRVDKLLVQAVDARH

SEQ ID NO: 21091 - protein, 185 aa, Pseudomonas syringae
MSADLEHIRQIMREADCLYTEAEVDAAIARVGAQINAELAERNPVVFCVMNGGLIFSGKLLTHLNFPLEASYLHATRYRNETTGGDLFWKAKPEVSFIDRDVLIIDDILDEGHTLGAIIDFCKHAGARAVHTAVLIDKDHDRKARPDLKADYVGLPCIDRYIFGFGMDYKGYWRNAAGIYAVKGM

SEQ ID NO: 21092 - protein, 257 aa, Elymus virginicus
CELDNIMRLTGITGIVNGMDVSEWDPTKDKFLAVNYDVTTALEGKALNKEALQAEVGLPVDRKVPLVAFIGRLEEQKGPDVMIAAIPEIVKDEDVQIVLLGTGKKKFERLLKSVEEKFPGKVGAVVRFNAPLAHQMMAGADVLAVTSRFEPCGLIQLQGMRYGTPCACASTGGLVDTIVEGKTGFHMGRLSVDCNVVEPADVKKVATTLKRAIKVVGTPAYQEMVKNCMIQDLSWKGPAKNWEDVLLELGVEGSEPG

SEQ ID NO: 21093 - protein, 603 aa, Hordeum vulgare
MAALATSQLATSGTVLGVTDRFRRPGFQGLRPRNPADAALGMRTIGASAAPKQSRKAHRGSRRCLSVVVSATGSGMNLVFVGAEMAPWSKTGGLGDVLGGLPPAMAANGHRVMVVSPRYDQYKDAWDTSVISEIKVADEYERVRFFHCYKRGVDRVFIDHPWFLEKVRGKTKEKIYGPDAGTDYEDNQQRFSLLCQAALEAPRILNLNNNPYFSGPYGEDVVFVCNDWHTGLLACYLKSNYQSNGIYRTAKVAFCIHNISYQGRFSFDDFAQLNLPDRFKSSFDFIDGYDKPVEGRKINWMKAGILQADKVLTVSPYYAEELISGEARGCELDNIMRLTGITGIVNGMDVSEWDPTKDKFLAVNYDITTALEAKALNKEALQAEVGLPVDRKVPLVAFIGRLEEQKGPDVMIAAIPEILKEEDVQIILLGTGKKKFEKLLKSMEEKFPGKVRAVVRFNAPLAHQMMAGADLLAVTSRFEPCGLIQLQGMRYGTPCVCASTGGLVDTIVEGKTGFHMGRLSVDCNVVEPADVKKVATTLKRAVKVVGTPAYQEMVKNCMIQDLSWKGPAKNWEDVLLELGVEGSEPGIVGEEIAPLAMENVAAP

SEQ ID NO: 21094 - protein, 72 aa, Pasteurella multocida
MAKEDCIEMQGTILETLPNTMFRVELENGHVVTAHISGKMRKNYIRILTGDKVTIEMTPYDLNKGRIIFRSR

SEQ ID NO: 21095 - protein, 446 aa, Unknown
  Frankia sp. EAN1pec
MPSVPPAPTPGPASGSGSSVSRPRLLARPTWPQARYVAGILRSETVGGLLLLAGAVVALVWANSPWRDAYATVVHTGVGPASLRLHLDLEHWAADGLLAIFFFVVGLELKREFVLGDLRSPSRAALPIVAALGGMLVPALIYTLVNGLAVDGSPEGWAVPTATDIAFAVAVLAIITTHLPAALRSFLLTLAVVDDLLAIVIIAVFFTDRLSPAPLAGSLAVIAVFALLVNRGVTRWWLLIPLALVAWALMHASGVHATIAGVLLGFAVPARPRSGEHAGMSERFEHAWRPVSAGVAVPLFALMAAGVSLAGGGVSAALADPAGLGVAMGLLLGKPIGVMGATGLLARLTRAELDPDLSWWDVAGVAVLAGVGFTVSLLIGELAFGAGTAENDHVKAAILIGSLASALLASIVLRARNRVYRRIEERETVDLDADGIPDVFQEPTVG

SEQ ID NO: 21096 - protein, 338 aa, Schizosaccharomyces pombe
MGLEQFKKYPLTFGPTPITSMKRLSKTLGGKVEIFAKREDCNSGLAFGGNKIRKLEYLIPEAIDGGYDTLVSIGGIQSNQTRQVAAVAAHLGLDCVLIQEDWVDYKDTMYDRVGNIELSRIVNADVRLDSSKFDIGIRPSFKNALEELTKKGKKPFPIPAGCSEHPYGGLGFVGCVEEIYEQEKQLGFKFDKIVVCTVTGSSFAGIIVGMALTGRQKDVIGIDASATPEKTKAQVLRIAQNTAKLIGLEKELTESDVNIDTRFAHPAYGIPNEGTIEAIKLCGATEGVLTDPVYEGKSMQGLIHLVRNNEIAEGSKVLYIHLGGAPALSAYSAYFKNT

SEQ ID NO: 21097 - protein, 213 aa, Arabidopsis thaliana
MTDPHTARTIVGIVGNVISFGLFCAPIPTMVKIWKMKSVSEFKPDPYVATVLNCMMWTFYGLPFVQPDSLLVITINGTGLFMELVYVTIFFVFATSPVRRKITIAMVIEVIFMAVVIFCTMYFLHTTKQRSMLIGILCIVFNVIMYAAPLTVMKLVIKTKSVKYMPFFLSLANFMNGVVWVIYACLKFDPYILVNPHIYLYCLELKSLHLKKD

SEQ ID NO: 21098 - protein, 605 aa, Zea mays
MAALATSQLVATRAGLGVPDASTFRRGAAQGLRGARASAAADTLSMRTSARAAPRHQQQARRGGRFPSLVVCASAGMNVVFVGAEMAPWSKTGGLGDVLGGLPPAMAANGHRVMVVSPRYDQYKDAWDTSVVSEIKMGDGYETVRFFHCYKRGVDRVFVDHPLFLERVWGKTEEKIYGPVAGTDYRDNQLRFSLLCQAALEAPRILSLNNNPYFSGPYGEDVVFVCNDWHTGPLSCYLKSNYQSHGIYRDAKTAFCIHNISYQGRFAFSDYPELNLPERFKSSFDFIDGYEKPVEGRKINWMKAGILEADRVLTVSPYYAEELISGIARGCELDNIMRLTGITGIVNGMDVSEWDPSRDKYIAVKYDVSTAVEAKALNKEALQAEVGLPVDRNIPLVAFIGRLEEQKGPDVMAAAIPQLMEMVEDVQIVLLGTGKKKFERMLMSAEEKFPGKVRAVVKFNAALAHHIMAGADVLAVTSRFEPCGLIQLQGMRYGTPCACASTGGLVDTIIEGKTGFHMGRLSVDCNVVEPADVKKVATTLQRAIKVVGTPAYEEMVRNCMIQDLSWKGPAKNWENVLLSLGVAGGEPGVEGEEIAPLAKENVAAP

SEQ ID NO: 21099 - protein, 399 aa, Candida glabrata
MSFNREHDLKLKFKSSKKLKISATFESMDLKEGLLRGIYSYGFEAPSAIQSRAITQIISGKDVIAQAQSGTGKTATFTIGMLQAIDLKKHDLQALVLSPTRELAAQIGKVVTNLGDYMNVKAYAMTGGKTMKDDLKKIQKHGCQVISGTPGRVLDMIKRRLIETRHVQILVLDEADELLSDTLGFKHQIYDIFTKLPRTSQVVVVSATMSPEILEITKKFMNDPVKILVKRDEITLEGIKQYYVNVEKEEWKFDTLCDIYDSLTITQCVIFCNSKKKVDWLAHKLKQSNFAVISMHGDMKQDERDRVMNEFRTGQSRVLISTDVWARGIDVQQVSLVINYDLPEITENYVHRIGRSGRFGRKGVAINFLTKIDASRMKEIEKYYKIKVKPMPADLSELS

SEQ ID NO: 21100 - protein, 166 aa, Triticum aestivum
MSGGGGGGVLGAGSSYQSFVRTALEQTRLRTALTPHPSQEKFRLIRANDDAAVLDALSFSTPKIRLLRSLTVEKKNSVQVLDFAAFSEPEYDLPIFCANAFTTPAQSIVVLDLNPLYDITEDKDYKDKYYRNLMPLIHKYSELLPWGGKITSESLRFFSPIVIWTI

SEQ ID NO: 21101 - protein, 419 aa, Arabidopsis thaliana
MGSLRRSTSNRSRKKGTAVKMNRMPSSLSPPTPPCSAIVGGTGKSKKRRGGVCLWTRFDRTGFMEVAGCDKSTIIERSSVSAKDLRTAFSHSSKILDNNKSMSCYDAAREKAIVLNLEVIKAVITSEQVMLLDSLRPEVLTLTDRLKHHFPRKDGPENILQASSHGHQEGGEEGLKSKLPFEFRVLEIAFEVFCSFVDSNVVDLETQAWSILDELTKKVSNENLKDLRSLKTSLTHLLARVQKVRDEIEHFLDDKEDMEDLYLTRKWIQNQQTEAASNSIVSQPNLQRHTSNRISTSMVTEEDDIDDMEMLLEAYFMQLEGMRNKILLMKEHIDSTEAYVKILQNSRRNGLIHLMMLVNIGNYAITAGTVVVNLFGMNIPIGLYSTPDIFGYVVWAVVALCIVLFIVTVGYAKWKKLLD

SEQ ID NO: 21102 - protein, 352 aa, Borrelia burgdorferi
MKKDYYEILGLSKGASKDEIKKAYRKIAIKYHPDRNQGNEEAASIFKEATQAYEILIDDNKKAKYDRFGHSAFEGGGFEGFSGGFSGFSDIFEDFGDIFDSFFTGNKGQERNRKHAKGEDLGYNIEISLENAYFGYKNNINIARQMLCDSCLGKKSEKGTSPSICNMCNGSGRVVQGGGFFRVTTTCSKCYGEGKIISNPCKSCKGKGSLTKQETIQLNIPPGIDNNQQIKMKGKGNVNPDNQEYGDLYVKILIRSHKVFKRNGKDLYAMLPISFTQAALGKEVKIKTIASKEIKIHIPKGINNEEQILIKNAGMPILQTEKFGNLILITKIKTPKNLNSNAINFLKTWAKN

SEQ ID NO: 21103 - protein, 313 aa, Streptococcus pyogenes
MTKIYKTITELVGQTPIIKLNRLIPNEAADVYVKLEAFNPGSSVKDRIALSMIEAAEAEGLISPGDVIIEPTSGNTGIGLAWVGAAKGYRVIIVMPETMSLERRQIIQAYGAELVLTPGAEGMKGAIAKTETLAIELGAWMPMQFNNPANPSIHEKTTAQEILEAFKEISLDAFVSGVGTGGTLSGVSHVLKKASPETVIYAVEAEESAVLSGQEPGPHKIQGISAGFIPNTLDTKAYDQIIRVKSKDALETARLTGAKEGFLVGISSGAALYAAIEVAKQLGKGKHVLTILPDNGERYLSTELYDVPVIKTK

SEQ ID NO: 21104 - protein, 216 aa, Brassica napus
MSMSSMSSPSSAVFSPENLSPDPLSPSEQLCYVQCNYCETILAVSVPYTSMFKTVTVRCGCCTNLISVNMRSLVLPASNQLQLQLGPHSYFTPQNILEELKDAPSNMNMMMMNQHPNMNDIPSFMDLHQQHEIPKAPPVNRPPEKRQRVPSAYNRFIKEEIQRIKAGNPDISHREAFSAAAKNWAHFPHIHFGLAPDNQPVKKTSMPQQEGEDNMG

SEQ ID NO: 21105 - protein, 168 aa, Setaria italica
  misc_feature (159)..(159): Xaa can be any naturally occurring amino acid
MAAASSTTSVHDFTVKDASGKDVDLSTYKGKVLLIVNVASQCGLTNSNYTELAQLYEKYKDQGFEILAFPCNQFGGQEPGTNEEIVQFACTRFKAEYPIFDKVDVNGNNAAPIYKFLKSSKGGLFGDSIKWNFSKFLVDKEGRVVDRYAPTTSPLSIEXDIKKLLGSS

SEQ ID NO: 21106 - protein, 484 aa, Propionibacterium acnes
MSTRLGGSSPAAGCPAVPSRFGAAGSGAPSGTEQEQGLQRGLKNRHIQFIALGGAIGTGLFYGAAESIEQAGPAIMVCYLIGGAVIFLIMRALGEMSVEHPTSGAFSYYAYRNWSPRAGFVSGYNYWFNYIAVSMAELTVVGKYVNFWFPQIPEWLSAGAFLVLITIINLTAVRAYGEFEFWFAVIKVVAILAMIVLGVLIIATGLGGGPPTGIGNLWRHGGFFPTGISGMLCGFVVVMFSFGGVELIGITAGEADDPRRSIPRAINQVVYRILIFYIGAISVMLCLFPWNQIGKAGSPFVTIFDKIGVAGAANILNVVVLTASMSAYNSGLYSNGRMLYSLAAQHNAPGIFWKTNRLGAPWVGVLASSVVTATAVLLTYLIPGKVFLYIISIALISGVINWTMIIITNLKFRRRIGPEGVAALEFRMPGNPVTSYVVLVFLALVVVIMAMMPSYRVALVVGPVWLALLWVGYDVSCLVRRRHA

SEQ ID NO: 21107 - protein, 511 aa, Unknown
  Torenia hybrid cultivar
MTVATTLVVVLSRELLLYVLVVYILVSKSLSTIIVVSRKRLPPGPTGFPVVGALPLLGSMPHVALAKMAKKYGPVMYLKTGTLGMVVASTPSSARAFLKTLDSNFSNRPANAGATHLAYGAQDMVFAPYGPRWRLLRRLSNLHMLGGKALDGWANVRASELGHMLEAMNRASREGEVVVVPEMLVYAMANMIGQVILSRRVFVTKGEEVNEFKDMVVELMTSAGYFNIGDFVPILAWMDLQGIERGMKALHKKFDKLITRMLEQHEASAHKPDFLDAIIAASLDDYSSEEERLSTSNIKALLLNLFTAGTDTSSSTIEWALSEMLKKGKILKRAQEEMDRVVGRERRLVESDIEKLGYLKAICKETFRKHPSTPLNLPRISSEACVVNGHYIPKGTRLSVNIWAIGRDPEVWEDPLEFNPDRFLHSKMDPRGNDFELMPFGAGRRICAGTRMGIVLVEYILATLVHSFDWKAADQDNNIMNMEEAFGIALQKATPLKALVTPRLPLHCYLP

SEQ ID NO: 21108 - protein, 362 aa, Medicago truncatula
MRFSLASPLFLLGLFTINLIHTADAQIGICYGMMGNNLPPANEVINLYKANNIKRMRLYDPNQAALNALRNSGIELILGVPNSDLQTLATNSDNARQWVQRNVLNFWPSVKIKYIAVGNEVSPVGGSSWLAQYVLPATQNIYQAIRAQGLHDQIKVSTAIDMTLIGNSFPPSKGSFRNDVRSYLDPFIGYLVYAGAPLLVNVYPYFSHVGNPRDISLPYALFTSPGVMVQDGPNGYQNLFDAMLDSVHAALDNTGIGWVNVVVSESGWPSDGGAATSYDNARIYLDNLIRHVGKGTPRRPWATETYIFAMFDENQKSPELEKHFGVFYPNKQKKYPFGFGGERNGEIVNGDFNATISLKSDM

SEQ ID NO: 21109 - protein, 154 aa, Zea mays; identical to SEQ ID NO: 535

SEQ ID NO: 21110 - protein, 362 aa, Medicago truncatula
MITGNRNVMASLLLLFALFTVNLRLTSAQIGVCYGMMGNNLPSQREAIDLCKSNNIKRMRLYDPNQAALEALRNSGIELMLGVPNSDLQNIATNNDIAIQWVQKNVLNFYPSVKIKYIAVGNEVNPVGGSSQFAKFVLPAIQNIYQAIRAKNLHDQIKVSTAIDMTMIGTSYPPSKGSFRSDVRSYLDPIIGYLVYANAPLFANIYSYFSYKDNPKDISLQYALFTSPNVVVWDGSRGYQNLFDALLDSLHAAIDNTGIGFVKVVVSESGWPSDGGFATTYDNARVYLDNLIRHVKGGTPMRSGPIETYIFGLFDENQKNPELEKHFGVFYPNKQKKYPFGFQGKIDGTNLFNVSFPLKSDI

SEQ ID NO: 21111 - protein, 201 aa, Phytophthora infestans
MNPEYDYLFKLLLIGDSGVGKSCLLLRFADDTYTESYISTIGVDFKIRTIELDGKTIKLQIWDTAGQERFRTITSSYYRGAHGIIVVYDVTDQESFNNVKQWLHEIDRYACENVNKLLVGNKSDLTAKRVVSTDAAKEFAESLGIEFLETSAKNAANVEKAFMMMAAQIKKRMANAPVAPKAGVKLTPGQQVPSNGGSKCC

SEQ ID NO: 21112 - protein, 84 aa, Oxalis staffordiana
  misc_feature (56)..(68): Xaa can be any naturally occurring amino acid
ISGTNGEVMPGQWEYQVGPSVGIEAGDHIWASRYILERITEQAGVVLTLDPKPIDXXXXXXXXXXXXXTKSMRDEGGFEVIKKA

SEQ ID NO: 21113 - protein, 485 aa, Thermoanaerobacter tengcongensis
MLKEYNSLIFELSKEGKKAYTLPPLDVEEKPLEDMLPKEMLREKEVDLPEVSEVDVIRHYTLLSQKNYGVDIGFYPLGSCTMKYNPKINEDMASLPGFTELHPYQPEETVQGALKLMYELEKALCEITGMDRFSLHPAAGAHGELTGLMIIKAYHEHRNDKKRKKIIVPDSAHGTNPASAAVAGFDVIEIKSNKEGAIDLEALKAVLNDEVAGLMLTNPSTLGLFEENIVEIARLVHEAGGLLYYDGANLNAIMGISRPGDMGFDVVHLNLHKTFSTPHGGGGPGSGPVGVKKELADFLPVPTVEEKDGRYFLDYDRPLSIGKVRSFYGNFNVMIKAYSYILTMGAEGLKRASELAVLNANYLKEKLKGYYKVAVDKTCMHEFVLAGLAEKSGDVRTLDVAKRLIDYGFHPPTIYFPLIVEEALMIEPTETETKETLDAFAETLIKIAKEAKENPELLKEAPHNTPVRRLDEVLAARNPVIRWTK

SEQ ID NO: 21114 - protein, 449 aa, Thermoanaerobacter tengcongensis
MIVMFPYLPISSEDEKEMLKTIGKNSIEELFEVIPKEVRLNRPLNLGKPMSELEVRKRLGSYADENKNLSQLVSFLGAGVYDHYIPSVVKHIISRSEFYTAYTPYQPEISQGTLQAIFEYQTMITNLTGMEVTNASMYDGASACAEAAMMACDATKRKSIIVSKTVNPETRKVLKTYMHFKEVEVVEIEDADGVTDIEKLKEVIGPNTAAVIVQYPNFFGIIENLQEIEKITHEQKAMLITYVHPIPLGILKSPGEIGADIAVGDGQSLGNGLHYGGPYLGFLATTQKLLRRMPGRIVGQTKDVDGKRGFVLTLQAREQHIRREKATSNICSNHSLNALTAAVYLATIGKKGIKEVAYQCLQKAHYAYTVLTESGKYKPAFNKPFFMEFALKTDKDVAEINKKLLEEGILGGYDLQRDYEKYKNVMLLAFTEKRTKEEIDRLKSLLEVM

SEQ ID NO: 21115 - protein, 208 aa, Brassica napus
  misc_feature (5)..(6): Xaa can be any naturally occurring amino acid
  misc_feature (15)..(15): Xaa can be any naturally occurring amino acid
  misc_feature (24)..(24): Xaa can be any naturally occurring amino acid
  misc_feature (45)..(45): Xaa can be any naturally occurring amino acid
  misc_feature (74)..(74): Xaa can be any naturally occurring amino acid
KSFNXXLHRNKKVDXIEQFNEKLXVKQENENLQILDVRNAQLMEXSRAEFMTPSAFIFLYENQLFLTFRNRNVXVWNFRGELVTSFEDHLLWHPDCNPNNIYITSDQDLIISYCKADTEDQWIEGNAGSINISNILTGKCLAKITSSSGPPKEDESSSSSSSSLGNNSKLRRNAVAEALEDITALFYDEERNEIYTGNRPGFVHVWSN

SEQ ID NO: 21116 - protein, 443 aa, Coprinopsis cinerea
MKLSAGLVSLAIAVTSASAQAVGPWGQCGGSGWSGATTCESGYTCQKHNEWYSQCVPGTSSAPPPPVTPQPSTTAAPPVVTPPPPTSATGFVKTNGTRFVLDGKPYTVVGSNSYWVGLSGHSRDNMNRAFADIAAAGGTTVRTWGFNEVTAYGGIPYYQIWNGRTPSVNTGANGLQNFDQVIAAAKANGIKLIVALTNNWSDYGGMDVYVRQILNSNNHDLFYTDPDVKAAFKNYIRAFVGRYVNETGILGWELANEPRCRGSTGTTSGRCTPATITAWAREMSAFIKSIDPNHLVALGDEGFYNQPGHPVYPYQGGEGIDFDVNLQIDTLDFGTVHAYPEHWGQQGNEVGFGNDWIKDHAESQKRYGKPVILEEYGVTTNKPAVYTEWLRTIQTSGLAGDLYWQAGSRLPTGSTHDDGFTVYPDQPAYQLLRSHAAAMKARG

SEQ ID NO: 21117 - protein, 294 aa, Staphylococcus arlettae
VLGVSKSASKDEIKKAYRKLSKKYHPDINQEEGSDEKFKEISEAYEVLSDENKRANYDQFGHNGPQGGFGGQGFGGQDFSGFGGGGFEDIFSSFFGGGRQRDPNAPRKGDDLQYTMTVTFDEAVFGTEKEISIRKDVTCHTCDGEGAKPGTSKKTCHYCNGAGHVSVEQNTILGRVRTEKACPSCNGSGQEFEEPCETCHGKGTENKTVKIKVTVPEGVDNEQQIRLAGEGAPGENGGPHGDLYVVFRVKPSNTFERMGDDVAYNLDISFSQAALGDEIKIPTLNSSVMLTVPA

SEQ ID NO: 21118 - protein, 304 aa, Unknown
  Agrobacterium sp. IP I-671
MTRQMILAVGQQGPIARAETREQVIARLLDMLANAASRGVNFIVFPELAVTTFFPRWHLTDEAELDSFYETEMPGPLTRPLFEKAAELGIGFNFGYAELVVEGGVKRRFNTSILVDRSGKIIGKYRKVHLPGHKEYEAYRPFQHLEKRYFEPGDMGFPVYDVDAAKMGMFICNDRRWPEAWRVMGLKGAEIICGGYNTPTHNPAVPQHDHLTSFHHLLSMQAGSYQNGAWSAAAGKVGMEEDCMLLGHSCIVAPTGEIVALTTTLEDEVITAMIDLDRCRELREHIFNFKAHRQPQHYGLIAEL

SEQ ID NO: 21119 - protein, 235 aa, Arabidopsis thaliana
MSSYSIASAISRISPLIRFVKPYSTGFSFITCACNSTRRPKRFDQLCVFSMASEARESPANNPGLSTNRDEATKGYIMQQTMFRIKDPKASLDFYSRVLGMSLLKRLDFSEMKFSLYFLGYEDTTTAPTDPTERTVWTFGQPATIELTHNWGTESDPEFKGYHNGNSEPRGFGHIGVTVDDVHKACERFEELGVEFAKKPNDGKMKNIAFIKDPDGYWIEIFDLKTIGTTTVNAA

SEQ ID NO: 21120 - protein, 454 aa, Oryza sativa
MEARRVSANPRPSCVRRVLARKRRRPEATANSARKLQRREISALPCRAFSASTTRERFRNIQLQEEFDTHDPKEMGSLLPYLMKRSEIIEIVGASDIIFALSQSGVCAAFSRVSNQRICFLNGRPDEVIRSLFYNKNNDSLITVSVYGSENFSALRCRTTRIEYIRRGKPDAGFPLFETESLKWPGFVEFDDVNGKVLTYSAQDSTYKVFDLKNYTLLYTISDKNVQEIKISPGIMLLIYSRKKGCIPLDILSIEDGKRLKSFKHLLHRNKKVDFIEQFNEKLLIKQEGENLQILDVRNFQSIEVSRSEFVTPSAFIFLYEMQLFLTFRSRSVSVWNFRGELVTSFEDHMLWHPDCNTNSIYITSNQDLIISYCKADPNDPSSEENACSINISEILTGKCLAKIKAGNLNKQRVSKFQSTPSEALGDITALYYDEEREEIYTGNRLGLVHVWSN

SEQ ID NO: 21121 - protein, 296 aa, Staphylococcus aureus
SLGISKDASKDEIKKAYRKLSKKYHPDIDKEEGADEKFKEISEAYEVLSDDNKRASYDQFGHDGPQGFGGQGFNGSDFGGFSGFGGGGFEDIFSSFFGGGRQRDPNAPQKGDDLQYTMTLTFEEAVFGTTKEISIRKDVTCETCHGDGAKPGASKKTCSYCNGAGHVAVEQNTILGRVRTEQVCPKCNGSGQEFEEACPTCHGKGTENKTVKLEVKVPEGVDNEQQIRLAGEGSPGVNGGPAGDLYVVFRVKPSETFKRDGDDIYYKLNVSFPQAALGDEIKIPTLNNEVMLTIPA

SEQ ID NO: 21122 - protein, 296 aa, Staphylococcus aureus
VLGISKDASKDEIKKAYRKLSKKYHPDINKEEGADEKFKEISEAYEVLSDDNKRASYDQFGHDGPQGFGGQGFNGSDFGGFSGFGGGGFEDIFSSFFGGGRQRDPNAPQKGDDLQYTMTLTFEEAVFGTTKEISIRKDVTCETCHGDGAKPGTSKKTCSYCNGAGHVAVEQNTILGRVRTEQVCPKCNGSGQEFEEACPTCHGKGTENKTVKLEVKVPEGVDNEQQIRLAGEGSPGVNGGPAGDLYVVFRVKPSETFKRDGDDIYYKLNVSFPQAALGDEIKIPTLNNEVMLTIPA

SEQ ID NO: 21123 - protein, 326 aa, Oryza sativa
MDLVAGGVIRGLPSSWERIRSPRTPLFLSSWASRRRVAFAACSSCPLVVCRNASAVVPFAKKKRKGGSEEPPDEEEGDDFVDEMEGEDDDEEEEDVDDDDLLDDNEDDDDDYSFEDDFESDDEQDLYVGDGGAGGGISLAGTWWDKEALALAEEVSNSFDGDLKIYAFKTAANLTIRVRIEKMSTRYGSPTIDDIEAFTIAYRAKMDDAESAGRIPQNISLEVSSPGVERVIRIPDDLERFKERAMYVRYTITSDGGEGMTPQEGDGVFRLISYDMDLCECTWGIADVKINRQQAGKGRPLSKKQREWRLQTPFESLKLVRVHSDC

SEQ ID NO: 21124 - protein, 247 aa, Picea glauca
MEHLNAAAAQASSSLYGVSMAEYGDVGVSSMMALMTQHEPHERDSILTTSMPSSFSSFHGHAECLLSAAMFQASQGDHKLKRQPEMDQLVSEQAVMSDSSMPSVKTEGCSSLRNQFEIRREQTGNCYTDQSSNAPVSPLVTSLVPQAGGEARMITSLEADSSHFSGGNEAEAIKAKILAHPQYPSLLGAYIDCQKIGAPPEVVARLDALTNEYENQHRTTVSIGMDPELDQFMEAYCEMLTKYHEEL

SEQ ID NO: 21125 - protein, 160 aa, Bacillus clausii
MLPLRKRIKMDYVMGLRKVVGNRPLILTGACVLIINNKNELLLQHRSDGGWGLPGGLMELGESLEDTARREVKEETGLIIGELKLLDVFSGSDYFFKFDNGDEVYSVTAVYVTKQAEGKIRIDYKESIDLQFFKLTNLPNGLTEEYRSYIKPLQEKGDLQ

SEQ ID NO: 21126 - protein, 257 aa, Elymus virginicus
CELDNIMRLTGITGIVNGMDVSEWDPTKDKFLVVNYDVTTALEGKALNKEALQAEVGLPVDRKVPLVAFIGRLEEQKGPDVMIAAIPEIVKDEDVQIVLLGTGKKKFERLLKSVEEKFPGKVRAVVRFNAPLAHQMMAGADVLAVTSRFEPCGLIQLQGMRYGTPCACASTGGLVDTIVEGKTGFHMGRLSVDCNVVEPADVKKVATTLKRAIKVVGTPAYQEMVKNCMIQDLSWKGPAKNWEDVLLELGVEGSEPG

SEQ ID NO: 21127 - protein, 257 aa, Elymus wawawaiensis
CELDNIMRLTGITGIVNGMDVSEWDPTKDKFLAVNYDVTTALEGKALNKEALQAEVGLPVDRKVPLVAFIGRLEEQKGPDVMVAAIPEIVKDEDVQIVLLGTGKKKFERLLKSVEEKFPGKVRAVVRFNAPLAHQMMAGADVLAVTSRFEPCGLIQLQGMRYGTPCACASTGGLVDTIVEGKTGFHMGRLSVDCNVVEPADVKKVATTLKRAIKVVGTPAYQEMVKKCMIQDLSWKGPAKNWEDVLLELGVEGSEPG

SEQ ID NO: 21128 - protein, 379 aa, Nicotiana sylvestris
MTIDCMITNVKSPMLRILEDEKRPLIFDASQMKREYNIPTQFIWPDDEKPRATARELPVPLIDLGGFLSGDPVAAQQASRLVGEACRNHGFFLVVNHGVNANLICNAHRFMDMFFDLPLSEKQKAQRKLGEHCGYASSFTGRFSSKLPWKETLSFRYSAQEDSSRIVKEYFQNTMGESFSHLGNVYQEYCNSMSILSLGIMELLGMSLGVGREHFKEFFEENESIMRLNYYPPCQKPDLTLGTGPHCDPTSLTILHQDCVGGLQVFVDNEWRSISPNFNAFVVNIGDTFMALSNGRYKSCLHRAVVNNKTPRKSLAFFLCPKKDKVVSPPTELVDSNNPRIYPNFTWPTLLEFTQKHYRADMNTLQSFSNWLQQTTAQV

SEQ ID NO: 21129 - protein, 444 aa, Moorella thermoacetica
MKIALIAPAWHDPLWESEKEKSIFPPLNLITLAAMTPPQHEVTILDESLTDLDFNEKYDLVGISAMTALAPRAYEIADAFRERGTMVVLGGMHPSALPEEAIAHADAVVVGEAEGSWQRLLTDLENGQLQAFYRQEKRPSLEHMVIPRRDLLQRSRYLVPDTVQTTRGCPFACSFCSVSQFFGHSYRFRPVEEVISEVRDLEGEVIAFIDDNIVGNPAYARRLFTELARLPRKVKWFSQGSLNIARDEELLRLAAASGCIGLFIGFESLSPANLKAVGKRVNLVDDYRQAIKKLHDHGIAIEGAFVFGLDEDDESVFERTVKFAQENRLEAAQFGILTPFPGTPLREALEREGRITNNDWSEYTISKVVFEPKNMSARTLQEGFNWAWQEFYSLGSISRRLGLAKKHAAILWALNLNIRKRFNHFMERLRAGNLGLPQPSLARQ

SEQ ID NO: 21130 - protein, 256 aa, Pseudoroegneria spicata
CELDNIMRLTGITGIVNGMDVSEWDPTKDKFLAVNYDVTTALEGKALNKAVLQAEVGLPVDRKVPLVAFIGRLEEQKGPDVMIAAIPEIVKDEDVQIVLLGTGKKFERLLKSVEEKFPGKVRAVVRFNAPLAHQMMAGADVLAVTSRFEPCGLIQLQGMRYGTPCACASTGGLVDTIVEGKTGFHMGRLSVDCNVVEPADVKKVATTLKRAIKVVGTPAYQEMVKNCMIQDLSWKGPAKNWEDVLLELGVEGSEPG

SEQ ID NO: 21131 - protein, 465 aa, Glycine max
MAFLMAIVVVGVVLVLCFCSALLRWNEVRYRKKGLPPGTMGWPLFGETTEFLKQGPNFMKTQRARYGSFFKSHILGCPTIVSMDPELNRYILMNEAKGLVPGYPQSMLDILGKCNIAAVHGSTHKYMRGALLSIISPTLIRDQLLPKIDQFMRAHLSNWGDKVINIQEKTKEMAFLSSLKQIAGMESGSLSDSFMAEFFKLVLGTLSLPIDLPGTNYHSGFQARKTIVNILSKLLEERRASHETYHDMLGCLMGRDESRYKLSDEEIIDLVITIMYSGYETVSTTSMMAVKYLHDHPKALEELRKEHLAIRERKKPDEPLDCNDLKSMRFTRAVIFETSRLATIVNGVLRKTTQDMELNGYLIPKGWRIYVYTREINYDPFLYPDPLTFNPWRWMDKSLESKNYFFIFGGGTRQCPGKELGITEISTFLHYFVTRYRWEEVGGDKVMKFPRVEAPNGLHIRVTSY

SEQ ID NO: 21132 - protein, 752 aa, Methanosarcina acetivorans
MKTRSYKIEKGYPHPPGATCDEEGVNFSIYSEHADYVELLLFDKHDDLEPVLVLSTNRVEELTRPGKVESLVEASKEIGTSKEIGTSKEIKTSQKIETAETPGIALNKTFHFWHVYIRGLKPGVHYAYRIGGPFDPSGGYRFDGGKVLIDPYSRGNNKTLWDREKASVPGDNLSTSMRSVVIDPSRYRWENNSHITAEKVYEMPGKWEDLFGKSRLQELNETIIYELHVGGFTRSPSSGVKTPGTFSGIIEKIPYLKELGITAVELMPVFDFDDTISPEGKRHYWGYDPICFFAPHSGYCKNPERGDHTKEFRDMVKALHKAGIEVILDVVFNHTAEGDHLGPVFSFKGIDNSIYYHLEPDRQYYSNYSGCGNTVNCNHPISQKLIVDSLKYWTEEMHVDGFRFDQGSILSLDTDGKVMKYPPVIWQIELDDSLGYIKVIAEAWDAAALNQVGYFPGPRWAEWNGYYRDEIRRFVRGDPGLVGRVASRIAGSPDLYQSESRLPINSVNFVTCHDGFTLNDLVSYNYKHNEANGENNRDGTDNNLSWNCGVEGETEDPEIEALRERQIKNFASILLLSIGVPMISMGDEVRRTQKGNNNAYCQDNGTGWFDWNLVGRNRDMFRFWKLMIDFRKRHTTILRPRYFTGKENERGLKDISWYGCKLNSPGWDDPYARALSFTMGEPGDEEDIHVMMNMYWEPLEFEIPGLRERNWHRAVDTFLPPPQDIAGAGEEVQVNGSSCTVQGRSVVVLISK

SEQ ID NO: 21133 - protein, 106 aa, Mesorhizobium loti
MATVKVDINNFQSEVLESAAPVVVDFWAEWCDPCKMIAPSLEEISVEMESKIKVAKLNIDENPELAAQLGVRSIPALAIFKGGEVADFSVGAKPKTALLNWISNAA

SEQ ID NO: 21134 - protein, 257 aa, Elymus elymoides
CELDNIMRLTGITGIVNGMDVSEWDPTKDKFLAVNYDVTTALEGKALNKEALQAEVGLPVDRKVPLVAFIGRLEEQKGPDVMIAAIPEIVKDEDVQIVLLGTGKKKFERLLKSVEEKFPGKVRAVVRFNAPLAHQMMAGADMLAVTSRFEPCGLIQLQGMRYGTPCACASTGGLVDTIVEGKTGFHMGRLSVDCNVVEPADVKKVATTLKRAIKVVGTPVYHEMVKNCMIQDLSWKGPAKNWEDVLLELGVEGSEPG

SEQ ID NO: 21135 - protein, 257 aa, Elymus lanceolatus
CELDNIMRLTGITGIVNGMDVSEWDPTKDKFLAVNYDVTTALEGKALNKEALQAEVGLPVDRKVPLVAFIGRLEEQKGPDVMIAAIPEIVKDEDVQIVLLGTGKKKFERLLKSVEEKFPGKVRAVVRFNAPLAHQMMAGADVLAVTSRFEPCGLIQLQGMRYGTPCACASTGGLVDTIVEGKTGFHMGRLSVDCNVVEPADVKKVATTLKRAIKVVGTPAYHEMVKNCMIQDLSWKGPAKNWEDVLLELGVEGSEPG

SEQ ID NO: 21136 - protein, 415 aa, Listeria monocytogenes
MTELIKKGSAAKEAAQFLAQASTKQKNAALLNLSNDLLTHTASLLEENNKDIIRAREKGTPETMIDRLRLTEERIKEISEAVKQVVALKDPIGEVTNMWKNEAELTIGKTRVPLGVIGIIYESRPNVTVDASVLCFKTGNAVILRGGSDAIDSNKALMSVIQDSLEASGFPRSSVQLIEDTSRETARDMMRLNRFLDVLIPRGGAKLIQTVLENATVPVIETGTGNCHIYVDKAAEKQMAIDILVNAKCSRPSVCNAAETLLIHRDVADAFLPEMETALKEYNVELRADERAREILKDSKAATESDWEDEFLDFILAIKVVDSVDEAINHINKYGTKHSEAIISNDYATGQAFHQKVDAAAVYINASTRFTDGFAMGFGAEIGISTQKLHARGPMGLTELTSTKYIIFGDGQIRN

SEQ ID NO: 21137 - protein, 474 aa, Synechococcus elongatus
AAPILFWHRRDLRLSDNIGLAAARAQSAQLIGLFCLDPQILQSADMAPARVAYLQGCLQELQQRYQQAGSRLLLLQGDPQHLIPQLAQQLQAEAVYWNQDIEPYGRDRDGQVAAALKTAGIRAVQLWDQLLHSPDQILSGSGNPYSVYGPFWKNWQAQPKPTPVATPTELVDLSPEQLTAIAPLLLSELPTLKQLGFDWDGGFPVEPGETAAIARLQEFCDRAIADYDPQRNFPAEAGTSGLSPALKFGAIGIRQAWQAASAAHALSRSDEARNSIRVWQQELAWREFYQHALYHFPSLADGPYRSLWQQFPWENREALFTAWTQAQTGYPIVDAAMRQLTETGWMHNRCRMIVASFLTKDLIIDWRRGEQFFMQHLVDGDLAANNGGWQWSASSGMDPKPLRIFNPASQAKKFDATATYIKRWLPELRHVHPKDLISGEITPIERRGYPAPIVNHNLRQKQFKALYNQLKAAI

SEQ ID NO: 21138 - protein, 365 aa, Bordetella parapertussis
MRARPARAPRSLPIRIAMSFQVTIEPSKHQFQAEAGQTVLDAALAAGIVLPYSCRTGACSTCKGKVVAGEVDAGPYPAQILSPEDLAQGYTLFCQAKPQSDLVVESTEVRLASDIQIRKLPSRVQTIERVAPDVAVLKLQLPASEQFRYYAGQYIEVILKDGKRRSYSMAGAPHTGSPLELHIRHMPGGLFTDHVFGAGDTQMKEREILRLEGPFGSFFLREDSDKPIVLLASGTGFAPVKAIVEHMIHNQIQRPAVLYWGGRRPRDLYHDALAQSWAGSLPGFRYVPVVSDALDEDGWSGRTGYVHEAVMQDLSDLSGYEVYACGTPLMVDAARREFSAQCGLPAEAFYADAFTSEADLAKATP

SEQ ID NO: 21139 - protein, 308 aa, Prosthecochloris aestuarii
MNVYESITETVGRTPLVRIRRMADHSYADVYAKLESFNPLSSVKDRVGVAMIEDAERNGLIGPETTIIEPTSGNTGIALAFSCASRGYRLILTMPDTMSVERRRLLKILGAELVLTEGAAGMKGAIAEAERLVDSIPHSLMLQQFNNPANPETHRRTTAREIWDDTDGQVDIFIAGVGTGGTITGVGSVLRELKPGVHIVAVEPDDSPVISGGEPGPHKIQGIGAGFVPGNLDPSVIDEIITVSNQDAAETARKLARKEGILCGISSGAAMWAAMSVAARPAMEGKNIVVLLPDTGERYLSTWLFADE

SEQ ID NO: 21140 - protein, 469 aa, Candida glabrata
MPYALSDKHLKMVSGHLSETDPEVEQIIKDEVDRQKHSIDLIASENFTTTSVFDALGTPLCNKYSEGYPGARYYGGNEHIDRIERLCQQRALEAFHVTPDRWGVNVQTLSGSPANLQVYQALMKPHERLMGLYLPDGGHLSHGYATENRKISAVSTYFESFPYRVNPETGIIDYDTLEKNAILYRPKILVAGTSAYCRLIDYKRMREIADKCGAYLMVDMAHISGLVAAGVIPSPFEYADIVTTTTHKSLRGPRGAMIFFRRGIRSVNQKTGKEIPYDLENPINFSVFPGHQGGPHNHTIAALATALKQAATPEFKEYQTQVLKNAKALENEFQTLGYRLVSNGTDSHMVLVSLREKGVDGARVEYVCEKINIALNKNSIPGDKSALVPGGVRIGAPAMTTRGMGEEDFHRIVRYIDQAVKFAEQTQSSLPKEANKLKDFKAKVDEIADQLAPLKKEIYDWTAEYPLAV

SEQ ID NO: 21141 - protein, 336 aa, Ashbya gossypii
MLAAATRYRLGQALQTRMVHHKVTIIGSGPAAHTAAIYLARAEIKPTLYEGMFANGVAAGGQLTTTTEIENFPGFPDGLTGSDLMERMKAQSVKFGTEVVTETVAKVDLSARPFKLWTEFNEDEEPTTTDAIILATGASAKRLGLPGEETYWQRGISACAVCDGAVPIFRNKPLAVVGGGDSACEEASFLTKYGSKVFMLVRKDHMRASTIMQRRVERNEKIEVLYNTAPVEAKGDGSLLDALRVRDTRTGEESDLPVNGLFYAIGHTPATQLVAGQVDLDESGYVKTVPGSTLTNVPGLFAAGDVQDSRYRQAVTSAGSGCMAALDAEKFLSELE

SEQ ID NO: 21142 - protein, 433 aa, Zea mays
MPAPDGWTKKFTPLRGGRSEIVFVSPTGEEIKNKRQLSQYLKAHPGGPAVSEFDWGTGDTPRRSARISEKVKVFDSPEGEKIPKRSRNSSGRKGKQGKKETPETEEAKDAETGKEAEEAPSEDAAKETDVEMKPAEEVKGASAETEDADMADAPAPAPMEEDKKQTEELAEAIAAPPVPSEEKKDVKPAEPEAAASNPTEDSAPAPAEPADVAAPAAEPKSDAKPAAVAAPVPETKSDAEPAAVAAPAPETKSDAEPAAVAAPAPETKSVAEPAAVAAPAPETKSDAEPAAVAAPVPETKSDAEPAAVAAPVPETKSDAEPAADAAPVPEMKSESEPAAVAAPASETKSDAEPAAVAAPAPETKSDAEPAAAAAPVPGTNSDAAATDPAPGTKATAADPAPGAPAENSTDKDGSQESQPVNNGQLPHSTVKCT

SEQ ID NO: 21143 - protein, 418 aa, Unknown
  marine gamma proteobacterium HTCC2207
MNIKAYMQTLGSQARDASRIIAAADTALKNTALLAIADALSDGRDKLLAANAVDMQNGSANGLDAALLDRLELNAPRIDAMIEGLQQVAELPDPIGEVTDLQDRPSGIKLGKMRVPLGVVGIIYESRPNVTIDAASLCLKSGNATILRGGSEAIQSNQAIADCISQGLSKVGLPEAVVQVVNTTDREAVGELITMTESVDVIVPRGGKSLIERISADARVPVIKHLDGNCHVYIDDHADLQKALAIALNAKTHRYGVCNAMESLLVAESVAKTVLPELAALYSEKDVELRGCDKTREIIASAISASEEDWSLEYLAPILSIKVVAGLDEAIEHINNYSSKHTEAIITEDQDRANRFIRQVDSSSVMVNASTRFADGFEYGLGAEIGISTDKIHARGPVGLEGLTSQKWVVYGDGQIRQ

SEQ ID NO: 21144 - protein, 91 aa, Oxalis teneriensis
  misc_feature (2)..(2): Xaa can be any naturally occurring amino acid
  misc_feature (58)..(70): Xaa can be any naturally occurring amino acid
  misc_feature (88)..(88): Xaa can be any naturally occurring amino acid
IXISGTNGEVMPGQWEYQVGPSVGIEAGDHIWASRYILERITEQAGVVLTLDPKPIDXXXXXXXXXXXXXTKSMRDEGGFEVIKKAIXNLS

SEQ ID NO: 21145 - protein, 175 aa, Kluyveromyces lactis
MGAAPSRIVDNLLDDTNFDRAEIERLKKRFMKLDKDSSGSIDKTEFMSIPGVSANPLAKRIIEVFDEDNSGDVDFQEFITSLSIFSGRGETDAKLRFAFRIYDIDKDGYISNGELFIVLKIMVGTNLEDEQLQQIVDRTIMENDVDGDGKLSFEEFKKAAETTEVIQSLTLQHNI

SEQ ID NO: 21146 - protein, 371 aa, Pisum sativum
MEGSSNGSSSYVMAAFGENSGGLCPPMMMMPLVTSSHHHPINSNNNNANNTSCLFLPIPNSTNNNNHYTNNNNSNNTMLQNNHHTTQNTPGLGYYFMDNHNNNGASSSSSSSAVKAKIMAHPHYHRLLEAYINCQKVGAPSEVVTRLEEACASAVRMGGDAVGSGCIGEDPALDQFMEAYCEMLIKYEQELSKPLKEAMLFLQRIEVQFKNLTVSSSSDNIACNEGGDRNGSSEEDQVDLYNNMIDPQAEDRELKGQLLRKYSGYLGSLKQEFMKKRKKGKLPKEARQQLLEWWSRHYKWPYPSESQKLALAESTGLDQKQINNWFINQRKRHWKPSEDMQFVVMDPTHPHYYMDNVLTNSFPMDLSNTML

SEQ ID NO: 21147 - protein, 397 aa, Ustilago maydis
MSGGINAGDSKLAFESSEHVKVATTFDAMGLKEDLLRGIYAYNFEKPSAIQQRAILPIIRGRDVIAQAQSGTGKTATFSISMLQSIDTTLRETQALVLSPTRELAIQIQSVVLALGDYLNVQCHACIGGTSVGEDIRKLDYGQHIVSGTPGRVYDMIRRRHLRTKNIKMLILDESDELLNMGFKDQIYDVYRYLPPSTQVVLLSATLPQDVLEMTSKFMTDPVRILVKRDELTLEGIKQFFVAVEKEEWKFDTLCDLYDTLTITQAVIFCNTRRKVDWLSAKMKENNFQVSSMHGEMQQKERDEVMAEFRQGSSRVLITTDVWARGIDIANISLVINYDLPTNRENYIHRIGRSGRFGRKGVAINFVTVDDVRTLRDIEQFYSTQIDEMPVKLEDML

SEQ ID NO: 21148 - protein, 89 aa, Oxalis polyrhiza
LYAGINISGTNGEVMPGQWEYQVGPSVGIEAGDHIWASRYILERITEQAGVVLTLDPKPIDGDWNGAGCHTNYSTKSMRDEGGFEVIKK

SEQ ID NO: 21149 - protein, 197 aa, Oryza sativa
THAFARVQLHVGDAVDFLRNAPEGKYDAIIVDSSDPIGPAQELVEKPFFQTIARALKPAGVLCNQAESMWLHTHLIQDMLSICRETFKGAVHYAWTSVPTYPSGVIGFLLCAKEGPAVNFLSPVNPIEKLEGAMEAGREIRFYNSEVHRAAFVLPTFVRRELESHNTCAEKDKSETKPVAKPKKMKIMPNSAIPTAS

SEQ ID NO: 21150 - protein, 636 aa, Mycobacterium avium
MPDWTAAQLPSFAGRTVIVTGANAGLGEVTARELARVGGHVILAVRNTDKGRAAADRMAGVATGRVEVRELDLQDLASVRRFADGIDTVDVLVNNAGIMATKHAVTVDGFEGQIGTNHLGHFALTNLLLPKLTDRVVTVSSLMHHFGYISLKDLNFRSRPYSAWLAYSQSKLANLLFTSELQRRLDAVPSSLRALAAHPGWSHTNLQGNSGRKLGDAAVLAVDRIVSTDADFGARQTLYAVSQDLPGDTFVGPRFGLYGRTQPTWRNWPAKRAGTAAALWELSEELTGTSFRSDPDLRRGRAAGPPSPRRPPGAVTKLVLSATPRGVGGYAMSDANLAAVLALCAALASAVGNVVRQRSAQEVTDKPVGHLALFGMLLRDTRWWLGGLGDIGSYVLLAAALDRGSVLLVMSLQVTALLFALPIYARMTHHPITGREWAWALLLAVALAVLIAVGDPTGGQQRAPLQTWLVVAAVIGPLLVLGLLGARVWADRPVAALLLAAVAGSLLAMFAVLMKGVVDILEHNPGQLWRSFELYALVFCGVAGMIYHQSAYRAGALTASLPTIIVAKPVVGGILGIIVLRETLVAGGWEWVVLAVTAVVVIVATVGLARGEAASMSAGAGRDVRPTDRPKAASQA

SEQ ID NO: 21151 - protein, 87 aa, Oxalis picchensis
  misc_feature (4)..(4): Xaa can be any naturally occurring amino acid
  misc_feature (9)..(9): Xaa can be any naturally occurring amino acid
  misc_feature (66)..(66): Xaa can be any naturally occurring amino acid
  misc_feature (68)..(68): Xaa can be any naturally occurring amino acid
  misc_feature (70)..(71): Xaa can be any naturally occurring amino acid
  misc_feature (73)..(73): Xaa can be any naturally occurring amino acid
  misc_feature (78)..(78): Xaa can be any naturally occurring amino acid
  misc_feature (80)..(80): Xaa can be any naturally occurring amino acid
GTNXEVMPXQWEYQVGPSVGIEAGDHIWASRYILERITEQAGVVLTLDPKPIDGDWNGAGCHTNYXTXSXXDXGGFEXIXKAIFNLS

SEQ ID NO: 21152 - protein, 353 aa, Pseudomonas putida
MYPRNTWYVACTPDEIADKPLGRQICGEKIVFYRGHENRVAAVEDFCRTRAPLSLGYVENGNLVCGYHGLVMGCDGKTVEMPGQRVRGFPCNKTFAVVERYGFIWVWPGDQAQADPSLIPHLEWAVNDDWAYGGGLFHIGCDYRLMIDNLMDLTHETYVHASSIGQKEIDEAPPYHRHRREVLSARHMENIMAPPFWRMALRGNGLADDVPVERWQICRFTPPSHVLIEVGVAHAGKGGYHAEQHKASSIVVWNFITPETDTSIWYFWVLACNFAAQDQALTANIREGQGKIFSEDLEMLERQQQNLLAYPQRNLLKLNIDAGGVQSRKILERLIANERMPQAELIATSASPA

SEQ ID NO: 21153 - protein, 349 aa, Brassica napus
MASITSTLSLSSTKPQRLFDSSFHGSSISSAAPVSVGLKPRSLSVRATAGYDLNAFTFDPIKESIVSREMTRRYMTDMITYAETDVVVVGAGSAGLSCAYEISKNPNVQVAIIEQSVSPGGGAWLGGQLFSAMIVRKPAHLFLDEIGVPYDEQDNYVVIKHAALFTSTIMSKLLARPNVKLFNAVAAEDLIVKGNRVGGVVTNWALVSMNHDTQSCMDPNVMEAKIVVSSCGHDGPFGATGVKRLKSIGLIDHVPGMKALDMNTAEDAIVRLTREVVPGMIVTGMEVAEIDGAPRMGPTFGAMMISGQKAAHLALKALGQPNVIDGSYVGDLSPELVLAAADSAETVDA

SEQ ID NO: 21154 - protein, 326 aa, Unknown
  Bradyrhizobium sp. BTAi1
MTCFQTIAVIGAGAWGTALAAVAARAGRDVTLYARDADHASHIASARENPRLPGIPLASRIAVTADLARAARADTVLIVVPAQHLRGAVMHVAPLLAPGTPLVACAKGIEHGTHKFMTEVIAEAAPCATPAILSGPSFAHDVARGLPTAVTLAAPDEALAAALVQALGSPTFRPYHSTDVRGVEIGGAAKNVLAIAAGIVAGRQLGASALAALTTRGFAELVRLGRAHGARSETLTGLSGLGDLILTCAGPQSRNFAAGLALGRGEPLPAGKLAEGQYTAPVLVELAAARGVEMPVAQAVAAILAGAVTIDAAIEALMLRPFKAEE

SEQ ID NO: 21155 - protein, 293 aa, Staphylococcus auricularis
VLGVSKDASKDEIKKAYRKLSKKYHPDINKEEGADEKFKEISEAYEVLSDPDKRANYDQFGHDGPQGGFGGQGFGGQDFSGFGGGFEDIFSSFFGDGRSSDPNAPRKGDDLQYNMTITFDEAVFGAKKDITIRKDVKCHTCNGNGAKPGTKKKTCHYCNGSGHTTVEQNTILGRVRTQKVCPVCDGTGEEFEEPCPTCHGKGTENKNVKINVKVPEGINNDQQIRLAGEGAPGENGGPQGDLYVVFRVKPSDKFERDGDDLFYDLNVSFAQAALGDEVKVPTLKGSVMLTIPA

SEQ ID NO: 21156 - protein, 396 aa, Arabidopsis thaliana
MAMALSNPTTSTNLYHYSILSPFSPPYHLHRRNTVLLASPRRLRRLAVAGGPPSPPGPDPPPPEDTTQLEGLVGAVTRVQDRVKIFLAVFFWMFLFFWVTVTDGTGKGKGKKGSRFKERREMGGEEEVVSVELPAPSSWKKLCCNYQIFFFEDSEYGSFWWRNFYPNKVGSVKKTEVVFVAPTGEEISNRKQLEQYLKSHPGNPAIAEFDWTTSGTPRRSARISEKTKATPSPDKEPPKKRGRTKSPVSKKDAEGEKSEGGGEENSHVKDTEMNPPEGIAENENVTDKNGSGETERVNDAKENIVAEETPNAAPVQEEGESMKEKALDSVDDKSKETDKEKDTGSIEKNSVDVEKKTVEASDEKKNSEAETRNHEENGLTTEAEGKEKTAEGEATG

SEQ ID NO: 21157 - protein, 328 aa, Coxiella burnetii
MAKHVKVAVTGAAGQIGYALLFRLASGQAFGLDTTVDLHLLEIEPALPALKGVVMELEDCAFPLLRNMVVTSDPRVAFNDVNWALLVGAAPRKAGMERKDLLEKNGSIFAGQGKAINENAASDVRIFVVGNPCNTNCLIAMNNAPDIPKDRFYAMTRLDQNRAIGQLALKAGVDVPSVKNMIIWGNHSSTQYPDFYHATIDGKPATEVIRDKNWLLNDFISVIQQRGAAVIKARGASSAASAANAALDSVWSLINTTPADDNYSVALCAQGQYGVDEGLIFSFPCRTENGVVSVIEEIEHNEFGQQKLKETLDELREERDAVEALGLI

SEQ ID NO: 21158 - protein, 429 aa, Brassica napus
  misc_feature (12)..(12): Xaa can be any naturally occurring amino acid
QGYQEMFKNLVXLLCTITGFDSLSLQPNAGASGEYTGLMVIREYHRSRGDHHRNVCIIPVSAHGTNPASAAMCGMKIITVGTDAKGNINMDEVRKAAEDNKDSLAALMVTYPSTHGVYEETIDEICKIIHDNGGQVYMDGANMNAQVGLTSPGFIGADVCHLNLHKTFCIPHGGGGPGMGPIGVKKHLAPFLPSHPVIPTGGFPQPEKTEPLGPIAAAPWGSALILPISYSYIAMMGSGGLTEASKIAILNANYMAKRLEKDFPVLFRGANGTVAHEFIIDLRGFKNTAGIEAEDVAKRLMDYGFHAPTMSFPVSGTLMIEPTESESKAELDRFCDTLISIREEIAQIEKGNADVQNNVLKGAPHSPAMLMSDTWKKPYSREYAAFPTPWLRSAKFWPTTGRVDNVYGDRKLVCTLLPEEEQVAAAVSA

SEQ ID NO: 21159 - protein, 392 aa, Thermoanaerobacter tengcongensis
MKAMVIKPGVSKIGAVHWERRLFDSLIPLPDGTSYNAYLVEGKEKVALLDTVDPMTEYILMEQLKDVKKIDYIIAHHAEQDHSGSIPAVLEKYKEAKVVCTPKAKTFLIDLLPIPEDKFITVEDGDTLDLGGKTLKFIHAPWVHWPETMFTYLVEDKILFTCDFLGSHLATSELYATDECKVYDSAKRYYAEIMMPFRNFIEKHLEKIKDLDIEIIAPSHGPVYNNPEFILNAYREWVLDKPKNIVLIPYVTMHGSVKKMVEYLEAALVERGVIVKPFDLSVTDIGEFAMALVDAATVVMATPTVLVGPHPMAVYAAYLTNALKPKVKFISVIGSYNWGSKAVDQITQMFGNLKVEFIPSVYIKGYPKEEDFKALDALAEEIVKRHKEAGIM

SEQ ID NO: 21160 - protein, 295 aa, Staphylococcus capitis
VLGVSKSASKDEIKKAYRKLSKKYHPDINKEEGADEKFKEISEAYEVLSDDNKRANYDQFGHEGPQGGFGSQGFGGGDFGGFSGGGFEDIFSSFFGGGSRQRDPNAPRKGDDLQYTMTVTFEEAVFGTKKEISIRKDVTCHTCDGEGAKPGTSKKTCSYCNGAGHVSVEQNTILGRVRTEQVCPKCEGSGQEFEEPCPTCHGKGTENKTVKLEVTVPEGVDTEQQIRLAGEGSPGVNGGPHGDLYVVFRVQPSDTFERDGDDIYYNLNVSFPQAALGDEIKIPTLNSNVVLTIPA

SEQ ID NO: 21161 - protein, 333 aa, Prochlorococcus marinus
MIKNKNILITGGNSGIGLFAIINLLKTKNILYVVIKNEFRKNEFLKKIEKYFDKNYLSKFLNIIENCDLSDLDNIKKIKDYFISKKIFIDILVLNAGLQYTGSFYPKVSKQGIELTFAVNHLAHFYLVNVLKDFIRDIEESRIIITSSDVHDPKSSGGNIGKKAGLNNLVNLRKKVTGQFLNFNADEAYKNSKLCNILFAKELEKKLKISSSKISVITWAPGLVIPNDDLGFFRYSKRFNLFGYLIFSKAAKNILGISESIENAGKILSEIVLDSNLNNIGYVHLSNKLISFKKHKLVESKVSDEANNSELASKLWILSEEICRSFGFVTFNI

SEQ ID NO: 21162 - protein, 377 aa, Nicotiana sylvestris
MTVDCMITRNKFTMQRTSKEPLIFDASVMKNESNIPSQFIWPDNEKPCANARELHVPHIDLGGVLSGDPFATKQAATLVNEACQKHGFFLVINHGIDTNLISNAHRYMDLFFELPLNEKQKAQRKIGEHCGYASSFTGRFSSKLPWKETLSFQYSAEEGSSHIVEDYFQRTMGENFCHLGKVYQDYSIAMSTLSLGIMELLGLSLGVSRNHFKEFFQENESIMRLNYYPPCQKPELTFGTGPHCDPTSFTILHQDSVGGLQVFVDNEWRSITPNFNAFVVNIGDTFMALSNGRYKSGLHRAVVNTKIPRKSLAFFLCPKKDKVVSPPIELVDSNNPRIYPEFTWPALLEFTQKQYRVDMNTLQTFSNWVQQTTTQAL

SEQ ID NO: 21163 - protein, 295 aa, Staphylococcus caprae
VLGVSKSASKDEIKKAYRKLSKKYHPDINKEEGADEKFKEISEAYEVLSDDNKRANYDQFGHEGPQGGFGSQGFGGADFGGFSGGGFEDIFSSFFGGGSRQRDPNAPRKGDDLQYTMTVTFEEAVFGTKKEISIRKDVTCHTCDGEGAKPGTSKKTCSYCNGAGHVSVEQNTILGRVRTEQVCPKCEGSGQEFEEPCPTCHGKGTENKTVKLEVTVPEGVDTEQQIRLAGEGSPGINGGPHGDLYVVFRVQPSDTFERDGDDIYYNLNVSFPQAALGDEIKIPTLKSNVVLTIPA

SEQ ID NO: 21164 - protein, 294 aa, Staphylococcus carnosus
VLGVSKDASKDEIKKAYRKLSKKYHPDINQEEGAEEKFKEISEAYEVLSDENKRANYDQFGHDGPQGGFGGQGFGGGQDFGGFGGGFEDIFSSFFGGGAQRDPNVPRKGDDLQYTMTVTFEEAAFGTEKEISIRKQVKCETCDGSGAKPGSKKKTCHYCNGSGHVSVEQNTILGRVRTEKVCPVCNGTGEEIEEPCPTCHGKGTETKNVKIKVKVPEGVDNDQQIRLAGEGAPGHNGGPQGDLYVVFRVEPSDTFEREGDDIFYNLNVSFPQAALGDEIKVPTLKGHVMLSVPE

SEQ ID NO: 21165 - protein, 319 aa, Arabidopsis thaliana
MKLDVYNGTLPSLVSTTYSWTKTSSIIFLDQPVGTGFSYSRTQQFNKPSDSGEAKRIHEFLQRWLGKHQVFSSNPFYVAGDSYSGLVVPATVQEISKGNYECCNPPINLQGYVLGNPLTDYTTGSNSRIPFAHGMALISDELYESLKKTCKGEYTNVHPRNTQCLKFVEEFNKCTNRIFQQLILDPLCETETPDCYIYRYLLTTYWANDATVREALQINKESIGEWVRCYYSIPYNNDIKSSMPYHVNNSISGYRSLIYSGDHDFEVPYLGTQAWIRSLNYSIIDDWRPWMVKNQIAGYTRTYANKMTFATIKASLSFF

SEQ ID NO: 21166 - protein, 827 aa, Haemophilus somnus
MNLSRRDFMKANAALAAASVAGLIIPVKNVNAADTSITWDKAVCRFCGTGCAVLVGTKDGRVVASQGDPDAEVNRGLNCIKGYFLPKIMYGKDRLTHPMLRMKNGQYDKEGEFTPVTWDFAFKTMAEKFKSALKAKGPNGVGMFTSGQSTIFEGVAKSKLFKAGLLSNNIDPNARHCMASAAVAFVRTFGIDEPMGCYDDIEHADAFVLWGSNMAEMHPILWSRISDRRLANPDTVSVNVLSTFEHRSFELADLGILLKPQSDLAILNYIANYLIENNAINREFIEKHTKFKRGETDIGYGLRPQDPREQIAKNVKTAGKMYDSSFEEFKKLVAPYTLEKAHEISGVPKEQLEKLAKLYADPNKKVVSYWTMGINQHTRGVWANHLIYNIHLLTGKISLPGCGPFSLTGQPSACGTAREVGTFIHRLPADLVVTKPEHRKIAEKIWKLPEGLISDKLGFHAVAQSRALKDGKMQVLWQMCNNNMQAGPNINEETYPGWRNPDNFIVVSDPYPTVSALSADLILPTAMWVEKEGAYGNAERRTQFWRQQVKAPGEAKSDLWQLVEFSKYFTTDEVWPAEILAKNPAYQGKTLYEVLYLNGQVNQYSNDELKGRLNDEAYHFGFYIQKGLFEEYASFGRGHGHDLADFDTYHKARGLRWPVVDGKETLWRYREGYDPYVKAGEGVSFYGQADKRAVILAVPYEPPAEVPDREYDLWLTTGRILEHWHTGSMTRRVPELHRSFPNNLVWMNPNDAKKRGLKHGDKIKVISRRGEITSYIDTRGRNKCPEGLIYTTFFDAGQLANKLILDATDPISKETDFKKCAVKVVKA

SEQ ID NO: 21167 - protein, 246 aa, Unknown
  Pelargonium x hortorum
MTKRSWNIRLEDMVAARVHLGHDIKKRNPRMAPYISAKLKDTDITNLKKTARFLSETCDLVFEAASKGKKFLIVGTKKEVANSVAQAARTAGCHYVNQKWLGGMLTNWSTTKKRLHKFRDLIRQQGRLNRLPKRDAAILKRQLFHLQKSLGGVKYMKELPDIVIILDQHGEFTALRECISLRIPTIGLIDTNCDPDLVDLPIPANDDSIPSIRFILNKLILAICKGRSRRTITSRPSHIKKKEKNR

SEQ ID NO: 21168 - protein, 207 aa, Oryza sativa
  misc_feature (129)..(129): Xaa can be any naturally occurring amino acid
MAGVSAASAAGKIGSFLSKRPYAPPSWASHLSPAPSQTFSLGHFPTPIHKWNLPNLPNGTEVWIKRDDISGMQLSGNKVRKLEFLMADAVAQGADCVITVGGIQSNHCRATAVAAKYINLPTRPGMFTXQLLVDKDPGLVGNLLVERLVGAHIDLVSKEEYGKIGSVALADLLKKKLLEEGRKPYVIPVGGSNSLGTWYCFLFNPNY

SEQ ID NO: 21169 - protein, 257 aa, Elymus lanceolatus
CELDNIMRLTGITGIVNGMDVSEWDPTKDKFLAVNYDVTTALEGKALNKEALQAKVGLPVDRKVPLVAFIGRLEEQKGPDVMVAAIPEIVKDEDVQIVLLGTGKKKFERLLKSVEEKFPGKVRAVVRFNAPLAHQIMAGADVLAVTSRFEPCGLIQLQGMRYGTPCACASTGGLVDTILEGKIGFHMGRLSVDCNVVEPADVKKVATTLKRAIKVVGTPAYHEMVKNCMIQDLSWKGPAKNWEDVLLELGVEGSEPG

SEQ ID NO: 21170 - protein, 112 aa, Unknown
  Azoarcus sp. BH72
MKKIEAIIKPFKLDEVREALSEVGIAGLTVTEVKGFGRQKGHTELYRGAEYVVDFLPKIKVEVVVADDMVEQTMDAVIKAAQTGKIGDGKIFVTPVEQVVRIRTGETNEAAI

SEQ ID NO: 21171 - protein, 257 aa, Elymus wawawaiensis
CELDNIMRLTGITGIVNGMDVSEWDPTKDKFLAVNYDVTTALEGKALNKEALQAEVGLPVDRKVPLVAFIGRLEEQKGPDVMIAAIPEIVKDEDVQIVLLGTGKKKFERLLKSVEERFPGKVRAVVRFNAPLAHQMMAGADVLAVTSRFEPCGLIQLQGMRYGTPCACASTGGLVDTIVEGKTGFHMGRLSVDCNVVEPADVKKVATTLKRAIKVVGTPAYHEMVKNCMIQDLSWKGPAKNWEDVLLELGVEGSEPG

SEQ ID NO: 21172 - protein, 316 aa, Unknown
  Azoarcus sp. BH72
MTTKHARLLILGSGPAGYTAAVYAARANLKPVLVTGLAQGGQLMTTTEVDNWPADADGVQGPELMERFQKHAERFNTEMIFDHIHTVQLQQRPFRLIGDAGEYTCDALIIATGATAKYLGLPSEEKFAGRGVSACATCDGFFYRNQDVAVIGGGNTAVEEALYLANIAKKVTVVHRREKFRAEKILIDKLMEKVEAGKIELVLNATLDEVLGDNTGVTGMRVRNESGATQDIALQGVFIAIGHKPNTDIFKGQLEMDETGYLITQGGRNGNATQTNIAGVFAAGDVQDHIYRQAVTSAGSGCMAALDAERYLDALS

SEQ ID NO: 21173 - protein, 366 aa, Oryza sativa
MAYDAGYECVRVILGDMDRVRNTRLHHGFPLVVIAFCPNNNEVHIYKFFTDKWEKLHVLSKHDQIVSGIDWSRSSNKIVTVSHDRNSYVWTQEGHDWVPTLVILKVNRAALCVQWSPKENKFAVGSGAKSVCICYYEQDNNWWISKVVRKKHESSVTSVAWHPNNILLATTSTDGKCRVLSTFIKGVDTRGSHASTSTDWKFGEQIAQLDLSSMWAFGVRWSPSGKTLAYAGHNSMIYFIDDVETSPAAQNLALRDLPLRDILFLSERTVIGVGFDCNPMIFSADETGLWSFVRYLDERKVTTSTSRASQLSEAFGKLYGQSKQVASSDTVEPSKPRGGVHENCITYYPLLPFCSSKADSYQLHID

SEQ ID NO: 21174 - protein, 486 aa, Yersinia pestis
MALRLVTGVILQTGVFLMSKQQIGVVGMAVMGRNLALDIESRGYSVSIFNRSSDKTDEVVAENPGKNLVPSYTVEEFVDSLEKPRRILLMVKAGEATDKTIASLTPHLDKGDILIDGGNTYYKDTIRRNRELSAQGFNFIGTGVSGGEEGALKGPSIMPGGQKEAYELVAPILEKIAARADDGDACVAYIGADGAGHYVKMVHNGIEYGDMQLIAEAYSLLKQSLGLSNEELASTFAEWNKGELNSYLIDITKDIFTKKDEDGNYLVDVILDEAANKGTGKWTSQSSLDLGEPLTLITESVFARYLSSLKDQRVAASKVLTGPKVQPFTGDKAEFIEKIRRALYLGKIVSYAQGFSQLKAASNENNWDLNYGEIAKIFRAGCIIRAQFLQKITDAYAENADIANLLLAPYFKQIADEYQQALRDVVSYAVQNGIPTPTFSAAINYYDSYRSAVLPANLIQAQRDYFGAHTYKRTDKEGVFHTEWMA

SEQ ID NO: 21175 - protein, 257 aa, Elymus wawawaiensis
CELDNIMRLTGITGIVNGMDVSEWDPTKDKFLAVNYDVTTASEGKALNKEALQAEVGLPVDRKVPLVAFIGRLEEQKGPDVMIAAIPEIVKDEDVQIVLLGTGKKKFERLLKSVEEKFPGKVRAVVRFNAPLAHQMMAGADVLAVTSRFEPCGLIQLQGMRYGTPCAYASTGGLVDTIVEGKTGFHMGRLSVDCNVVEPADVKKVVTTLKRAIKVVGTPAYHEMVKNCMIQDLSWKGPAKNWEDVLLELGVEGSEPG

SEQ ID NO: 21176 - protein, 82 aa, Arabidopsis thaliana
MASSRLSSADVVTSPAQATMVAPFTGLKSSAAFPVTRKTNRDITSIAGNGGRVTCMNVWPSVGQKKFETLSHVPDLSDGRIG

SEQ ID NO: 21177 - protein, 356 aa, Ashbya gossypii
MVEEVPDVTRILGGIYVGSVKPIVNHTPLKGMFNITHILSVLKFTVIPESLVIKGYSLKNIAIDDDESTDILQYINESNRFIDQCLFPHEEEYDPRKVDFRKKKQHGSVYIHCQAGVSRSVSFTIAYLMYRYGLDLKSALHAVKRRRPEAQPNDGFMEQLRIFEEMGGQYVDTALPRYRHWVLQASLQADPTGSGILAREETYRGDGEEDLQSLSTEDRHKLTMLRCKKCRQRLALSTAFIQHEPPSAESSEGHFIRRAAGSRRIIDIQQSQDQCSHFFVEPLNWMKAELQGKQELEGKFSCPNCTQKVGGYNWKGSRCSCGKWMIPAIHLQAVKVDQVDAARLALPNPVNFETKQ

SEQ ID NO: 21178 - protein, 257 aa, Pseudoroegneria spicata
CELDNIMRLTGITGIVNGMDVSEWDPTKDRFLAVNYDVTTALEGKALNKEALQAEVGLPVDRKVPLVAFIGRLEEQKGPDVMIAAIPEIVKDEDVQIILLGTGKKKFERLLKSVEEKFPGKVRAVVRFNAPLAHQMMAGADMLAVTSRFEPCGLIQLQGMRYGTPCACASTGGLVDTIVEGKTGFHMGRLSVDCNVVEPADVKKVATTLKRAIKVVGTPAYHEMVKTCMIQDLSWKGPAKNWEDVLLELGVEGSEPG

SEQ ID NO: 21179 - protein, 336 aa, Oryza sativa
MAVPLVLVVLPLGLLFLLSGLIINAIQAVLFLSIRPFSKSLYRRINRFLAELLWLQLVWLVDWWAGVKRSGCLGSTLAVMKKSSKFLPVIGWSMWFAEYLFLERSWAKDEKTLKWGLQRLKDFPRPFWLALFVEGTRFTPAKLLAAQEYAVSQGLPAPRNVLIPRTKGFVSAVTIMRDFVPAIYDTTVIIPKDSPQPTMLRILKGQSSVVHVRMKRHAMSEMPKSEDDVSKWCKDIFVAKDALLDKHLATCTFDEEIRPIGRPVKSLLVTLFWSCLLLYGAVKLFLWTQLLSTWKGVGFTGLGLALVTAVMHVFIMFSQSERSSSAKAARNRVKKD

SEQ ID NO: 21180 - protein, 439 aa, Nicotiana tabacum
MQQPHHQQRELPFTSSKPPLGDYHRFSTDPLQQPEAILVKSTPLKRKSETTNYKQGVGAQITDSGYADVSSPMQTPISGKVGKAQKVPRTSKARSASQAATSNLGSPSGNNATPVGPCRYDSSLGLLTKKFINLIKHAEDGILDLNKAADTLEVQKRRIYDITNVLEGIGLIEKKLKNRIQWKGLDVSRPGEVDDSVTSLQAEVENMTIEERRLNEQTREMQERLTDLCEDENNQRWLLVTEDDIKSLPCLQNETLIAIKAPHGTTLEVPDPDEAVDYPQRRYRIVLRSTMGPIDVYLVSQFEEKFEEINAVEAPSAMPSTSGFNENDTATLPTEENGGVDGRIDEKENQSVCADVGTSQDFASGIMKIVSDVDNEEDYWLLSDADVSITDIWRADSVLDWNELNVIHEDYSIANVSTPRAQTPPSSTTELPSANTTGS

SEQ ID NO: 21181 - protein, 335 aa, Unknown
  Erythrobacter sp. NAP1
MSTSIGVIGAGAWGTALAQMLASDGREVLLWAYESEVVDAINSDRRNPQYLPSAQLAKTIRATGDLADFAEIEIALVVTPAQLLGKVLSVLDKSPRDLVLCSKGIEAGTGRLMNDVAREAAPGSEIAVLSGPTFAHEVASGLPTAVTLACEGGREQWERLSPAIARPAFRPYYSDDVTGAEIGGSIKNVLAIACGVVEGLKLGQNARAALIARGYAEMLRFGETMGAQAETLAGLCGLGDLVLTCSSTSSRNFSLGKALGEGEKAADLMADRTTVAEGAHTAPVLASLAKERDIAMPIVIAVNAILDGSAPEAVVAELLSRPLRAETPSDQGDVE

SEQ ID NO: 21182 - protein, 211 aa, Triticum aestivum
AQCCDLDIPSRPKGLEDPERLARETVFNVNEIEALYELFKKISSAVVDDGLINKEEFQLALFKTNRKDSMFADRVFDLFDTKHNGILEFEEFARALSVFHPSAPIDDKIDFAFKLYDLKQQGFIEKQEVKQMVVATLAESGMNLSDDIIEGIIDKTFEEADTKHDGKIDKEEWRSLVLRHPSLLKNMTLPYLRDITTTFPSFVFNSQVEDA

SEQ ID NO: 21183 - protein, 362 aa, Glycine max
MEDGAGRGLECPKTMDGKASNGNGLEKEIPSCCLKAKASIPESEAKCHSTVVSGWFSASQTCSGKSGKAVYFNNPMWPGEAHSIKVEKILYKEKSEYQEVLVFESSTYGKVLVLDGIVQLTEKDECAYQEMIAHLPLCSIHSPKNVLVVGGGDGGVLREVARHSSVEHIDICEIDKMVIDVSRKFFPQLAVGFEDSRVHLHVGDAVDFLKSAPEGKYDAIIVDSSDPVGPAQELVEKPFFDTIARALRPGGVLCNMAESMWLHTHLIQDMISICRETFKGSVCYAWASVPTYPSGMIGFLLCATEGPPVDFVNPINPIEKLEGANEHKRELQFYNSEMHSAAFALPAFLKREVSLLRDLSLQ

SEQ ID NO: 21184 - protein, 248 aa, Unknown
  Synechococcus sp. CC9311
MSIVGAGPGAPDLLTRRAENRLKSAQVLIWTDSLVSPQIAALAPDHCETIRSSTLTLEDVLPLMIDRAKKGLEVVRLHDGDPCLYGALSEQICGLTDAGISVDVVPGISAYQATASALGAELTIPGLVQTIVLGRAGGRTGVPETESLENLARLKASLCLYLSARHVEEVQATLLKHYSPDTPVAIGHRVSWPDEWLQVVPLDRMAAISQEQNLIRTTLYVVSPALNAGRQRSKLYSPDHDHLFRPSR

SEQ ID NO: 21185 - protein, 572 aa, Schizosaccharomyces pombe
MKDNQQAVQLQQPTTIGHYLAVRLAQAGVKHHFVVPGDYNLGLLDKLQYNNYLEEVNCANELNCAFAAEGYARANGIAACVVTYSVGAFTAFDGIGGAYAEDLPVILISGSPNTNDIGSSHLLHHTLGTHDFSYQYEMAKKITCAAVSIQRPTEAPRLIDYAIKMALLKKKPVYIEVPTNVASQPCAAPGPASLITEPETSNQEYLQMAVDISAKIVNGKQKPVLLAGPKLRSFKAESAFLELANSLNCSVAVMPNAKSFFPESHPNYAGIYWGQASTLGAESIINWSDCIICAGTTFTDYSSNGWTSLPPKANVLHVDVDRVTVSDAEFGGVLLRDFLHELAKKVKANNASVVEYKRIRPESLEIPMENPKAALNRKEIIRQVQNLVNQETTLFVDTGDSWFGGMRITLPEKARFEIEMQWGHIGWSVPSAFGYAIGAPKRNVVVFVGDGSFQETVQEVSQMVRLNLPIIMFLINNRGYTIEVEIHDGPYNRIKNWDYAAIVEAFNAGEGHAKGFRVGNGHELAEAIRQAKENSQGPTLIECNIDQDDCSKELINWGHNVGAANGKPPAKE

SEQ ID NO: 21186 - protein, 713 aa, Bacillus cereus
MLKVKRPFDAYLDEMNKITILLPHAYGTSRTFRLQEGSNVKDLPIAHTIALPDATKYECFIEEPLDVGKYYTVRDERNEETDLQIGAVIRTAIFDEKYYYEGTDLGAVHKKEATTFKVWAPTARLAKVRIYKSDKEYIDHEMYREANGVWAHTLQGDLAGEKYTFLVCINLIWNEAVDPYAKSVTVNGKYGVVIDLEKTNVTKRGQLPPLQAMTDAILYELHIRDATIHPNSGVSKKGTYKGLMEEGTTGQNGTLTGLSHIKDLGVTHVELLPLYCFGGVDEANPSSAYNWGYNPLYYNTPTGFYATNPSDPYNRIVECKQLIETFHEHGIRVIIDVVYNHVYERELSSFEKLVPGYYFRHGENGMPSNGTGVGNDIASERKMMRKFIVESILYWLTEYNVDGFRFDLMGILDVDTINIIEKEVRNIKRDALLLGEGWDLQTPLPLEEKATLNNAKKMPHIAQFNDQFRDGIKGSTFHINKRGFAFGGYVDCHHLQYIASGSLLSMKETGLFLEPAQSINYVECHDNMTMWDKLMRSNEESEEILKKRHLLATAMVILSQGIPFLHAGQEFYRTKQGNENSYNANDEINQLDWDRKEKEIETVNYIKGLIAIRKEHGAIRLQNADLIKKYMTFLQTSPEVLAYHLEGVESFGPWKEIVVLFNSGLEAKTVQLPKEETWHVLVNEKQAKIEPISSFRGKELRLAPISTYILTIM

SEQ ID NO: 21187 - protein, 257 aa, Bacillus licheniformis
MGKVYIVGAGPGDPDLLTIKALKAIQTADVILYDRLVNKQILQHAKEGADLIYCGKLPDYHMMKQETINHFLVKYAKKGKTVVRLKGGDPFVFGRGGEEAQTLAEHGVAFEIVPGITSGIAAAAYAGIPVTHREASSNVAFVTGHYQKEENFEEKWKALATGIDTLVIYMGIKNVKQIERLLIENGRDPSTPAAFIHWGTTDKQKTVLCTVETLAGTVESEKIENPSLIVIGDVVQFSSQLSWFEPELKDPALSEAL

SEQ ID NO: 21188 - protein, 303 aa, Methanothermobacter thermautotrophicus
MMTDYDMIVIGAGPAGLTAGIYGGRQGSSVLMLDKGPAGGLGLEVPMMENYPGFEMIAGMSLVTKMKKQATAVAELREMEEVKEIEKGDVFTVKTSRDTYTASAIIFATGSKHRQLGVPGENDLLGRGVCYCATCDGPLYKGRKVLMVGGGNSAAQEAVFLKNIGCDVSIVHRRDELRADKYLQDKLREMEIPVIWNSVVKEIGGDERVEEVIIHNRVTGRDETLKVDGVFIAIGEEPLNQLAVDLGVEVDKGGYIITDKFQRTNVPLVYAAGDITGGLNQWVTACAEGAIAATYAYREIQSY

SEQ ID NO: 21189 - protein, 201 aa, Glycine max
ADPEEMGLKDLVKPHVYDILTPLACAIVSSHGNDHVNSYVLADSSLFVYGYNTIILTCVTTKLLLAIPPILKVAEVLSLNVRSVNYTARTYIFPGAHAYPHLNYSDEVAILDGYYGKIMAGSNAYIMCGQYSAPNWYVYSASADSATPSYNADTLKKSMTGLYREQAPASDNKPAASAVIMTVNYGNIRNLPYAESCDSDY

SEQ ID NO: 21190 - protein, 108 aa, Aspergillus fumigatus
MSHGKVIAVDNPIIYKALTSSGPVVVDFFATWCGPCRAVAPKVGELSEKYSNVRFIQVDVDKVRSVAHEMNIRAMPTFVLYKDGQPLEKRVVGGNVRELEEMIKSISA

SEQ ID NO: 21191 - protein, 135 aa, Escherichia coli
MRLLHTMLRVGDLQRSIDFYTKVLGMKLLRTSENPEYKYSLAFVGYGPETEEAVIELTYNWGVDKYELGTAYGHIALSVDNAAEACEKIRQNGGNVTREAGPVKGGTTVIAFVEDPDGYKIELIEEKDAGRGLGN

SEQ ID NO: 21192 - protein, 105 aa, Crocosphaera watsonii
MALKKQFSTFEEMLSTSTVPILIDFYATWCGPCQMMSPILEQVGTQMRSRVQVVKIDTDKYPGIASKYGIQSLPTLVLFKEGQPVEKFEGVMQASQLIQHLNLLV

SEQ ID NO: 21193 - protein, 72 aa, Desulfitobacterium hafniense
MSKEDVIEVEGKVLEPLPNAMFLVELSNGHKVLAHVSGKIRMNFIRILPGDRVTVELSPYDLSRGRIVYRFK

SEQ ID NO: 21194 - protein, 175 aa, Secale cereale
MAPTVMASSATSVAPFQGLKSTAGLPVSRRSNGASLGSVSNGGRIRCMQVWPIEGIKKFETLSYLPPLTTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 21195 - protein, 437 aa, Arabidopsis thaliana
MGKECYYLSWILKFHLLLVLIQLVDSGSTIRFLPGFQGPLPFELETGYIGVGEAEKDQMFYYFIKSESNPEKDPLLLWLSGGPFCSSFTALIYENGPIAFKAEEYNGSIPSLVSTTYAWTKVASILYLDQPVGTGFSYSRNPLADIPSDTGVAKPVNEFLHKWLDKHPEFLSNPLYVAGNSYSGIVIPTIVQEISNGNHLDSKPQINLQGFVLGNPATDTDIDLNSRIPFAHGKALISDEHYESLKRSCQGNYISVNPRNTKCLKLLEDFKKCVSGISEEYILKPDCMWLYSCMANLHSLSEYWANEKSVRKALLVNEGTVRKWIRCNTEIAYNKDIRSSVPYHKYISIEGYRSLVFSGDHDMLVPFLGTQAWIRSLNYSIVDDWRPWMVQNQVAGYTRTYANKMTFATVKGGGHTSEYKPVETYIMIKRWLSGQPL

SEQ ID NO: 21196 - protein, 492 aa, Xanthomonas axonopodis
MTAKPRLDFWQIWNMCFGFLGIQFGFALQNANASRIFQTLGAQVDDVPGLWIAAPLTGLVVQPVIGYLSDRTWTPWGRRRPYFMVGAVFTTLALLVMPNAPMLWVAAGTLWVLDASINISMEPFRALVGDQLPPSQRPTGYAMQSFFIGIGAIVASFLPWLLTHWGIANTAPPGQLPDSVRYAFYLGAAVLFLSITWTVLRTREYSPEQLAGFDDAHPPLAQAVSTGMVPTSMASVLWCGLGVLLAAAIAWQHGDRMLYVLAGLCFAYGVLLALARMLPATSMLVAIVQDVRSMPMTMRRLAWVQFFSWFALFAMWIYTTAAVTQVHFGASDTASAAYNDGANWVGVLFGAYNGFAALAAVVIPLLVRAIGLRWSHLCNLWLGAAGLLSMLVIRDPQWLLLSMLGVGFAWASILSLPYALLSDSVPAPKMGVYMGIFNFFIVIPQLVAASALGFVLRVWLGGQPIYALAIGGLSLLIAGVCVVRVPVASGGQ

SEQ ID NO: 21197 - protein, 262 aa, Pyrococcus furiosus
MVKVAYVQMEPKILELDKNLSKAEKLVKEAAKREAKLIVLPELFDTGYNFESRDEVFEIAQRIPEGETTTFLMDLAGDLEVYIVAGTAEKYNDRLYNSAVLVGPTGYLGKYRKIHLFYREKVFFDPGDLGFNVFDLGFIRVGIMICFDWFFPESARTLALKGADIIAHPANLVMPYAPRAMPIRALENRVYIITADRVGEERGLRFIGKSLIASPKAEVLAMGSETEEEVGVAEVDISLVRNKRINDLNDIFKDRRPEYYFR

SEQ ID NO: 21198 - protein, 294 aa, Staphylococcus carnosus
SLGVSKDASKDEIKKAYRKLSKKYHPDINQEEGAEEKFKEISEAYEVLSDENKRANYDQFGHDGPQGGFGGQGFGGGQDFGGFGGGFEDIFSSFFGGGAQRDPNAPRKGDDLQYTMTVTFEEAAFGTEKEISIRKQVKCETCDGSGAKPGSKKKTCHYCNGSGHVSVEQNTILGRVRTEKVCPVCNGTGEEIEEPCPTCHGKGTETKNVKIKVKVPEGVDNDQQIRLAGEGAPGHNGGPQGDLYVVFRVEPSDTFEREGDDIFYNLNVSFPQAALGDEIKVPTLKGHVMLSVPE

SEQ ID NO: 21199 - protein, 558 aa, Bacteroides fragilis
MCGIAGIFNIKIQSRELRNKALRMARKIRHRGPDWSGMYCGGSAILAHERLSIVDPQSGGQPLYSSDRKQVLAVNGEIYNHRDIRAQYAGRYEFRTGSDCEVILALYRDKGIHFLEELNGIFAFALYDEEKDEYLIARDPIGVIPLYIGKDAEGHVYFGSELKALEGFCDEYEPFLPGHYYHSKERTMKRWYTRDWMEYKEENDKQADSRSPTRQIQDALENAVHRQLMSDVPYGVLLSGGLDSSVISAIAKKYAAKRIETDGASDAWWPQLHSFAIGLKGAPDLIKAREVAEYIGTVHHEINYTLQEGLDAIRDVIYFIETYDVTTVRASTPMYLLARVIKSMGIKMVLSGEGADEIFGGYLYFHKAPDARAFHEETVRKLSKLHLYDCLRANKSLAAWGVEGRVPFLDKEFLDVAMQLDPEIKMAPGKVIEKKVLREAFADMLPSGIAWRQKEQFSDGVGYSWIDTLKEITATAVSDEQMAHAAERFPIHTPMNKEEYYYRSIFEEHFPSESAARSVPSIPSVACSTAEALAWDTTFKNLNDPSGRAVKGVHEEAY

SEQ ID NO: 21200 - protein, 293 aa, Staphylococcus chromogenes
VLGVDKNASKDEIKKAYRKLSKKYHPDINKEEGSDAKFKEISEAYEVLSDEQKRKQYDQFGHAGAQGGFNQGFGGQDFSGFGGAGFEDIFSSFFGGQRQRDPNAPRKGDDLQYSMTVTFEEAVFGTNKEITVRKDVTCHTCDGDGAKPGTKKKTCSYCKGSGHVSVEQNTILGRVRTEKVCPQCNGSGEEFEEACPTCHGRGTETKNVKIQVTVPEGVDNDQQIRLAGEGAPGENGGPAGDLFVVFRVKPSDKFTRDGDDILYKQSISFAQAALGDEIKVPTLNGQIMLTVPA

SEQ ID NO: 21201 - protein, 293 aa, Staphylococcus cohnii
ILGVSKDASKDEIKKAYRKLSKKYHPDINKEEGADEKFKEISEAYETLSDENKRANYDQFGHDGPQGGFGGQGFGGQDFSGFGGGFEDIFSSFFGGGRQRDPNAPRKGDDLQYTMTVTFEEAVFGTSKEISIRKDVTCHTCDGEGAKPGTKKKTCHYCNGSGHVAVEQNTILGRVRTEKVCPVCSGSGQEFEEPCPTCHGKGTENKTVKINVTVPEGVDNEQQIRLAGEGAPGENGGPQGDLYVVFRVKPSETFEREGDDIYFSQDISIAQATLGDEIKVPTFKGHVMLTIPG

SEQ ID NO: 21202 - protein, 113 aa, Zea mays
MAEKETWHETLHSGFGQYFSVDNLLYRDKTAHQDLVIFENAAFGRVMALDGVVQTTERDEFIYHEMMTHVPILAHGNARRVLIIGGGDGAMLREVARHQSVEHITMVEIDAGV

SEQ ID NO: 21203 - protein, 953 aa, Bacteroides fragilis
MKYLTFPFLLLLLPLIGFGCSSEEKETDSLILSSDSEIFFEQGIDFAATSGTRNLSFSSGRPWRISLTTDTDTRRAADWCTVSPSSGTAGDASVTISIQENADYDSRSVKLTLVAGGIEKSFTVSQKQKDALTLTASRFEVGKEGGTVQVEVKANITFEVEIPEVDRSWISQANTRGLVVTNLAFTVAPNEGVAGREGEIVIRSGSLSEKIRITQEGRCDDGLSFRPETPDADRQLTLYFKATKTSPLYGYAGDVYVHTGVVSEGTWMYVPAEWNTNVDKCKMVRVADNIWSITLAPSIRQWFGSNETPVRQLGVVIRSADGSKKGTDGDSFVSVTDHLYKPFEPAAVRYASMPSGLQEGINLIDASTVTLVLYDKDKKGGHKDFAHVVGDFNDWKLSNESNSQMNRDDAAGCWWITLTGLQPTREYAFQYYVGTRAGEILRLADAYSRKILDPDNDKYIPSSTYPDAKEYPTGAVGIASVFKIQGDSYDWKVKNFRIPDKNNLMIYELLLRDFTATGDLNGAMEKIGYLKSLGFNAVELMPVQEFDGNDSWGYNPCFYFALDKAYGTDHMYKAFIDKCHEAGMAVLFDVVYNHASGSHPFARLYWDTKNNRTAADNPWFNVKEPHPYGVFHDFNHDSPLVRAFVKRNLKFLLEEYRIDGFRFDMTKGFTQNSSTEATAGSYDASRIAILKDYNETVREVNPEAVVILEHFCDEKEESELAEEGMQLWRNLNHAYCQSAMGYPSNSDFTPLVTFGTTMPYGGWVGFMESHDEERTAFKQIAYGEGPLKSDINVRMKQLAANASFFFTAPGPKMVWQFGEMGYDVSIEEGGRTGRKPLHWEYLDNEARKGLCNTYAKLLKLRREHSELFNPGSTFSWLVKTANWTGGRFLTLAATNGKRLVVVGNFTAKPIEAITSFPVTGVWTNYLDGTKLHVTSIPTGLTIPAHECRVYINF

SEQ ID NO: 21204 - protein, 293 aa, Staphylococcus cohnii
ILGVSKDASKDEIKKAYRKLSKKYHPDINKEEGADEKFKEISEAYETLSDENKRANYDQFGHDGPQGGFGGQGFGGQDFSGFGGGFEDIFSSFFGGGRQRDPNAPRKGDDLQYTMTVTFEEAVFGTNKEISIRKDVTCHTCDGEGAKPGTKKKTCHYCNGSGHVAVEQNTILGRVRTEKVCPVCSGSGQEFEEPCPTCHGKGTENKTVKINVTVPEGVDNEQQIRLAGEGAPGENGGPQGDLYVVFRVKPSETFEEMATIFTFHKILVLRKQRLGDEVKVPTLKGHVMLTIPW

SEQ ID NO: 21205 - protein, 153 aa, Narcissus pseudonarcissus
MCGGAIISDFIPPSRSRKLTADYLWPNLNKGKDKKKSFGFEDDFEADFNEFEDESEEGESEAVDVKPFKFGAKAGFSREGSTYLKPIELNGAAERSSKRKRKNQYRGIRQRPWGKWAAEIRDPNKGVRVWLGTFNTAEEAARAYDDEARRIRG

SEQ ID NO: 21206 - protein, 146 aa, Magnetospirillum magnetotacticum
MEYLHTMVRVADLDRALAFYVDTFGLKEVRRVENEKGRFTLVFLAAPGDVARAEAEKSPLIELTYNWDPEEYSGGRNFGHLAYQVDDIYAFCQRLKEAGVTINRPPRDGHMAFVRSPDGISIEILQKGGAKPPQEPWASMENTGSW

SEQ ID NO: 21207 - protein, 297 aa, Staphylococcus condimenti
VLGVSKDASKDEIKKAYRKLSKKYHPDINQEEGAEEKFKEITEAYEVLSDENKRANYDQFGHDGPQGGFGGQGFGGGQDFGGFGGGFEDIFSSFFGGGAQRDPNAPRKGDDLQYTMTVTFEEAAFGTEKEISIRKQVKCETCEGSGAKPGSKKKTCHYCNGSGHVSVEQNTILGRVRTEKVCPVCNGTGEEIEEPCPTCHGKGTETKNVKIKVKVPEGVDNDQQTPFSRGKRSRTQWRTSRRLIRCIPCRTFFYFSTEGDDIFYNLTVSFPQAALGDEIKVLPLKGHVMLSVPEGPN

SEQ ID NO: 21208 - protein, 438 aa, Bacteroides fragilis
MKVKPDLSFWKLWNISFGFFGVQIAYALQSANISRIFATLGADPHSLSYFWILPPLAGIIVQPIIGAASDKTWTRFGRRIPYLFAGSLLAVWVMCLLPNAGSFGMAVGTAMIFGLVALMFLDTSINMAMQPFKMLVGDMVNEKQKGLAYSIQSFLCNAGSLMGYLFPFIFTFIGISNTADKGTVPDSVIYSFYIGAAILILCVIYTTVKVKEMPPKEFEEFHGITADEKKEKADFISLLKHAPKVFWTVGLVQFFCWAAFMYMWTYTNGAIAATVWGTTDVQSAGYQEAGNWVGVLFAVQAIGSVIWAVILPLFKARKQAYAFSLVLGGIGFISTLFFHNEYLLFISYLLIGCAWAAMLAMPFTILTNSVSGKNMGAYLGLFNGTICVPQIAAALVGGGLLHLVGGHQVNMLVLAGVLLIAGAVCVYFIKETMAHHEA

SEQ ID NO: 21209 - protein, 1000 aa, Methanosarcina acetivorans
MCGLKKRLFIDCYEGESIEEIRGKKRADREETEVQEKSHLEEKLVRLEWQADSAVTGLITMDFDGTLSYVNPFFVRMWGYGSAEEPPGRQVSELWASPAEFLQAERECREKGEWIGELQARRRDGTFFYVHTSLSLIRNREGLPLGISGSFVDITRLKQVEEELRNRTLELSEAKARLDLALEATEMGTWDWDVLTNGMTWDDNLFRLVGISREEFLQTHDSLLELSNRILSPEDNRRMLEVMQAVADGKTDSYEFEHDVLRPDGTVRHFLVKGRAHRDSEGKLLRVTGTTTDITDQKIAEDALRRSEANLARSQAMAHLGSYSFDAHTGEIYWSEELKTIWDYDPGPNYSFETVISRIHPEDRKRILEALKNAGQGKHPFNSEYGILKPDGSIRYVHDQGEISLDGNGVPVRMFGTLQDITHRKLMEEQLLKAKEAAESANKAKGDFLANMSHEIRTPMNAVLGMLEMLLETSLTDEQREYLQLAHASAESLLSIIDDVLDFSKIEQNKLELEQISFELESLISHIINLLSGKAGSKGLKLAFHIEKDLPSTFIGDPVRLKQVLFNILGNAIKFTKKGEIALSVEVYMPSERNSGLSNSDFPEEVALLFKVKDTGIGIPPEKLSQIFDPFIQADASVTREYGGTGLGLAISSQLVELMEGRIWVESEVGKGCTFYFTVRVKRGESSENYGQGNNIPEESLLVCMEAKESYGNGITSGESLNVLFAEDHPINQKLILGLLEKKGHKLTLVTSGKDALDALSRRDFDAVLMDIQMPGMDGLEATRRIRDPSSGVRRHNIPIIAFTARALKEDREKCFEAGMNYYISKPLKKEKLLNILEDIRVGKNTREKTARERTVQDRIVQEKNIQERAATPLDLESIAFDFPEDQVFNLEEVLERTEGDEVLLKEMVKIFLGMAPELLDSINSALRKGEAEALRENAHILKSAAGSIGANRVFRVAYYLEQVGRRDRMELASDKFEEIKARFKELEPVLVRYLEKQIC

SEQ ID NO: 21210 - protein, 388 aa, Salmonella enterica
MKHLHRFFSSDASGGIILIIAAALAMLMANMGATSGWYHDFLETPVQLRVGALEINKNMLLWINDALMAVFFLLIGLEVKRELMQGSLASLRQAAFPVIAAIGGMIVPALLYLAFNYSDPVTREGWAIPAATDIAFALGVLALLGSRVPLALKIFLMALAIIDDLGAIIIIALFYTSDLSIVSLGVAAFAIAVLALLNLCGVRRTGVYILVGAVLWTAVLKSGVHATLAGVIVGFFIPLKEKHGRSPAKRLEHVLHPWVAYLILPLFAFANAGVSLQGVTMDGLTSMLPLGIIAGLLIGKPLGISLFCWLALRFKLAHLPQGTTYQQIMAVGILCGIGFTMSIFIASLAFGNIDPELINWAKLGILIGSLLSAVVGYSWLRARLNAPA

SEQ ID NO: 21211 - protein, 189 aa, Unknown
  Candidatus Kuenenia stuttgartiensis
MWRINDVEKDVARVVISEKQIKEKLVELSNTLINTYQNKEWTIIAILNGSLVFLADLIRHIPFSIRLDTIDASSYGDSTISKGEVNIIHNFKIDIEGKHVLVIDDIVDTGNTLKKVLADIKKYAPASLKSCVLLSRSGRRQNKIKPDYCCFNVGDDFVVGYGLDYNNKYRNLPYIAVLKDECYRRNGCP

SEQ ID NO: 21212 - protein, 1065 aa, Bacillus cereus
MDKKVSAIPQPKTYGPLGNLPLIDKDKPTLSFIKIAEEYGPIFQIQTLSDTIIVISGHELVAEVCDETRFDKSIEGALAKVRAFAGDGLFTSETQEPNWKKAHNILMPTFSQRAMKDYHAMMVDIAVQLVQKWARLNPNENVDVPEDMTRLTLDTIGLCGFNYRFNSFYRETPHPFITSMTRALDEAMHQLQRLDIEDKLMWRTKRQFQHDIQSMFSLVDNIIAERKSSGNQEENDLLSRMLHVQDPETGEKLDDENIRFQIITFLIAGHETTSGLLSFAIYFLLKNPDKLKKAYEEVDRVLTDPTPTYQQVMKLKYIRMILNESLRLWPTAPAFSLYAKEDTVIGGKYPIKKGEDRISVLIPQLHRDKDAWGDNVEEFQPERFEDLDKVPHHAYKPFGNGQRACIGMQFALHEATLVMGMLLQHFEFIDYEDYQLDVKQTLTLKPGDFKIRIVPRNQNISHTTVLAPTEEKLKNHEIKQQVQKTPSIIGADNLSLLVLYGSDTGVAEGIARELADTASLEGVQTEVAALNDRIGSLPKEGAVLIVTSSYNGKPPSNAGQFVQWLEELKPDELKGVQYAVFGCGDHNWASTYQRIPRYIDEQMAQKGATRFSTRGEADASGDFEEQLEQWKESMWSDAMKAFGLELNKNMEKERSTLSLQFVSRLGGSPLARTYEAVYASILENRELQSSSSERSTRHIEISLPEGATYKEGDHLGVLPINSEKNVNRILKRFGLNGKDQVILSASGRSVNHIPLDSPVRLYDLLSYSVEVQEAATRAQIREMVTFTACPPHKKELESLLEDGVYHEQILKKRISMLDLLEKYEACEIRFERFLELLPALKPRYYSISSSPLIAQDRLSITVGVVNAPAWSGEGTYEGVASNYLAQRHNKDEIICFIRTPQSNFQLPENPETPIIMVGPGTGIAPFRGFLQARRVQKQKGMNLGEAHLYFGCRHPEKDYLYRTELENDERDGLISLHTAFSRLEGHPKTYVQHVIKEDRMNLISLLDNGAHLYICGDGSKMAPDVEDTLCQAYQEIHEVSEQEARNWLDRLQDEGRYGKDVWAGI

SEQ ID NO: 21213 - protein, 369 aa, Prochlorococcus marinus
MSENPASKIEEKNPEKETSIPEETVSNATIAEFEENSITELKEDDIPKNIPAADDSSSRINKSDLETAGFTLDEFASLLSKYDYNFKPGDIVNGTVFALESKGAMIDIGAKTAAFMPMQEVSINRVEGLSDVLQPSEIREFFIMTEENEDGQLSLSIRRIEYQRAWERVRQLQKEDATIYSEVFATNRGGALVRVEGLRGFIPGSHISTRKAKEELVADFLPLKFLEVDEERNRLVLSHRRALVERKMNRLEVGEVVVGAVRGIKPYGAFIDIGGVSGLLHISEISHEHIETPHSVLNVNDQMKVMIIDLDAERGRISLSTKALEPEPGDMLTDPQKVFDKAEEMAARYKQMLLEQAEEGEDPIAVMTI

SEQ ID NO: 21214 - protein, 468 aa, Mycobacterium avium
MRIAQHISDLIGGTPLVRLNSVVPDGAGIVAAKVEYLNPGGSSKDRIAVRMIDAAEASGALKPGGTIVEPTSGNTGVGLALVAQQRGYKCVFVCPDKVGEDKRNVLMAYGAEVVVCPTAVPPEHPDSYYSVSDRLVTEIEGAWKPDQYANPEGPASHYATTGPEIWADTDGKVTHFVAGIGTGGTITGAGRYLKEVSGGRVRVIGADPEGSVYSGGTGRPYLVEGVGEDFWPQAYDRTVPDEIIAVSDSDSFNMTRRLAREEAMLVGGSCGMAVVAALRVAEQAGPDALVVVLLPDGGRGYMAKIFNDAWMSSYGFLRTRLDGSTDQSRVGDVLRRKSGELPDLVHTHPSETVRDAIGILREYGVSQMPVVGAEPPVMAGEVAGSVSERELLSAVFEGRAKLADAVSLHMSPPLPMIGAGESVSAAGKALRDWDALMVVEEGKPVGVITRYDLLGFLSEGPRGSGGRR

SEQ ID NO: 21215 - protein, 257 aa, Pseudoroegneria spicata
CELDNIMRLTGITGIVNGMDVSEWDPTKDKFLAVNYDVTTVLEGKALNKEALQAEVGLPVDRKVPLVAFIGRLEEQKGPDVMIAAIPEIVKDEDIQIVLLGTGKKKFERLLKSVEEKFPGKVRAVVRFNAPLAHQMMAGADVLAVTSRFEPCGLIQLQGMRYGTPCACASTGGLVDTIVEGKTGFHMGRLSVDCNVVEPADVKKVATTLKRAIKVVGTPAYHEMVKNCMIQDLSWKGPAKNWEDVLLELGVKGSEPG

SEQ ID NO: 21216 - protein, 245 aa, Dehalococcoides ethenogenes
MPTTNIKELLEAGAHFGHQTSRWHPRMKKYIFTKRNGIHIIDLEKTVVMLDKACNYINQVVSEGGKVLFVGTKKQAQEILAEEAKRCGMYFINQRWTGGILTNFHSIQSRIDYLVRLEDQQARGDFNRLPKKEAQKLAEEIARLNRTMGGFKEMTRLPDVIFVVDPTKEKIAMAEAKRMGVPLVAMVDTNCNPDEVDYPIPSNDDAMRAIKLICSKMADSVIEAQNALKVTEVETTGEAQAETAG

SEQ ID NO: 21217 - protein, 70 aa, Mycoplasma gallisepticum
MKETNLSIKGVVKEIIKGDKFKVLLENNLLIEAHVSGKIRMHKIRILPGDSVEVEFSPYDLTKGRIIYRH

SEQ ID NO: 21218 - protein, 998 aa, Pyrus pyrifolia
MLLFLPLLLLLLPPLPTTLSLNQEGLYLQHFKLSLDDPDSALSSWNDADSTPCNWLGVSCDDASSSYPVVLSLDLPSANLAGPFPTVLCRLPNLTHLSLYNNSINSTLPPSLSTCQNLEHLDLSQNLLTGGLPATLSDVPNLKYLDLTGNNFSGPIPDSFGRFQKLEVLSLVYNLIESTIPPFLGNISTLKMLNLSYNPFHPGRIPAELGNLTNLEVLWLTECNLVGEIPDSLGRLKNLKDLDLAINGLTGRIPPSLSELTSVVQIELYNNSLTGELPPGMSKLTRLRLLDASMNQLSGQIPDELCRLPLESLNLYENNLEGSVPASIANSPNLYEVRLFRNKLSGELPQNLGKNSPLKWFDVSSNQFTGTIPASLCEKGQMEEILMLHNEFSGEIPARLGECQSLARVRLGHNRLSGEVPVGFWGLPRVYLMELAENELSGPIAKSIAGATNLSLLILAKNKFSGPIPEEIGWVKNLMEFSGGDNKFSGPLPEGIARLGQLGTLDLHSNEVSGELPVGIQSWTKLNELNLASNQLSGKIPDGIANLSVLNYLDLSGNRFSGKIPFGLQNMKLNVFNLSYNQLSGELPPLFAKEIYRSSFLGNPGLCGDLDGLCDGRAEVKSQGYLWLLRCIFILSGLVFIVGVVWFYLKYKNFKKANRTIDKSKWTLMSFHKLGFSEYEILDCLDEDNVIGSGASGKVYKVILSSGEVVAVKKLWRGKVQECEAGDVEKGWVQDDGFEAEVETLGRIRHKNIVKLWCCCTARDCKLLVYEYMQNGSLGDLLHSSKGGLLDWPTRFKIALDAAEGLSYLHHDCVPPIVHRDVKSNNILLDGDFGARVADFGVAKEVDVTGKGLKSMSIIAGSCGYIAPEYAYTLRVNEKSDIYSFGVVILELVTGRLPVDPEFGEKDLVKWVCTTLDQKGVDNVVDPKLESCYKEEVCKVLNIGLLCTSPLPINRPSMRRVVKLLQEVGTEKHPQAAKKEGKLTPYYYEDVSDHGSVA

SEQ ID NO: 21219 - protein, 105 aa, Mycoplasma gallisepticum
MNLRIMKHITNKAELDQLLSTNKKVVVDFYANWCGPCKILGPIFEEVAQDKKDWTFVKVDVDQANEISSEYEIRSIPTVIFFQDGKMADKRIGFIPKNELKELLK

SEQ ID NO: 21220 - protein, 293 aa, Arabidopsis thaliana
TRPWFSEISPMWPGEAHSLKVEKILFQGKSDYQDVIVFQSATYGKVLVLDGVIQLTERDECAYQEMITHLPLCSISNPKKVLVIGGGDGGVLREVARHSSVEQIDICEIDKMVVDVAKQYFPNVAVGYEDPRVNLIIGDGVAFLKNAAEGTYDAVIVDSSDPIGPAKELFEKPFFESVNRALRPGGVVCTQAESLWLHMDIIEDIVSNCRDIFKGSVNYAWTSVPTYPSGVIGFMLCSSEGPQVDFKKPVSLIDTDESSIKSHCPLKYYNAEIHSAAFCLPSFAKKVIDSKAN

SEQ ID NO: 21221 - protein, 257 aa, Pseudoroegneria spicata
CELDNIMRLTGITGTVNGMDVSEWDPTKDKFLAVNYDVTTALEGKALNKEALQAEVGLPVDRRVPLVAFIGRLEEQKGPDVMIAAIPEIVKDEDVQIVLLGTGKKKFERLLKSVEEKFPGKVRAVVRFNAPLAHQMMAGADVLAVTGRFEPCGLIQLQGMRYGTPCACASTGGLVDTIVEGKTGFHMGRLSVDCNVVEPADVKKVATTLKRAIKVVGTPAYHEMVKNCMIQDLSWKGPAKNWEDVLLELGVEGSEPG

SEQ ID NO: 21222 - protein, 998 aa, Pyrus pyrifolia
MLLFLPLLLLLLPPLPTTLSLNQEGLYLRHFKLSLDDPDSALSSWNDADSTPCNWLGVECDDASSSSPVVRSLDLPSANLAGPFPTVLCRLPNLTHLSLYNNSINSTLPPSLSTCQTLEHLDLAQNLLTGALPATLPDLPNLKYLDLTGNNFSGPIPDSFGRFQKLEVLSLVYNLIESTIPPFLGNISTLKMLNLSYNPFHPGRIPAELGNLTNLEVLWLTECNLVGEIPDSLGRLKNLKDLDLAINGLTGRIPPSLSELTSVVQIELYNNSLTGELPPGMSKLTRLRLLDASMNQLSGQIPDELCRLPLESLNLYENNLEGSVPASIANSPNLYEVRLFRNKLSGELPQNLGKNSPLKWFDVSSNQFTGTIPASLCEKGQMEEILMLHNEFSGEIPARLGECQSLARVRLGHNRLSGEVPVGFWGLPRVYLMELAENELSGPIAKSIAGATNLSLLILAKNKFSGPIPEEIGWVKNLMEFSGGDNKFSGPLPEGIARLGQLGTLDLHSNEVSGELPVGIQSWTKLNELNLASNQLSGKIPDGIANLSVLNYLDLSGNRFSGKIPFGLQNMKLNVFNLSYNQLSGELPPLFAKEIYRSSFLGNPGLCGDLDGLCDGRAEVKSQGYLWLLRCIFILSGLVFIVGVVWFYLKYKNFKKANRTIDKSKWTLMSFHKLGFSEYEILDCLDEDNVIGSGASGKVYKVILSSGEVVAVKKLWRGKVQECEAGDVEKGWVQDDGFEAEVETLGRIRHKNIVKLWCCCTARDCKLLVYEYMQNGSLGDLLHSSKGGLLDWPTRFKIALDAAEGLSYLHHDCVPPIVHRDVKSNNILLDGDFGARVADFGVAKEVDVTGKGLKSMSIIAGSCGYIAPEYAYTLRVNEKSDIYSFGVVILELVTGRLPVDPEFGEKDLVKWVCTTLDQKGVDNVVDPKLESCYKEEVCKVLNIGLLCTSPLPINRPSMRRVVKLLQEVGTEKHPQAAKKEGKLTPYYYEDVSDHGSVA

SEQ ID NO: 21223 - protein, 197 aa, Arabidopsis thaliana
MRRPKSSHVRMEPVAPRSHNTMPMLDQFRSNHPETSKIEGVSSLDTALKVFWNNQREQLGNFAGQTHLPLSRVRKILKSDPEVKKISCDVPALFSKACEYFILEVTLRAWMHTQSCTRETIRRCDIFQAVKNSGTYDFLIDRVPFGPHCVTHQGVQPPAEMILPDMNVPIDMDQIEEENMMEERSVGEHEAALEDKN

SEQ ID NO: 21224 - protein, 380 aa, Unknown
  Candidatus Kuenenia stuttgartiensis
MKEISDIRYEYIKDTKKIVIKIGTGVITDNAGYLDNKQIKGLAEQVVELKRRNFNVTVVSSGAIGCGMGELGLQKRPGTLPELQAVASIGQSKLISTYDSFFKSHGYHAAQILFTREDFENRKRYLNTCNTIHTLFRMNAIPVVNENDTISTDEIAFGDNDELSALVTNLIDADLLVILSSVDGLYDKQPEGESRAHVIPVVEHITHKTKQMAYNSKTLRGVGGMRTKLEAASIVTNAGEKVIIANGRHENVLLKIFQYEDIGTLFLPKNEKLTSRKRWIGYSKKSKGVVFVDEGACSALSKKGKSLLASGIVSIEGGFEKGDIVSICKGENDGVFARGLTNYSSEEIEKIKGCRASSIHKILGYKSYDEVIHRDNLVLI

SEQ ID NO: 21225 - protein, 257 aa, Pseudoroegneria spicata
CELDNIMRLTGITGIVNGMDVSEWDPTKDKFLAVNYDVTTALEGKALNKEALQAEVGLPVDRKVPLVAFIGRLEEQKGPDVMIAAIPEIVKDEDVQIVLLGTGKKKFERLLKSVEEKFPGKVRAVVRFNAPLAHQMMAGADALAVTSRFEPCGLIQLQGMRYGTPCACASTGGLVDTIVEGKTGFHMGRLSVDCNVVEPADVKKVATTLKRAIKVVGTPAYHEMVKNCMIQDLSWKGPAKNWEDVLLELGVEGSEPG

SEQ ID NO: 21226 - protein, 987 aa, Pyrus pyrifolia
LPTLPTTLSLNQEGLYLQHFKLSHDDPDSALSSWNDADSTPCNWLGVECDDASSSSPVVRSLDLPSANLAGPFPTVLCRLPNLTHLSLYNNSINSTLPPSLSTCQNLEHLDLSQNLLTGGLPATLSDVPNLKYLDLTGNNFSGPIPDSFGRFQKLEVLSLVYNLIESTIPPFLGNISTLKMLNLSYNPFHPGRIPAELGNLTNLEVLWLTECNLVGEIPDSLGRLKNLKDLDLAINGLTGRIPPSLSELTSVVQIELYNNSLTGELPPGMSKLTRLRLLDASMNQLSGPIPDELCRLPLESLNLYENNFEGSVPASIANSPHLYELRLFRNRLTGELPQNLGKNSPLKWLDVSSNQFTGTIPASLCEKRQMEELLMIHNEFSGEIPARLGECQSLTRVRLGHNRLSGEVPVGFWGLPRVYLMELVENELSGTIAKTIAGATNLTLLIVAKNKFWGQIPEEIGWVENLMEFSGGENKFSGPLPESIVRLGQLGTLDLHSNEISGELPIGIQSWTKLNELNLASNQLSGKIPDGIGNLSVLNYLDLSGNRFSGKIPFGLQNMKLNVFNLSNNRLSGELPPLFAKEIYRSSFLGNPGLCGDLDGLCDGRAEVKSQGYLWLLRCIFILSGLVFIVGVVWFYLKYKNFKKANRTIDKSKWTLMSFHKLGFSEYEILDCLDEDNVIGSGASGKVYKVILSSGEVVAVKKLWRGKVQECEAGDVEKGWVQDDGFEAEVETLGRIRHKNIVKLWCCCTARDCKLLVYEYMQNGSLGDLLHSSKGGLLDWPTRFKIALDAAEGLSYLHHDCVPPIVHRDVKSNNILLDGDFGARVADFGVAKEVDVTGKGLKSMSIIAGSCGYIAPEYAYTLRVNEKSDIYSFGVVILELVTGRLPVDPEFGEKDLVKWVCTTLDQKGVDNVVDPKLESCYKEEVCKVLNIGLLCTSPLPINRPSMRRVVKLLQEVGTEKHPQATKKEGKLTPYYYEDVSDHGSVA

SEQ ID NO: 21227 - protein, 347 aa, Aspergillus oryzae
MPRAEAGSTKAISNKIKSKGLQRLRWYCQMCEKQCRDENGFKCHTQSESHVRNALLVGEDPRKYIEEYSKEFLNNFLTQLRTSHQEKAIHANIFYQTIVADKTHIHLNATKWKSLTQFVAYLGREGLCRVEETEKGLFIAYIDRSPEAMRRREALMKKERQDRGDEEREQRQILEQVERARQNADKEEEIDPEARNLQRKEGEKVKLNIGFGSKANGDSKTESPKPQSPEEKDNAASSATPEPAAASASPDSAPTPAPAPAAAPAPAQDAPKPAVKLSMSLGDKKPKNVFAAAAKKNPLAGKKGPVMEAPKKMSEQERIMKQEMEAMEKKRMRGGFGMPNPKRPKLT

SEQ ID NO: 21228 - protein, 257 aa, Agropyron cristatum
CELDNIMRLTGITGIVNGMDVSEWDPTKDKFLSVNYDVTTALEGKALNKEALQAEVGLPVDRKVPLVAFIGRLEEQKGPDVMIAAIPEIVKDEDVQIVLLGTGKKKFERLLKSIEEKFPSKVRAVVRFNAPLAHQMMAGADILAVTSRFEPCGLIQLQGMRYGTPCACASTGGLVDTIVEGKTGFHMGRLSVDCNVVEPADVKKVATTLKRAVKVVGTPAYQEMVKNCMIQDLSWKGPAKNWEDVLLELGVEGSEPG

SEQ ID NO: 21229 - protein, 523 aa, Mycobacterium avium
MSTVEVSAPEAAPPSPGRWRALLLAAVAACAACGIIYELALLTLSASLDGGGIVATSLIVAGYIAALGVGALLAKPLLARAALGFITVEALLGVVGGLSAAALYVVFAFLDGSVGSTWVLAVSTALIGGLVGAEVPLLMTLLQRGRTAGPADAGRTLANLDAADYLGALLGGLVWPFLLLPHLGMIRGAAATGMINLAAAAVVAIFLLRQVVSARQLALALCALAAALALLAGLLLRSADVETTSRQRLYADPIIAYRHTPYQEIVVTRRGDDTRLYLDGGLQFSTRDEYRYTESLVYPALGNGARSVLVLGGGDGLAARELLRQPGISRIVQVELDPAVIEIARSTLRAANGGSLDNPRVRVLTGDAMAWLRGPNPDRFDAVIVDLPDPDTPVLGRLYSTEFYALAAHALAPGGLLVVQAGSPFSTPTAYWRTVSTIRAAGYAVTPYHVHVPTFGDWGFVLAQRGDTPPAPKVPPDAPPLRFLDQRVLQAAVVFSGDVGPRPLEPSTLDNPRIVGDMRHGYD

SEQ ID NO: 21230 - protein, 237 aa, Oryza sativa
  misc_feature (150)..(150): Xaa can be any naturally occurring amino acid
MKGEFVPPWLELLLSTQFFNTCTSHHNSPRNECNLFCIDCQAPEAAFCYYCRSCHHSSHRVIQIRRSSYHDVVKVSELEDILDISDVQTYVINSARVVFLNERPQLRGCGVLAIKSSPSSLSSYNCETCSRVLLDAFRFCSLGCNLIGIXKNDVETVVANDGIAHNDKDIEIDGSNGTANTNGTGKGIEICGNNGTIANTGNEDEICSDASKNKEILSSTRVVRHRRKGIPRRAPFF

SEQ ID NO: 21231 - protein, 256 aa, Agropyron mongolicum
ELDNIMRLTGITDIVNGMDVSEWDPTKDKFLSVNYDVTTALEGKALNKEALQAEVGLPVDRKVPLVAFIGRLEEQKGPDVMIAAIPEIVKDEDVQIVLLGTGKKKFERLLKSIEEKFPSKVRAVVRFNAPLAHQMMAGADILAVTSRFEPCGLIQLQGMRYGTPCACASTGGLVDTIVEGKTGFHMGRLSVDCNVVEPADVKKVATTLKRAVKVVGTPAYQEMVKNCMIQDLSWKGPAKNWEDVLLELGVEGSEPG

SEQ ID NO: 21232 - protein, 232 aa, Brassica napus
SSDCERTTISHRNIAIPMTARAIYVYKSPMNNLFTRLGFGSRPQPDPASAAIAQGPDDDVPSPGQQFAQFGAGCFWGPELAYQRVPGVTRTEVGYSHGFVHDPSYEDVCSGTTGHNEVVRVQYDPKEASFERLLDVFWNRHDPTTLNRQGNDVGTRYRSGIYFYTDEQEKLAREALEKQQKILNRKVVTEILPAKKFYRAEEYHQQYLAKGGSMGRRQSPEKGCTDPIRCYG

SEQ ID NO: 21233 - protein, 464 aa, Solanum pennellii
MARVTLFLLLLLVYGVVSEHFIVETLPGFHGKLPFTLETGYISVGEEEKVQLFYFFVQSERDPRNDPLMIWLTGGPGCSGLSSFVYEIGPLTFDYANSSGNFPKLELNSYSWTKVANIIFIDQPAGTGYSYANTSEAYNCNDTLSVTLTYDFLRKWLMDHPEYLNNPLYVGGDSYSGIFVALLTRKIYDGIEVGDRPRVNIKGYIQGNALTDRSIDFNGRVKYANHMGLISDKIYQSAKANCNGNYIDVDPNNILCLNDLQKVTRCLKNIRRAQILEPYCDLPYLMGILQETPTNGQSVFPIAGPWCREKNYIYSYVWANDKAVQKALNVREGTTLEWVRCNESMHYRGKERTESYVYDVPSVIDDHQHLTSKSCRALIYSGDHDMVVPHLSTEEWIETLKLPIADDWEPWFVDDQVAGYKVKYLQNDYEMTYATVKGAGHTAPEYKPEQCLPMVDRWFSGDPL

SEQ ID NO: 21234 - protein, 258 aa, Propionibacterium acnes
MIYSADLVPGTVTLVGGGPGDPGLLTVAGFEAVRQADVILYDRLAPTAVMDENPQAERIPVGKVPRGPYVPQERTNELLIEHAKAGRKVVRLKGGDSFVFGRGGEEWQACAAAGVPVRIIPGVTSCVAGPELMAVPLTHRHMVQGFTVVSGHVAPGDTRSELDWAQIAKTGTTLVILMGVAHIGDIATRLMDGGLAGDTPVAIIADASLPTQRSLTTTLEKAAEDMAEAEINPPAITVVGDVAGLDLDGTQAHVPSDH

SEQ ID NO: 21235 - protein, 427 aa, Salinibacter ruber
MSTSLDNSILTVILGGGKGTRLYPLTKLRAKPAVPLAGRYRLIDVPVSTSINSGITRIFVLTQYNSASLNRHLARAYQFDRFSNGFVSILAAEQTPSSKDWFQGTADAVRRSLPHIEGHRHRHVLILSGDQLYSMDYRKMLAHHRETDADVTLGTIPVAADDATSFGILKTDDEHIITEFHEKPDRDELDGLESPVGPGLEDEGRVYHASMGMYIFDREPLHELLNANPNDHDFGNQIIPKAIDKMRVASYPFSDYWSDIGTIRSFYEANLMLAEPEPPFSLYDPNRPLYTRARMLPPAKVQNSTVQDSLITEGSLVENSQISKSVVGIRSYVGPDTTLKNTVMMGADHFRWHDMEERGFVEGPANPGIGENSYVEGAIIDKNVSIGKRCIIKNRDNVQEAEEDLYHIRDGIVVIPKNTRIPDDTII

SEQ ID NO: 21236 - protein, 501 aa, Zea mays
MARLRCVFVVFVLLSSALRLPGDAIASRGHHGPAAHDYRDALVKSILFFEGQRSGKLPPSQRVSWRRDSGLSDGHSAKVDLVGGYHDAGDNVKFGFPMAFSMTMLAWSVVEFGGLMKSELQHARDAVRWGADYLLKATAHPDTIYVQVGDATKDHACWERPEDMDTPRTVYKVDRGTPGSDVAAETAAALAAASLVFRKSDPAYASSLVARAKRVFEFADKHRGSYSTGLAADVCPYYCSYSGYQDELLWGAAWLHRATKSPSYLSYIQTNGQVLGADESDNTFGWDNKHAGARVLISKSFLVQRLGALHEYKGHADGFICSMVPGTATDQTQYTRGGLLFRLSDSNMQYVTSSSFLLLTYAKYLAFAKQTVRCGGVAVTPQRLRAIARRQVDYLLGSNPMGMSYMVGYGAKYPRRIHHRASSLPSVAAHPARIGCSQGFTALYAGGANPNLLVGAVVGGPDMQDRFPDERNDHEHSEPATYINAPLVGALAYLAHSYGQL

SEQ ID NO: 21237 - protein, 305 aa, Streptococcus pyogenes
MYDTLIIGSGPAGMTAALYAARSNLSVAIIEQGAPGGQMNNTFDIENYPGYDHISGPELAMKMYEPLEKFNVENIYGIVQKIENFGDYKCVLTEDASYEAKTVIIATGAKYRVLGVPGEEYYTSRGVSYCAVCDGAFFRDQDLLVVGGGDSAVEEAIYLTQFAKKVTVVHRRDQLRAQKILQDRAFANDKVDFIWDSVVKEIKGNDIKVSNVLIENVKTGQVTDHAFGGVFIYVGMIPVTGMVKDLKITDSEGWIITDDHMRTSIPGIFAIGDVRQKDLRQITTAVGDGAIAGQGVYHYLESFPS

SEQ ID NO: 21238 - protein, 85 aa, Ixophorus unisetus
ECQKVGAPPEVSARPTAMAQELEARQRTALGGLSAATEPELDQFMEAYHEMLVKFREELTRPLQEAMEFMRRVETQLNSLSISGR

SEQ ID NO: 21239 - protein, 341 aa, Mycobacterium smegmatis
MAASLRVPKVVVLGGGSWGTTVASICARRGPTLQWVRSEETAKDINENHRNSRYLGDDVVLPDSLTATNDFSEAAACADVIVMGVPSHGFRGVLQELARELRPWVPVVSLVKGLEQGTNLRMSQIVDEVLPGHPAGILAGPNIAREVAEGYAAAAVLAMPDQHLAAKLAELFRTKRFRTYTTDDVTGVEMAGALKNVYAIAVGMGYSLGIGENTRAMVMARAVREMAKLGEAAGGHRDTFAGLAGMGDLIVTCTSQRSRNRHVGEQLGAGKKIDEIIASMNQVAEGVKAASVIMEFADQYGLNMPIAREVDAVINHGSSVEQAYRGLMAEKTGHEVHSSGF

SEQ ID NO: 21240 - protein, 303 aa, Coprinopsis cinerea
MTVPDILNQTFQAVDDALSKMCAESDGKIHSGCTAVTAFLRIEDEDGQQSFVVPVESSSSSNESPVSSLDDIAPPTPSGTQSSAALDSGDESKEIKTDKKTKKKSASLSGKRIRKALRSLGGSKAPTPRSTSPVDARDFTNTGITVTIPPDSHRRVLYSANAGDARGVLCRAGKAIRLTYDHKGSDKQEAKRITDAGGFVMSGRVNGVLAVTRSLGDASMKEFVVGAPYTTETELCEEDEFLILACDGLWDITNDQAAVELVRDIEDAQVASETLLKHALSQHTTDNVTVIVVRFKHGQPKTA

SEQ ID NO: 21241 - protein, 85 aa, Ixophorus unisetus
ECQKVGAPPEVSARLTAMAQELEARQRTALGGLGAATEPELDQFMVAYHEMLVKFREELTRPLQEAMEFMRRVETQLNSLSISGR

SEQ ID NO: 21242 - protein, 85 aa, Ixophorus unisetus
ECQKVGAPPEVSARLTAMAQELEARQRTALGGLGAATEPELDQFMEAYHEMLVKFREELTRPLREAMEFMRRVETQLNSLSISGR

SEQ ID NO: 21243 - protein, 387 aa, Coprinopsis cinerea
MKFLLALLSAICLFQMASAAAISRRAPGFVQTDGTYFSLDGYKYTVVGANAYWISQAGLSDADMDKSFADIASMGATTVRVWGFNEMAEEHIAENGIYYQLWRGNKAVVNYSASGLGYFDRVIASARKHNLRLIVVLTSNYNLDWVVGGAGTYMDQVLGPNRRQTNDAFFTHPEIKDIFKNYVSAIVSRYKDEKTIMSWELGHQLKCAVSWNPRNPQCNPEIITEWIKEMSSHIKSIDSNHLVAVGDEGFFNRPNSNGRYVYTGRDGMDFEANSALNTIDYATFAYRPASYEMPTHSKEPLEWIDAHGKSQERLQKPVLLVDLGSEIRPHWLDQIVESGIAGTLYWQAGTEGIKLNMPYWFRGDYISLSSDIAKDIKKHFEALKRRP

SEQ ID NO: 21244 - protein, 289 aa, Staphylococcus epidermidis
VLGVNKSASKDEIKKAYRKLSKKYHPDINKEEGADEKFKEISEAYEVLSDENKRANYDQFGHDGPQGGFGSQGFGGSDFGGFEDIFSSFFGGGSRQRDPNAPRKGDDLQYTMTITFEEAVFGTKKEISIKKDVTCHTCNGDGAKPGTSKKTCSYCNGAGRVSVEQNTILGRVRTEQVCPKCEGSGQEFEEPCPTCKGKGTENKTVKLEVTVPEGVDNEQQVRLAGEGSPGVNGGPHGDLYVVFRVKPSNTFERDGDDIYYNLDISFSQAALGDEIKIPTLKSNVVLTIP

SEQ ID NO: 21245 - protein, 310 aa, Dechloromonas aromatica
MKIANNVTELVGNTPLVKLNRVTAGAGATIAAKLEFFNPGHSVKDRIAVSMLDAAIAAGKVGPDTVILEPTSGNTGIGLAMVCAARGIKCAFVMPETMSRERKLLLKAYGAELILTPGPEGMGGAIAKAKALAESDPKYFVPQQFENPANPEVHRNTTAEEIWRDTDGQVDIFVSGVGTGGTITGVGEVLKAKKPGIKIVAVEPDASPVLSGGQKGPHPIQGIGAGFVPGVLNTAVYDEVIRVKNDDAFAIARQMATEEGLLVGISSGAATWAALELARRPENAGKLIVVIIPSFGERYLSTPLYQHLEV

SEQ ID NO: 21246 - protein, 358 aa, Unknown
  Burkholderia sp. 383
MTSPEQHAAQHDPVRAYLDRGIKNYWYPVAPSWQVSNAPVGLTRLSEQIVLWRDHDGKVHALEDRCPHRGARLSLGWNLGGNIACWYHGIEVDGGGTVNRVPAVSNCPLEGTKCVKSYPVEEKAGAIFLWFGDEAHGEPAPLNLPEELVADEYGHFLCVSNWKCNYQYAIDNVMDPMHGAYLHATSHSMAEGDKQADMRVRKTETGLMFEKVGQRDVNFDWVELGETGCLWMRLAIPYKQKFGPGGNFGIIGFATPVDGDNCQVYFWRTRKVSGWQRDVWRFMYRNRLEGLHWDVLEQDRYVLESLAPNARDHEYLYQHDVGMTRVRRMLRTRAQEHLSALDAHRAAQAQAASEPANG

SEQ ID NO: 21247 - protein, 295 aa, Staphylococcus equorum
VLGVSKGASKDEIKKAYRKLSKKYHPDINQEEGSDEKFKEISEAYETLSDENKRANYDQFGHDGPQGGFGGQGFGGQDFSGFGGGGFEDIFSSFFGGGRQQRDPNAPRKGDDLQYTMTVTFDEAVFGSEKEISIRKDVSCHTCDGAGAKPGTKKKTCQYCSGAGHVSVEQNTILGRVRTEKVCPVCSGSGQEFEEPCPTCKGKGTENKNVKISVTIPEGVDNEQQIRLAGEGAPGENGGPQGDLYIVFRVKPSEKFERDGDDIYYSLDISIAQASLGDEVKVPTLNSSVMLTIPA

SEQ ID NO: 21248 - protein, 807 aa, Cucumis melo
MAHVRILVRHGGEWDEGRRKYEGGVLKGIVVPKEITHKDLQSELYDLAEVDPTKFDIKIRCIYEIKGEKEAPPFELSNDRDLKFYILSENPLEVPLYLSFEPTSNRSMKVLNKDYNSVSGSNQVQNLNPHPPPIGMDRLDENEVDIGEVEGGLCHNMIGTNSAIWESYESYHSIDDTFTLESVEMYNELFDIPEQRDAPTKDCKGKGKVDYRSSSRKLKTKGSGWSEESSTSEELDVGQIFFCKRDLSMRLSVLAMKKNFQFVVKKSTKEVLFVRCIDNKCGWRLRAVRLKDSNIFKIKKYVKVHSCSLEFLNRDHRQAKSWVVGELIKSKFKGPGRIYKPRDIIEDMRQDYGINMSYEKAWRARENAYERVRGSPEESYNLLRRYGEALKFTNSGTIFHMELEDDRFFKYLFMAVGACVRGFLNCIRPVIVMDGTFLKNKYRGQLIVAVCLDGNNQIYPLAFGVVDRETDDSIQWFLEKLKGAIGEVPNLGFVTDRKTCFAKGISSVFPSAFHGLCVQHLSQNLHDKYKNDTVATLFYNASRTYRESTFVEAWRHLLSFPNGSGKYLNDVGIARWSRVHCPGRRYNMMTTNIAESMNSILKEPRDLPIASFLENVRALLQPLVLGASRRSIKVTSTLTKWAELVIQKKQEGALTMKVNPIDCYQFHVKDLDKEEVVNLQTKECTCKEFQAEQLPCSHAIAAARVRNINVYSLCANYYTNECLLAAYAEAVYPVGNQSDWKTSEDYVHMTVLPPKVVKRVGRPKKKRIPSVGEAPKLHKCGRCKQIGHNRLTCTNPISYTDKSSIQD

SEQ ID NO: 21249 - protein, 295 aa, Staphylococcus felis
VLGVNKGASKDEIKKAYRKLSKKYHPDINKEEGADEKFKEISEAYEVLSDDNKRANYDQFGHAGAQNGGFGQGFGGQDFSGFGGGGFEDIFSSFFGGAQRQRDPNAPRRGDDLQYTMTVTFEEAVFGTEKEISIRKDVTCHTCDGDGAKPGTKKKTCSYCNGAGHVSVEQNTILGRVRTEKVCPQCNGSGQEFEEACPTCHGKGTETKNVKLQVTVPEGVDNDQQIRLANQGSPGENGGPSGDLFIIFRVKPSDKFIREGDDILYKHKISFSQAALGDEVKIPTLNSHVMLTIPS

SEQ ID NO: 21250 - protein, 204 aa, Veronica arvensis
GVHFGHGTRKWNPKMAPYISAKRKGIHITNLTRTARFLSEACDLVFDAASRGKQFLIVGTKNKAADSVAWAAIKARCHCVNKKWLGGMLTNWSTTETRLHKFRDLRMEQKTGRLDRLPKRDAAMLKRQLSRLQTYLGGIKYMTGLPDIVIIVDQYDEYTALRECITLGIPTICLIDTNCDPDLADISIPANDDAISSIRLILNK

SEQ ID NO: 21251 - protein, 208 aa, Ralstonia metallidurans
MSRQRTLESVQRTALAGALTLAAAVAVMLPPPAHAAEKAVPAAAQPAGNCPASLNFRFPRLQDESPQNLCQYAGKVVLVVNTASYCGFTPQYEGLEALYAKYRERGLVVLGFPSNDFSQEPGSSKDIADFCYNTYGVKFPMLGKSHVRGSDANPMYALLAQETGTAPKWNFYKYLIDRKGQVIGSYNSMVKPDDKQFVSKIEELLNAR

SEQ ID NO: 21252 - protein, 294 aa, Staphylococcus fleurettii
VLGVSKDASKDEIKKAYRKLSKKFHPDINQEEGADAKFKEISEAYEILSDENKRAQYDRFGHNGPQQGFGGSQGFGGQDFSGFGGFEDIFGSFFGGGGARRDPNAPRQGDDLQYSMTLTFEEAVFGTEKDITVRKDVECDTCHGKGAKPGTKKKTCTYCNGQGHVTVEQNTILGRMQTQKVCPECEGSGEIFEEKCSDCHGKGTQNKKVTIKVKVPEGVDNDQQIRLAGKGGPGVNGGPAGDLYVVFRVKPHNKFRREGDDIFYDLNLSFPQAALGDEITVPTLTGNVSLSVPA

SEQ ID NO: 21253 - protein, 204 aa, Verbascum blattaria
  misc_feature (1)..(3): Xaa can be any naturally occurring amino acid
XXXFGHGTRKWNPKMAPYISAKRKGIHITNLTRTARFLSEACDLVFDAASKGKQFLIVGTKNKAADSVAWAAIKARCHCVNKKWLGGMLTNWSTTETRLHKFRDLRMEQKTGRLNRLPKRDAAMVKRQLFRLQTYLGGIKYMTGLPDIVIIVDQHEEYTALRECITLGIPTICLIDTNCDPDLADISIPANDDAISSIRLILNK

SEQ ID NO: 21254 - protein, 294 aa, Staphylococcus gallinarum
VLGVSKSASKDEIKKAYRKLSKKYHPDINKEEGSDEKFKEISEAYEVLSDENKRANYDQFGHDGPQGGFGGQGFGGQDFSGFGGGGFEDIFSSFFGGGRQRDPNAPRKGDDLQYTMTVTFDEAVFGAEKEISIRKDVTCHTCDGEGAKPGTNKKTCSYCNGAGHVSVEQNTILGRVRTEKVCPVCSGSGQEFEEPCPTCNGKGTENKNVKISVKIPEGVDNEQQIRLAGEGAPGENGGPHGDLYVVFRVKPSEIFERDGDDIYHSLNVSFAQAALGDEVKVPTLNGHVMLTIPA

SEQ ID NO: 21255 - protein, 238 aa, Picea glauca
MEHLNTAAAQASSSLYGVGMAEYGDAGVSSMMALITQHEPHDSESIMSTRMPSSFSSFHGHADCLLSAAMFQAFQGDHKLKRQPGMDQLVSEQAGMSDSSMPSVKTEVCSGLRNQFEFHREQTGNCYTDQSSNTPVNPLVTSLASQARGEAQMIPSLDANSPHFNVDNEEYAIKSKILAHPQYPSLLGAYIDCQKIGAPPEAVARLDALTREYQNQQRRTVSIGMDPELDQFMEAYCE

SEQ ID NO: 21256 - protein, 245 aa, Sinorhizobium meliloti
MTKSPIGGNRSGRKLGQKVKKGKLKASSRRWIERHINDPYVQRAQLEGYRARAAFKLLEIDEKHKILAGAKRIIDLGAAPGSWSQIAAKVTNSTDADPRVAAIDFLEMDPIPGVRFLQMDFLDPEAPENLKQAIGGAPDIVLSDMAAPTTGHRQTDHIRTMHLCEVAAHFAVEVLAEGGHFLAKTFQGGTERDLLNMLKQNFRQVVHVKPASSRAESVEMFLLAKGFKGRHALESDEPAEGAAEE

SEQ ID NO: 21257 - protein, 150 aa, Vibrio parahaemolyticus
FQGISAKTDAGEPCCDWVGNDGAGHFVKMVHNGIEYGDMQLITEAYQFMKDGLGMSADEMQAVFAEWNNTELNSYLVEITADILGYKDEDGAPLVEKILDTAGQKGTGKWTGINALDLGIPLTLISESVFSRCLSALKDQRVEAEKLFGK

SEQ ID NO: 21258 - protein, 205 aa, Corynebacterium glutamicum
MTLAPRIGTATRTTSESDITVEINLDGTGKVDIDTGLHFSTNMLTAFGVHGSFDLKVHAKGQTSRSTHHTVEDTAIVLGKHSLRYCDKKGIRRFASCQLPMDEALVESVVDISGRPYFVISGEPDHMITSVIGGHYATVINEHFFETLALNSRITLHVICHYDRDPHHITEAEYKAVARALRGAVEMDPIPSLRERFTHELFYHL

SEQ ID NO: 21259 - protein, 71 aa, Rickettsia sibirica
MSNDDLIQFTGTVLELLPNATFRVKLENDHVIIAHTSGRMRKNRIRILLGDKVMVEMTPYDLTKGRVIHRH

SEQ ID NO: 21260 - protein, 150 aa, Vibrio parahaemolyticus
FQGISAKTDAGEPCCDWVGNDGAGHFVKMVHNGIEYGDMQLITEAYQFMKDGLGMSADEMQAVFAEWNNTELNSYLVEITADILGYKDEDGEPLVEKILDTAGQKGTGKWTGINALDLGIPLTLISESVFSRCLSALKDQRVEAEKLFGK

SEQ ID NO: 21261 - protein, 355 aa, Listeria monocytogenes
MKSILKGFSSWKISFTEGVFDIFLYLIGICLSRKTSQADEASVKVASELEIPKIRLTNGGLHMSEDLFDVEVRNFEEGDKVTGTVTSVEDKQVYVGIPGSKLDGVVPISELSNIHVETASDVVSVGDTLDLIVTKVEDDILVLSKRKVDAEKASDDIKAKFESGEVFEAVVSDVVKGGLVVDLGVRAFVPASLVEDHFVEDFADYKGTTLTFKVVEFEPENNRVILSHRAVVETEKASQKQALLSEIKEGDVIEGTVQRLANFGAFVDIGGVDGLVHISQISYKHIATPQEVLEEGQKVTVKVIGIDPENERISLSIKATLPGPWDGITEKAQVGSVLEGKVVRLVTFGAFVEIF

SEQ ID NO: 21262 - protein, 313 aa, Pseudomonas syringae
MIGTPRSLDCEDAMTLQYQTIADCVGNTPLVRLQRMAGNTSNTLLLKLEGNNPAGSVKDRPALSMITRAELRGQIHPGDTLIEATSGNTGIALAMAAAIKGYRMILIMPDNSSAERKAAMTAYGAELISVSKDDGMEGARDLAERMQAEGRGKVLDQFANGDNPEAHYTSTGPEIWRQTGGTVTHFVSSMGTTGTIMGTSRYLKEQNPDVQIVGLQPMEGASIPGIRRWPQEYLPKIYQSDRVDRIIDMGQSEAEDTMRRLAREEGIFCGVSSGGSVAGALRISREVENAVIVAIICDRGDRYLSTGVYDSPN

SEQ ID NO: 21263 - protein, 287 aa, Triticum aestivum
  misc_feature (14)..(14): Xaa can be any naturally occurring amino acid
  misc_feature (33)..(33): Xaa can be any naturally occurring amino acid
  misc_feature (58)..(58): Xaa can be any naturally occurring amino acid
  misc_feature (177)..(177): Xaa can be any naturally occurring amino acid
AAASTIMKDISQGXERIPVSVLNSISDEHPMPXITMSRLKYPPNYQPAPPAGCACVGXGCSDSKLCACVVKNGGEIPFNDKGCIIAAKPLVYECGPSCKCPPTCHNRVGQKGIKFRLQVFKTKSMGWGVKTLDYIPSGSFVCEYIGEVLDDEEAQKRMTDEYLFAIGHNYYDESLWXEGLSRSIPSLQNGPGKDEETGFAVDASKMGNFAKFINHSCTPNLYAQNVLYDHDDKSAPHIMFFACEDIPPGQELVYHYNYAIDQVHDENGNIKKKKCLCGSVECDGWLY

SEQ ID NO: 21264 - protein, 917 aa, Pseudomonas syringae
MLTKLGIKGRVLLLTILPASLMAAMLGGYFTWMQLSELQSQLLQRGEMIAQDLAPLAANALGRKDKVLLSRIATQTLEQTDVRAVSFLDTDRTVLAHAGPTMISPSPIGSGSQLLSSTGTDATRYLLPVFGSQRHLTSPIIPAEADTLLGWVELEISHNGTLLRGYRSLFASLLLILTGLAFTATLAVRMSRTINGPMSQIKQAVSQLKDGNLETRLPPLGSRELDELASGINRMAATLQNAQEELQLSIDQATEDVRQNLETIEIQNIELDLARKEALEASRIKSEFLANMSHEIRTPLNGILGFTHLLQKSELTPRQFDYLGTIEKSADNLLSIINEILDFSKIEAGKLVLDNIPFNLRDLLQDTLTILAPAAHAKQLELVSLVYRDTPLALSGDPLRLRQILTNLVSNAIKFTREGTIVARAMLEDETEEHAQLRISVQDTGIGLSSQDVRALFQAFSQADNSLSRQPGGTGLGLVISKRLIEQMGGEIGVDSTPGEGSEFWISLKLPKAREDKEESLNIPLGGLRAAVLEHHDLARQALEHQLEDCGLQTIVFNNLENLLNGVTAAHETPAAIDLAVLGVTALEISPERLRQHIWDLENLNCKVMVLCPTTEHALFQLAVHDVYTQLQAKPACTRKLQKALSELIAPRAVRADIGPPLSSRAPRVLCVDDNPANLLLVQTLLEDMGAEVVAVEGGYAAVNAVQQEAFDLVLMDVQMPGMDGRQATEAIRAWEAERNQSSLPIVALTAHAMANEKRSLLQSGMDDYLTKPISERQLAQVVLKWTGLALRNPAPERQNEALEVHVGPLVLDHEEGLRLAAGKADLAADMLAMLLASLDADREAIRVARANQDVHALIERIHRLHGATRYCGVPQLRSACQRAETLLKQNAPHTEEALNDLDKAIIRLEAEARVMA

SEQ ID NO: 21265 - protein, 181 aa, Triticum aestivum
MSLTNCRFYEEKYPEIDSFVMVNVKQIAEMGAYVKLLEYDDIDGMILLSELSRRRIRSIQKLIRVGRNEVVVVLRVDKEKGYIDLSKRRVSPEDIVKCEERYNKSKMVHSVMIHLAKATEIPLETLYQAIAWPLNKKFGHALDAFKLSITNPEVWNDITFPRRGHRPGAEEYIGKRLTPNP

SEQ ID NO: 21266 - protein, 449 aa, Streptomyces peucetius
MKDDSPAPCVADRDRIARRTASTCGPPGQRRESMATNAAFVIVGASLAGAKAAQTLREENFDGPVVLLGEESEHPYERPPLSKGYLLGKDERDTVYVHPAQWYPEHDVDLRLGATVTAIDPAGHEVTLADGSRIGYEKLLLTTGSSPRRLTVPGADLEAVHYLRRLADSDRIKESFASATRIVVIGAGWIGLETAAAARAAGVEVTVLEMAELPLLRVLGREVSQIFADLHTEHGVDLRFGVQVAEITGADGRANGVMLADGSRIDADAVIVGVGITPNTQLADAAGLEVDNGIRVDAHLRTSHPDIYAAGDVANAFHPLLGKHIRVEHWANAVNQPHVAAKAMLGQDVAYDRVPYFFTDQYDLGMEYTGYVEPGGYDQVVFRGRTDTREFIAFWLAEGRVLAGMNVNVWDVTDPIRDLVTSRRPVDAKRLADSDVPLAHLLGRPDTTA

SEQ ID NO: 21267 - protein, 324 aa, Rhizobium leguminosarum
MSGSDNPYNGSFGNQMTATTSFGATPEPAAAAGSYITETTTANFAKDVIEESRKQPVLVDFWAPWCGPCKQLTPVLEKVINEAKGRVRLVKMNIDDHPSIAGQLGIQSIPAVIAFVNGRPADGFMGAVPESQIQQFIDRIAGPAGADEAAEIEAVVTEAAELLAAGNINEAAQLYGAVMQADPENAKALAGMAECMIAANQHQRAREILTELPEELAKDTGIQAVLMKLEQIEEARKLGDPVALERELAANPDDHEARIKLAKIRNVEGRRDEAADHLLLIMRKDRAFDDDGARRQLLQFFEVWGFKDPATVAARRKLSAMLFS

SEQ ID NO: 21268 - protein, 205 aa, Unknown
  Azoarcus sp. BH72
MKRNKTSKAWMHEHLNDTYVQRANAEGYRARAAYKLMEIDERDRLLRPGRVVVDLGAAPGSWCQVARQRVGSDGRVLALDILPMDPVPGVDFLQGDFTEDAVLAELESRLAGAAVDLVLSDMAPNLSGVATVDQARSIYLCELALDFARRHLKPGGQFLVKVFQGEGFMGFRKAMDEVFLSVQVRKPKASRDRSAEVYLLGVDLR

SEQ ID NO: 21269 - protein, 415 aa, Ralstonia metallidurans
MGAADIIKQHLIDPEICIRCNTCEDTCPIDAITHDDRNYVVKADVCNACNACLSPCPTGAIDNWRTMLKGQAYTIEAQLTWDELPEEVPLPEAEIEAAAAAGQVIEEASRGSKSVAVQEVEASRHTSSRAPWSAAHPYVNLHGVREPVTATVAGNHRLTAEDASSDIHHIVLDFGNHFFPVLEGQAIGIVPPGTDASGKPHYIRMYSVASPRDGERPGYNNLALTVKRVDTDHDGNPVRGVASNFLCDLAKGDPVQVVGPFGSTFLMPNHREASVMMICTGTGSAPMRAMTERMRRNMDHFSGRRLLFFGARNRRELPYFGPLLKLPKDFLDIHFAFSRDPEVPRRYVQDAIREASAQVAALLADPHGHIYICGLKGMEEGVLDAFAEVCATSGQSWQDIEPRLRAEGRLHIETY

SEQ ID NO: 21270 - protein, 331 aa, Triticum aestivum
  misc_feature (5)..(5): Xaa can be any naturally occurring amino acid
  misc_feature (7)..(7): Xaa can be any naturally occurring amino acid
  misc_feature (16)..(16): Xaa can be any naturally occurring amino acid
  misc_feature (20)..(20): Xaa can be any naturally occurring amino acid
  misc_feature (32)..(33): Xaa can be any naturally occurring amino acid
  misc_feature (42)..(42): Xaa can be any naturally occurring amino acid
HPNHXLXLQRCFKDEXFRLXLVQSIGEGVSSXXVEEFGREIXRDEIYQITVVDILMWAIEVDWRDFFPYLGWIPNKGFETGLHTTEFRRTSVMRALINEQKKRIARGEARVSYLDFLVAERPLADDQLMMLVWEAVIENADTTLVTTEWAMYELAKNPEKQERLYQEIKDVCAGETVTEDHLRRLPYLSAVFHETLRFHSPVPLVPPRFVHETTKLAGYDVPAGTEIVINLFGCNMNKKDWEEPEEWRPERFLDPRFDAADMYKTMSFGSGKRICAGSMQATVISCTAMARMVQEFSFRLKEGDEDKVDTVQLTSYKLHPLYVHLSPRGSK

SEQ ID NO: 21271 - protein, 677 aa, Kluyveromyces lactis
MGHNDSVETMDEISNPNNILLPHDGTGLDATGISGSQEPYGMVDVLNPDSLKDDSNVDEPLIEDIVNPSLDPEGVVSAEPSNEVGTPLLQQPISLDHVITRPASAGGVYSIGNSSTSSAAKLSDGDLTNATDPLLNNAHGHGQPSSESQSHSNGYHKQGQSQQPLLSLNKRKLLAKAHVDKHHSKKKLSTTRARPAFVNKLWSMVNDKSNEKFIHWSTSGESIVVPNRERFVQEVLPKYFKHSNFASFVRQLNMYGWHKVQDVKSGSMLSNNDSRWEFENENFKRGKEYLLENIVRQKSNTNILGGTTNAEVDIHILLNELETVKYNQLAIAEDLKRITKDNEMLWKENMMARERHQSQQQVLEKLLRFLSSVFGPNSAKTIGNGFQPDLIHELSDMQVNHMSNNNHNNTGNINPNAYHNETDDPMANVFGPLTPTDQGKVPLQDYKLRPRLLLKNRSMSSSSSSNLNQRQSPQNRIVGQSPPPQQQQQQQQQQGQPQGQQFSYPIQGGNQMMNQLGSPIGTQVGSPVGSQYGNQYGNQYSNQFGNQLQQQTSRPALHHGSNGEIRELTPSIVSSDSPDPAFFQDLQNNIDKQEESIQEIQDWITKLNPGPGEDGNTPIFPELNMPSYFANTGGSGQSEQPSDYGDSQIEELRNSRLHEPDRSFEEKNNGQKRRRAA

SEQ ID NO: 21272 - protein, 253 aa, Pinus gerardiana
CGIGSCAFAGGQLSSLKPHTNQLLGVGAGIHGESRVTMRKSATKKSFASASPSPWYGPDRVLYLGPFSGEPPSYLTGEFPGDYGWDTAGLSADPETFAKNRELEVIHCRWAMLGALGCVFPELLARNGVKFGEAVWFKAGAQIFSEGGLDYLGNPSLIHAQSILAIWACQVILMGAVEGYRIAGGPLGEVTDPIYPGGSFDPLGLADDPDAFAELKVKEIKNGRLAMFSMFGFFVQAIVTGKGPIENLADHLA

SEQ ID NO: 21273 - protein, 491 aa, Aspergillus oryzae
MADQAVADFGLIGLAVMGQNLIMNVADHGFTVCAYNRTTSKVDRFLENEAKGKSIVGAHSIEEFCAKLKRPRRIMLLVMAGKPVDQFIESLLPHLEKGDIIIDGGNSHFPDSNRRTKYLAEKGIRFVGSGVSGGEEGARYGPSLMPGGNEEAWPFIKDIFQSIAAKSEGEACCDWVGDEGAGHYVKMVHNGIEYGDMQLICEAYDILKRGVGMPVNEIAEVFDKWNKGVLDSFLIEITRDVLRFNDDDGTPLVEKILDKAGQKGTGKWTAINALDLGMPVTLIGEAVFSRCLSALKDERVRASSLLPGPTPQFTGDKQAFVDDLEQALYASKIISYAQGFMLMQEAAKEYGWKLNKPSIALMWRGGCIIRSVFLKDITNAYRQNPDLENLLFDKFFNEAIAKAQNGWRNVVSKGALWGIPTPAFSTALSFYDGYRTRDLPANLLQAQRDYFGAHTFRVKPEHANETYPEGKDIHVNWTGRGGNVSASTYIA

SEQ ID NO: 21274 - protein, 951 aa, Pseudomonas putida
MTINLGTANEFIARHIGPRAADEQAMLTALGFDSLDAMTAAVIPDSIKGTSVLGSHDGQSEADALAALKAIAGKNQLFKSYIGQGYYNTHTPAPILRNLLENPAWYTAYTPYQPEISQGRLEALLNFQTLISDLTGLPIANASLLDEATAAAEAMTFCKRLSKNKSSHAFFASVHCHPQTLDVLRTRAEPLGIEVVVGDERELGDVSAFFGALLQYPASNGEVFDYREVVQRFHAANALVAVAADLLALTLLTPPGEFDADVAIGSAQRFGVPLGFGGPHAAYFATRDAFKRDMPGRLVGVSIDRFGKTALRLAMQTREQHIRREKATSNICTAQVLLANIASMFAVYHGPAGLKRIAERTHALTAILAAGLKALGVQVVGASAFDTLTLATGTATASLHDKARAQGINLRQIDAAHVGLSLDETSTQADVESLWQLLGGEQAQPDFTALAASTGSLLPAALLRQSAILEHPVFNRYHSETELMRYLRRLADKDLALDRSMIPLGSCTMKLNAASEMIPVTWAEFGNLHPFAPAEQSQGYLQMTTELEAMLCAATGYDAVSLQPNAGSQGEYAGLLAIRAYHRSRGEGHRDICLIPSSAHGTNPATAHMAGMRVVVTACDARGNVDVEDLRAKAIEHRERLAAIMITYPSTHGVFEEAIGEICAIIHDNGGQVYIDGANMNAMVGLCAPGKFGGDVSHLNLHKTFCIPHGGGGPGVGPIGVKSHLAPFLPGHAQLENTQGAVCAAPFGSASILPITWMYIRMMGGAGLKRASQMAILNANYIARRLEEHYPVLYTGGNGLVAHECILDLRPLKDTSGISVDDVAKRLIDFGFHAPTMSFPVAGTLMIEPTESESKEELDRFCNAMIQIREEIRAVEDGSLDKDDNPLKNAPHTAAELVGEWTHGYSREQAVYPLASLVEGKYWPPVGRVDNVFGDRNLVCACPSIESYQDA

SEQ ID NO: 21275 - protein, 250 aa, Pinus krempfii
CGIGSCAFAGGKISSLKPHSNQLLGVGAGVHGESRVTMRKSATKKFASESPSPWYGPDRVLYLGPFSGEPPSYLTGEFPGDYGWDTAGLSADPETFARNRELEVIHSRWAMLGALGCVFPELLARNGVKFGEAVWFKAGAQIFSEGGLDYLGNPSLIHAQSILAIWASQVILMGAVEGYRIAGGPLGEVTDPIYPGGSFDPLGLADDPDAFAELKVKELKNGRLAMFSMFGFFVQAIVTGKGPIENLADH

SEQ ID NO: 21276 - protein, 516 aa, Aspergillus oryzae
  misc_feature (153)..(153): Xaa can be any naturally occurring amino acid
MPSEDQNQQFKRIGIVGAGNMGSMMAFAFSELGLDVSIWDVKKENVDQLLQSAKDIKGQGKIEGFEDIGEFTQSLEGQGERKLFIFSITHGDPADSVLSKIKHALKKGDIILDGGNENYRRTERRQKECEEIGVSWIGTGVSGGYQSARRGPXLSPGGDEKALELVLPLLERYAAKDRKTGQPCVARVGPAGSGHFVKMVHNGIEGGMLSAVAEAWSILHYGLGLKYDEIGDIFDEWNQKGELRNNFLLDIGADVCHRRKSPEGDGKGEGIGEKNEYVLDDVLDKVVQDDDDTEGTPYWCVMETANRHVSAPTIATGHYMRIASGNRAERLRVAEKLRMPKPKPIEGIKDRRLFIEDLRRAVYCCFLSSFCQGLELIARASDDEGWNIDLSKCLQIWRGGCIIQSEAIADLLQPLLKKDVHYTNLKDIDEVARALKHNFDSLKRIVIDSTVFDQYIPAISATLEYLKYAGGTMLPTKFMEAQMDLFGAHAYYKPGVPGEDPGPVKKGPHHYEWRPA

SEQ ID NO: 21277 - protein, 546 aa, Zea mays
MVDSKSRHGNQTADVSGITSAKDPTSTKTSLDRLKQPMPYKGRKELMNFLHETMQSPNKSTMPTPVSQRKRVAAPFGSVDRKLFILTPMPLRSGGSAVAGAGMFNNKVQDMENIEEKVHVLELKVLLRSFHQGCKVDVWSAGVTLFSSLKNVTKMLHLSDKRNIKEIAKLKGSEELWEVAKLHNCESSYPSDLFDVKFPLCSVDLREWLSSEDALMHEFFAPGRDNFRKLRMLRRSAGSDAAWVEWTWKHPTTNQPTNQASSRRVEASGPRRHKRKREDKASAAPPPMPPLLTSPASLPSASPLLVSCIGALHRPGPFLHQRAAASVHFLAPHRKTRPPPAMSWLGKLGLSGLGGSPRASEASAALAQGPDEDQPAPGNEFAQFGAGCFWGVELAFQRVPGVTRTEVGYSQGNIHDPTYEDVCTGTTNHNEVVRVQYDPAACKYDDLLDTFWARHDPTTPNRQGNDVGTQYRSGIYYYNPEQEKAARESLEKQQKLLNRKIVTEIVPAKRFYRAEEYHQQYLEKGGRFGFGQSAAKGCNDPIRCYG

SEQ ID NO: 21278 - protein, 917 aa, Pseudomonas putida
MLDRLGIRSRVLLLALLPAGLMALVLGSYFTWLQQNDLRTQLLQRGKMIAEQLAPLAAPAMARLAPAQLERIAAQTLEQADVRAVAFLAPDRTRLAHAGPSMLNLPPSGGTGTQLLQRSGNDATRYLMPVFGHHRDLATDAVPAEAERLLGWVEIELSHDGTLLRGYRNLFTSLLLILACLALSGLLALRMSRTINDPIERIKHAVNQLKDGHLEERLPTMGSHELDELAHGINRMAETLQNAHEELQHSIDQATEDVRQNLETIEIQNIELDMARKEALEASRIKSEFLANMSHEIRTPLNGILGFTHLLQKSEMTPRQLDYLNTIEKSADNLLGIINEILDFSKIEAGKLVLDSIPFNLRDLIQDTLTILAPAAHAKQLELLSLIYRDTPASLVGDPLRLKQILTNLVSNAIKFTREGTIVVRAMLEDEHEDCAQLRISVQDTGIGLSPQDVRTLFQAFSQADNSLARQPGGTGLGLVISKRLIEQMGGEIGVDSTPGEGSQFWISLNLPKAHDDAEALPPQPLLGRRAAIVDGHELARQALEHQLEDCGLSVSLFASYDQLLQGVQAASQAGLPFEFAVLGANLGNLSPEQLGHYHQQLERYHCQCVVLCPTTEQALYHPYLPNGHGQLLSKPTCTRKLRRLLLELVQPRRPLAEGSNPNGQRRPKILCVDDNAANLLLVKTLLEDLGAEVLAVNNGYAAVQAVQEELFDLVLMDVQMPGMDGRACTEQIRLWENTQSGNPLPIVALTAHAMANEKRALLHSGMDDYLTKPISERQLAQVVMKWTGLSLGTPQQAQAELLTNGDELKVLDPEEGLRLAAGKADLAADMLSMLLASLDTDREAIRAARAADDRNGLIEQVHRLNGASRYCGVPQLRAACQRSETLLKQDNPQAQQALDELDSAISRLAAQARLSA

SEQ ID NO: 21279 - protein, 85 aa, Ixophorus unisetus
ECQKVGAPPEVSARLTAMTQELEARQRTAFGGLGAATEPELDQFMEAYHEMLVKFREELTRPLQEAMEFMRRVESQLNSLFISGR

SEQ ID NO: 21280 - protein, 326 aa, Pseudomonas fluorescens
MQLGIIGLGRMGGNIARRLMLNGHTTVVYDRNTAFVDTLAAEGSTGVADLPALVAGLAKPRAVWVMLPAGAPTEDTIETLSHLLEAGDTIIDGGNTNYKDDIRRAKTLAEKGLHYIDVGTSGGVWGLERGYCMMIGGDAETVKRLDPLFAALAPGMGDIPRTKDRKSDDHRAEHGYIHAGPAGAGHFVKMIHNGIEYGMMAAFAEGFDILKTKSSELLPEDQRFDLNVADIAEVWRRGSVVSSWLLDLTADALAVDPKLDGFSGSVADSGEGQWTIEAAMEQKVPVPVLSNSLFSRYRSRGQGTFGDKILSAQRFGFGGHVETPKK

SEQ ID NO: 21281 - protein, 81 aa, Oryza sativa
LDEASAVGEAMAMCNGLLKSKKKIFLITSNCSPQTIDLCQNRAGGFNLNVILTDPKDFDYTSCDLCRVLVHYPSPEGEVLG

SEQ ID NO: 21282 - protein, 647 aa, Gibberella zeae
MGVPSEREAGDGPPASSASNPRRTPGNQSYARVAAQGTDEQSPLLRHDADTDNAHGEHDDSQTTKSIWYLLLLTISIGGLQIAWSVELSNGSPYLLSLGLSKSLMALVWIAGPLTGTLVQPYVGMLSDNCRMPMGKRKPFMIGGSVATILSLLFLAWAKEIVACASNIIGFDPESQGVKTTTIVVAVVGVYVLDFAINTVQASIRAFIVDCAPAHQQESANAMASRITGFGNIVGYIAGYVDLTRHLGFLGKTQFQILCAIACVALALTVFVSTALIKERDPRLDGPAKKQEHGVISFFLTIFKSIKRLPPQIKRVCEVQFCAWVGFFPLLFYTSSYIGEIYVEPYLEANPHMPPEQLNKLYEQATRIGTFALLINSVVSLLTNVFLPFFIAPTYDSQPVNNVPGETPAAGHYDEDEDDKPSWLDKLAIPGLTLKRAWFLSLLLFAGCMFATLFVRTVKAATVLIGLVGITWAMTLWAPWAIISAEISRRDALIRAQRTRQATARANNGGIRGDEEEEEIDQAGVILGIHNMAIAAPQIIATVGSSVIFKLWQKPRGTPGDHSISIVFALGGICVLVSSFFVAKIKDDAAMPADVMIEAEEGQSGAAEVVERRPLNRRKSTRDQLPRATQARANLTRNKSFGGAEMY

SEQ ID NO: 21283 - protein, 615 aa, Propionibacterium acnes
MGPASLRQALPRSARPYPACAKDHLMTHVPCTPAAEIPETLAPTGALGLTSAQLQARLDEIHPVGSIDRTETEWFRTAVFYEVLVRSFKDSNGDGIGDFKGLTGKLDYLQWLGVDCLWLPPFYDSPLHDGGYDIRDYRWIREELGTIEDFKVFLDAAHDRGLRVIIDFVMNHTSDSHPWFQSSRADPDGPYGNYYVWSDTDEAYSDARIIFCDTEDSNWSWDSQRKQFYWHRFFHHQPDLNFEEPRVMEEMLDAVRFWMDLGIDGFRLDAVPYLIEAEGTNCENLPGTHKILKQLRAMVDEEYPGRILLCEANQWPDDVVEYFGNGDECQMAFHFPVMPRLYMGLRRGSRECISEILAHTPHIPDGCQWGTFLRNHDELTLEMVTEEDRHYMWEEYAPESRWRCNLGIRRRLSPLVDNDDAKIRLLNAMLLSLPGSPVLYYGDEIGMGDDPWLPDRDGVRTPMQWDDSETAGFSTALPEDFHLPLIRTFGHDPEHVNVARQMDDPSSLLVWTRAMLGIRRHHPVFGTGEFTDLGGPDMAVMSFLRHNEHETVLCLANFSDTERMVALHLPQFAGMTGSSLIHGQDAQPVKADGTLSVPLWPYGYRWLQMSREERS

SEQ ID NO: 21284 - protein, 299 aa, Pseudomonas putida
MTLQYPTIADCVGNTPLVRLQRIAGETSNTLLLKLEGNNPAGSVKDRPALSMIARAELRGQIKPGDTLIEATSGNTGIALAMAAAIKGYKMILIMPDNSTAERKAAMTAYGAELILVTKEEGMEGARDLAEKLQAEGRGLVLDQFANGDNPIAHYNSTGPEIWQQTQGTITHFVSSMGTTGTIMGCSQYLKEQNPAVQIIGLQPMEGSAIPGIRRWPEEYLPKIFDATRVDRVVDMSQQEAEDTTRRLAREEGIFCGVSSGGAVAAMLRLSREVENAVMVAIICDRGDRYLSTGLFDPR

SEQ ID NO: 21285 - protein, 275 aa, Streptococcus pyogenes
MGMMKRQFEDVTRIVIKIGTSSLVLPTGKINLEKIDQLAFVISSLMNKGKEVILVSSGAMGFGLDILKMEKRPTNLAKQQAVSSVGQVAMMSLYSQIFAHYQTNVSQILLTRDVVVFPESLANVTNAFESLISLGIVPIVNENDAVSVDEMDHATKFGDNDRLSAVVAGITKADLLIMLSDIDGLFDKNPTIYEDAQLRSHVAVITQEIIASAGGAGSKFGTGGMLSKVQSAQMVFENKGQMVLMNGANPRDVLRVLEGQPLGTWFKQIEEVTHD

SEQ ID NO: 21286 - protein, 706 aa, Propionibacterium acnes
MTDTNTAPFDTSALGSTLIDGGCRFGLWAPRAERVELALVADDGSQVNHDMTRDEHGVWTVEVSDVQAGQRYGYRVHGPWDPDRGMRFNPAKLLLDPYARAITAGVDYHGPIMDHTPESNYEPDLTDDATSVPLAVVIDDPGPPTPIARRHDISESVIYETHVKGYTRLHPLVPEHLRGTYAGLAYPAVIEHLKSIGVTAIELLPVQQFISEPFIVGRGLSNYWGYNTLGFFAPHAAYCSVGSMGTQVREFKDMVTSFHEAGIEVFLDVVYNHTGEGGHEGPTLSFRGIDHESYYRLTNDHRNDYDVTGCGNSVDTSHPEVLAMVLDSLRYWVTEMGVDGFRYDLATTLIRDKSHGVDQNHLFKQALVEDPILNKVKHIAEPWDLGPYGYQVGAWGPHWSEWNDRFRNYVRDFWRGAVRGVEELATRLCGSPDLYGQPTSSVNFITAHDGFTMRDLVTYNMKHNQGNGEDNHDGSNDNRAWNCGWEGETTDQSIVMLRHRQVRNLVATLLLATGVPMITAGDEMGRTQQGNNNAYCQDSPISWIDWEDAEAWSDVTDLVKIITALRREHPALRPSRYRHHDPVGDANDSYPRRADLAWFSGHGGEMVNNDWHDESRRTLGMYTSDDNEAFLIWFHAGDRPIEIILPSVRWGESWHVVASTALPGEIPDEAVPAGLSVTLPSRCVVVMQASPFGLTAPLRAKRTLGG

SEQ ID NO: 21287 - protein, 294 aa, Staphylococcus haemolyticus
VLGVSKDASKDEIKKAYRKLSKKYHPDINKEEGADEKFKEISEAYEVLSDDNKKANYDQFGHDGPQGGFGGQGFSGQDFSGFGGGGFEDIFSSFFGGSRQRDPNAPRKGDDLQYTMTLEFEEAVFGTKKEISIRKDVTCHTCNGDGAKPGTSKKTCSYCNGAGHVSVEQNTILGRVRTQQTCPKCDGTGQEFEEPCPTCHGKGTENKTVKLEVTVPEGVDNDQQIRLAGEGTPGENGGPHGDLYVVFRVKPSDKFERDGDDLYYNLDVSFPQASLGDEIKVPTLNGNVMLTIPS

SEQ ID NO: 21288 - protein, 586 aa, Medicago sativa
MCGILAVLGCSDDSQAKRVRILELSRRLKHRGPDWSGLHQHGDNYLAHQRLAIVDPASGDQPLFNEDKSIIVTVNGEIYNHEDLRKQLPNHKFRTQCDCDVIAHLYEEYGENFVDMLDGIFSFVLLDTRDNSFIVARDAIGVTSLYIGWGLDGSVWIASELKGLNDECEHFEVFPPGHLYSSKDREFRRWYNPPWFNEAVIPTTPYDPLVLRNAFEKAVIKRLMTDVPFGVLLSGGLDSSLVAAVTARYLAGTKAAKQWGAKLHSFCVGLKGAPDLKAGREVADFLGTVHHEFQFTIQDGIDAIEDVIYHTETYDVTTIRAATPMFLMSRKIKSSGVKWVISGEGSDEIFGGYLYFHKAPNKEEFHQETCRKIKALHRYDCLRANKSTYAWGLEARVPFLDKDFIKVAMDIDPEYKMIKHEEGRIEKWILRKAFDDEENPYLPKHILYRQKEQFSDGVGYGWIDGIKDHAAKHVTDRMMLNASHIFPFNTPLTKEAYYYRMIFERFFPQNSARLTVPGGASVACSTEKAIEWDASWSSNLDPSGRAAFGVHNSAYENQVNSVAKTVEPEKIIPKMEISNLGVAIQS

SEQ ID NO: 21289 - protein, 706 aa, Yersinia enterocolitica
MLTPIIRKFQYGQHTVTIETGMMARQATAAVMVSMDDTAVFVTVVGQKKAKPGQSFFPLTVNYQERTYAAGRIPGSFFRREGRPSEGETLTSRLIDRPIRPLFPDSFLNEVQVIATVVSVNPQINPDIVALIGASAALSLSGIPFNGPIGAARVGFINDQYVLNPTTDELKESRLDLVVAGTAGAVLMVESEADILSEDQMLGAVVFGHEQQQVVIENINALVAEAGKPKWDWHAEPVNEALHARVAELAAARLGDAYRITEKQERYTQVDAIKADVTEALLAQDDTLDAAEIQDILGSVEKDVVRSRVLRGEPRIDGREKDMIRGLDVRTGVLPRTHGSALFTRGETQALVTATLGTARDAQNIDELMGERTDSFLLHYNFPPYSVGETGMVGSPKRREIGHGRLAKRGVLAVMPSPSEFPYTVRVVSEITESNGSSSMASVCGASLALMDAGVPIKAAVAGIAMGLVKEDENFVVLSDILGDEDHLGDMDFKVAGSRDGITALQMDIKIEGITREIMQVALNQAKGARLHILGVMEQAISTPRGDISEFAPRIYTMKINPEKIKDVIGKGGSVIRALTDETGTTIDIEADGTIKIAATDGDKAKHAIRRIEEITAEIEVNRIYAGKVTRIVDFGAFVAIGGGKEGLVHISQIADKRVDKVTDYLQMGQEVPVKVIEVDRQGRIRLSMKEATTPDAEAPAPEAAE

SEQ ID NO: 21290 - protein, 277 aa, Beta vulgaris
  misc_feature (15)..(15): Xaa can be any naturally occurring amino acid
EDLQLLPKILTWCRXIHLFVGVVYCLISWTVGLPKRAPIDGTLLKLLIPVAVCHALGHVTSNVSFAAVAVSFTHTVKALEPFFNAAASQFILGQPIPITLWLSLAPVVIGVSMASLTELSFNWLGFISAMISNISFTYRSIYSKKAMTDMDSTNIYAYISIIALFVCLPPAIIVEGPQLIKHGFNDAITKVGLTKFVSDLFWVGMFYHLYNQLATNTLERVAPLTHAVGNVLKRVFVIGFSIIIFGNKISTQTAIGTSIAIAGVAIYSFIKAKMEEE

SEQ ID NO: 21291 - protein, 293 aa, Staphylococcus hominis
VLGVSKDASKDEIKKAYRKLSKKYHPDINKEEGADEKFKEISEAYEVLSDDNKRANYDQFGHSGAQGGFGSQGFGGQDFSGFGGGFEDIFSSFFGGSRQRDPNAPRKGDDLQYTMTLEFDEAVFGTKKEISIRKDVTCHTCHGDGAKPGTSKKTCSYCHGSGHVSVEQNTILGRVRTEQTCPKCEGSGQEFEEPCPTCHGKGTENKTVKLEVTVPEGVDNEQQIRLAGEGAPGENGGPHGDLYVVFRVKPSDKFRRDGDDLFYELNISFPQASLGDEIKVPTLNSNVMLTIPA

SEQ ID NO: 21292 - protein, 701 aa, Pseudomonas putida
MNPVIKTFQFGQSTVTLETGRIARQATGAVLVTVDNDVTVLVTVVGAKQADPGKGFFPLSVHYQEKTYAAGKIPGGFFKREGRPSEKETLTSRLIDRPIRPLFPEGFMNEVQVVCTVVSTSKKTDPDIAAMIGTSAALAISGIPFEGPIGAARVAFHESTGYLLNPTYEQLAASSLDMVVAGTSDAVLMVESEAQELTEDQMLGAVLFAHDEFQAVIQAVKELAAEAGKPTWDWKPAVANTELFNAIRAEFGEAVSQGYTITVKADRYARLGELRDQAVAKFSGEEGQPSASEVKEIFGEIEYRTVRENIVNGKPRIDGRDNKTVRPLNIEVGVLPKTHGSALFTRGETQALVVATLGTARDAQLLDTLEGEKKDPFMLHYNFPPFSVGECGRMGGAGRREIGHGRLARRSVQAMLPAADVFPYTIRVVSEITESNGSSSMASVCGASLALMDAGVPMKAPVAGIAMGLVKEGDKFAVLTDILGDEDHLGDMDFKVAGTAKGVTALQMDIKINGITEEIMEIALGQALEARLNILGQMNQVIGQSRTELSANAPTMIAMKIDTDKIRDVIGKGGATIRAICEETKASIDIEDDGSIKIFGETKEAADAAKQRILGITAEAEIGKIYVGKVERIVDFGAFVNILPGKDGLVHISMLSDARVEKVTDILKEGQEVEVLVLDVDNRGRIKLSIKDVAAAKASGV

SEQ ID NO: 21293 - protein, 468 aa, Corynebacterium glutamicum
MNDPQRSPTLLWFRDDLRLSDNAALKWAADHGPVIGLFIDETINRSIGAAARWWREQSLNALAQDLSFYGVPLLRRTGNPLEILPKIVSEMEVKAVTWNRRYHQPLCEVDATLKKNLRDKGIEVHSHPGFLLTEPWEVSTATGTPYKVFTPFSKAAWEVARVHAYETVKNNVPVPSHLTGPEDVELPILEMEQPFWSTTLVKECAPGEKNASEKLFDFLEHLQDYPQARDSLARSATSKLSAHLRFGEISIHRVWAETAAIDSEGTELFLKELLWRDFAWHRLYALPHMDTQNVRMQFNRFGWSWDPSEKDKLNTPSTPLIPTKADQFHEDLAAWRAGKTGIPLVDAGMRELWATGSMHNRVRMVVASFLTKNLQIHWRHGEEWFWETLVDADPASNAFNWQWAAGSGDDASPYFRIFNPVTQAKKFDPDETYIRRWVPEYGTPSYPDPIVDLKESRQIALDAYSAIK

SEQ ID NO: 21294 - protein, 491 aa, Yarrowia lipolytica
MTFQEKIKEYPVTLPASQGPLLKSVQDWAFSNGLTMLTDDPATAVHAPVTLHPSPFPRSVFDESIEAQRGFNTLYSKISSFTNNNWLDKIIDKLAPSDPDFTGKLWETHKLSLVDGKPIQPLTLGLFRSDYMIDQKDGNLTPKQVEFNTVSVSFGGLTSKVADLHRYLAATGAYGDDAKFDLDDIPRSNSISELANGLAQAHKAYVAQNGAQKSKTAVLAVVEKHEKNAIDQRHLEYQLWDNHGIVTHRVSMLEATKVTEIRDLDGVSRLYYNDAEVSVVYFREGYSPDHFPTQAHWDARLYLEKNRAIKCPSVYTQLAGAKKVQQILTDKSELLKFVSEKDIGPLVNTFVEILPLGEDSEGGKRAEQLARTEPERFVLKPQREGGGNNIYKQDIPGFLEKLPKNEWSAYILMELINPPVIQNHILRKGELFTGDTLSELGVFGTVLWNSENGEILHNDTTGWLLRTKLESSNEGGVAAGFGCIDGVYLVD

SEQ ID NO: 21295 - protein, 292 aa, Staphylococcus hyicus
VLASKSASKDEIKKAYRKLSKKYHPDINKEEGSDAKFKEISEAYEILSDDQKRQQYDQFGHAGAQGGFSQGFGGQDFSGFGGSGFEDIYSSFFGGQRQRDPNAPRKGDDLQYTMTITFEEAVFGTKKEISIRKEVTCHTCNGNGAKPGTKKKTCSYCKGSGHVSVEQNTILGRVRTEKVCPQCNGSGEEFEESCPTCHGRGTQTKNVKLEVTVPEGVDNDQQIRLAGEGAPGENGGPAGDLFVVFRVKPSDKFTRDGDDILFKQNISIAQAALGDEIKVPTLNGQVMLTIPA

SEQ ID NO: 21296 - protein, 989 aa, Methylobacterium extorquens
MSNGPEPHGNKIEQPEIRADERQDAGGPANGAPSTSGGAYSQGAKSGGQAAPDPSGSYGIKDAPVAPATIAFEFDGQQVEAQPGETIWAVAKRLGTHIPHLCHKPDPGYRPDGNCRACMVEIEGERVLAASCKRTPAIGMKVKSATERATKARAMVLELLVADQPERATSHDPSSHFWVQADVLDVTESRFPAAERWTSDVSHPAMSVNLDACIQCNLCVRACREVQVNDVIGMAYRAAGSKVVFDFDDPMGGSTCVACGECVQACPTGALMPAAYLDANQTRTVYPDREVKSLCPYCGVGCQVSYKVKDERIVYAEGVNGPANQNRLCVKGRFGFDYVHHPHRLTVPLIRLENVPKDANDQVDPANPWTHFREATWEEALDRAAGGLKAIRDTNGRKALAGFGSAKGSNEEAYLFQKLVRLGFGTNNVDHCTRLCHASSVAALMEGLNSGAVTAPFSAALDAEVIVVIGANPTVNHPVAATFLKNAVKQRGAKLIIMDPRRQTLSRHAYRHLAFRPGSDVAMLNAMLNVIVTEGLYDEQYIAGYTENFEALREKIVDFTPEKMASVCGIDAETLREVARLYARAKSSLIFWGMGVSQHVHGTDNSRCLIALALITGQIGRPGTGLHPLRGQNNVQGASDAGLIPMVYPDYQSVEKDAVRELFEEFWGQSLDPQKGLTVVEIMRAIHAGEIRGMFVEGENPAMSDPDLNHARHALAMLDHLVVQDLFLTETAFHADVVLPASAFAEKAGTFTNTDRRVQIAQPVVAPPGDARQDWWIIQELARRLDLDWNYGGPADIFAEMAQVMPSLNNITWERLEREGAVTYPVDAPDQPGNEIIFYAGFPTESGRAKIVPAAIVPPDEVPDDEFPMVLSTGRVLEHWHTGSMTRRAGVLDALEPEAVAFMAPKELYRLGLRPGGSMRLETRRGAVVLKVRSDRDVPIGMIFMPFCYAEAAANLLTNPALDPLGKIPEFKFCAARVVPAEAAPMAAE

SEQ ID NO: 21297 - protein, 294 aa, Staphylococcus intermedius
VLGVSKSASKDEIKKAYRKLSKKYHPDINKEEGSDEKFKEISEAYEVLSDENKRAQYDQFGHSGPQGGFGQGFGGQDFSGFGGGGFEDIFSQFFGGAQRQRDPNAPRRGDDLQYTMTVTFDEAVFGTKKEISIRKEVTCHTCDGEGAKPGTKKKTCSYCHGAGHVSVEQNTILGRVRTEKVCPECNGTGEEFEEPCPTCHGKGTELKNVKLEVTVPEGVDNDQQIRLAGQGGPGENGGPAGDLFVIFRVQPSDKFTREGDDILYNHNISFAQAALGDEVKIPTLNGHVMLTVPE

SEQ ID NO: 21298 - protein, 862 aa, Nicotiana tabacum
MLGVDEKDRVPGGNRKTYARSVSWSDRSPTKSSAKPQWNSKARACLPPLQPLSITRPTAEEWPCAGSDDLGVWPNNPPTPGVRLGPVSTHVGSATKRVPREFEFKKDKLAFFNKECSKIVDHIYLGSDTVAKNRDILHENGITHVLNCVGFSCPEYFKDDLVYKTLWLQDSPTEDITSILYDVFDYFEDVREQGGRVFVHCYQGVSRSTSLVIAYLMWKEGLSFEDAFQHVKAARGVTNPNMGFACQLLQCQKRVHALPVSPSSVLRMYRMAPHSPYDPLHLVPKMLNEAGAEGFDSRGAFLVLIPSAIYVWIGKHCDSVMSDNARAAAFQVIRYEKAQGPVIIINEGKEPSDFWSALSHGSFFTGGCSKEKTKVEASLLDGTTGTITDNIIQYIGQQKVGEYDLDFEIFYKALAGGVVPPFPLSGTESEMRLPARENGWSRLRRKFSSGIMKEFITASKLYSHTGGQASPVLDKMDTSKEISPALPSSPSSPQCDSPDSFSSYATSSPSFRDVGNSGLDSEPLLSPSPSFSSLDSLSCFLVNKPKSDTTSPSLSPSTSDYSSSFTFSPSSSNWSDLAYLSAQPSPTRFEYEDPNFVKNDSFKESSSLLCKETSLPAEEAFPTCHTLGQANSCLLYKEAFPSLAERRGSHPPPRMMLRCNDDSTQISAKLVRTSSFSLPSFGDDTIKCLECDNLNDGDFADTSKEELMLDAESSITDNQLPNGVQPDDVSRSFYDHPIVVADTTDLGLYQWPSMHKLGLASGFFDSRSVYIIVIPDLNLDENSSNSLYIWVGRDVQWKESPNQVINNESMCEDGHVHWEKVGRRFLIQKGLATSSLVQIVKEGEEPEQLLKHLPCFSLEKTY

SEQ ID NO: 21299 - protein, 502 aa, Streptomyces coelicolor
MTSSTETTATTPQVAVNDIGNEEAFLAAIDETIKYFNDGDIVDGVIVKVDRDEVLLDIGYKTEGVIPSRELSIKHDVDPNEVVAVGDEIEALVLQKEDKEGRLILSKKRAQYERAWGTIEKIKEEDGIVTGTVIEVVKGGLILDIGLRGFLPASLVEMRRVRDLQPYVGKELEAKIIELDKNRNNVVLSRRAWLEQTQSEVRQTFLTTLQKGQVRSGVVSSIVNFGAFVDLGGVDGLVHVSELSWKHIDHPSEVVEVGQEVTVEVLDVDMDRERVSLSLKATQEDPWQQFARTHQIGQVVPGKVTKLVPFGAFVRVDEGIEGLVHISELAERHVEIPEQVVQVNDEIFVKVIDIDLERRRISLSLKQANEAFGADPSTVEFDPTLYGMAASYDDQGNYIYPEGFDPETNDWLEGYETQREAWETQYAEAQTRFEQHQAQVIKSREADEKAAAEGVDTAGAAPAASGGGGGGSYSSEGGDNSGALASDEALAALREKLAGGQS

SEQ ID NO: 21300 - protein, 794 aa, Triticum aestivum
  misc_feature (226)..(226): Xaa can be any naturally occurring amino acid
VTLQNKFVQKSRLRTGPEFPGYRRPTRPSSGDVCGVLVQYPGTEGEVLDYAEFVKDAHAHGVKVVMATDLLALTTLRPPGEIGADIAVGSAQRFGVPMGYGGPHAAFLATSQEYKRLMPGRIIGVSVDSSGKPALRMAMQTREQHIRRDKATSNICTAQALLANMAAMYAVYHGPAGLKAIADRVHGLAGTFAHGLKKLGTVTVQELPYFDTVKITCADANAIAEXEARKSEMNLRVVDANTITVAFDETTTLEDVDKLFKVFSGGKPVDFTAESIAPEVSSSIPPSLVRDSPYLTHPIFSMYHTEHELLRYLHKLQSKDLSLCHSMIPLGSCTMKLNATVEMMPVTDPKFANMHPFAPIDQAAGYHEMFDNLGDLLNTITGFDSFSLQPNAGASGEYAGLMVIRAYHKARGDHHRNVCIIPVSAHGTNPASAAMCGMKIVAVGTDAKGNINIEELRKAAEANKDNLSALMVTYPSTHGVYEEGIDEICRIIHENGGQVYMDGANMNAQVGLTSPGFIGADVCHLNLHKTFCIPHGGGGPGMGPIGVKKHLAPFLPSHPVIPTGGFPLPEKTNPLGSISAAPWGSALILPISYTYIAMMGSQGLTEASKIAILNANYMAKRLEKHYPVLFRGVNGTVAHEFIIDLRGFKATAGIEPEDVAKRLMDYGFHGPTMSWPVPGTLMIEPTESESKAELDRFCDALISIREEIAEVENGKADAHNNVLKGAPHPPQLLMGDAWTKPYSREYAAFPAAWLRGAKFWPTTCRVDNVYGDRNLICTLQQASQVAEEAAAATA

SEQ ID NO: 21301 - protein, 487 aa, Bacillus licheniformis
MTITFQDFQLSSDLTKAIKRMGFEEATPIQAQTIPLGLANKDVIGQAQTGTGKTAAFGIPLVEKINPESPNIQAIVIAPTRELAIQVSEELYKIGQDKRARVLPIYGGQDIGRQIRALKKNPHIIVGTPGRLLDHINRRTMRLQTVNTVVLDEADEMLNMGFIEDIESILSNVPAEHQTLLFSATMPAPIKRIAERFMTNPEHVKVKAKEMTVSNIQQFYLEVHERKKFDTLTRLLDIQSPELAIVFGRTKRRVDELTEALNLRGYTAEGIHGDLTQAKRMVALRKFKQGAIEVLVATDVAARGLDISGVTHVYNFDVPQDPESYVHRIGRTGRAGKTGMAMTFITPREKDMLRAIEQTTKRKMDRMKAPTLDEAIEGQQQVTVDRIRTIIEENNLNFYMTAAAELLEDHDSVTVVAAAIKMMTKEPDNTPVRLTEEAPLRTKRNKNHHHRSSKRRDGGGYRGKNNRSSYDKKRSSNDRRQKKSYNS

SEQ ID NO: 21302 - protein, 989 aa, Bordetella parapertussis
MLLTKKTSGAAAGASESHFIQSLRRGMAQALPTMDRRTFLRRSGLGVGAGLAATQLALVKRAEAAEGDGKVAIGNTKIEVRRTVCTHCSVGCAVDAVVENGVWVRQEPVFDSPINLGAHCAKGASVREHGHGEHRLRYPMKLVNGKYQRISWDTAYEEITAKLMQLRKESGPDSVYWIGSSKHNNEQSYLLRKFVSFWGSNNCDHQARICHSTTVAGVANTWGYGAMTNSYNDMQNSKVALYIGSNAAEAHPVSMLHMLHAKETGCKMIVVDPRFTRTAAKADQYVRIRSGTDIPFLFGLLYHIFKNGWEDQAYIDARVYGMDEVKADILAKWSPDKVEEACGVDEATMYSVAKTMHENRPGTLVWCMGQTQHSIGNAMVRASCIVQLALGNVGKSGGGANIFRGHDNVQGATDVGPNPDSLPGYYGLAEGSWKHFANTWGVDYEWIKGRYASPAMMTKPGITVSRWIDGVLENPDLIDQDTNLRAVFYWGHAPNSQTRGLEMKRAMDKLDLLVVVDPYPSATAAMAAMPGKAEDLNPNRAVYLLPAATQFETNGSCTASNRSLQWREKVIDPLWESRTDHMIMYQLAEKLGFGKELSKNYKMQKVKGMDEPVVEDILREINASVWTIGYTGQSPERLKAHMRNMHVFDVKTLRAKGGKDAETGYDLTGDYFGLPWPCWGNPSLKHPGTANLYDTSLHVMDGGGNFRANFGVERNGVNLLAADGSHSKGADLTTGYPEFDHVLLKKLGWWEDLTPEEQKAAEGKNWKTDPSGGIIRVTMKVHGCHPFGNARARAVVWNFPDAIPQHREPIYGTRPDLVAKYPTHNDLKTFWRLPTLYTSLQQKNVAEKLYEKFPIILTSGRLVEYEGGGEETRSNPWLAELQQESFVELNPKAAADRGIRNGDRVWVLTPTGARLNVQALVTERVGPDTAFMPFHFSGHWQGVDMLASYPEGAAPIVRGEAVNTGTTYGYDSVTMMQETKTTICNIEKA

SEQ ID NO: 21303 - protein, 150 aa, Vibrio parahaemolyticus
FQGISAKTDAGEPCCDWVGNDGAGHFVKMVHNGIEYGDMQLITEAYQFMKDGLGMSADEMQAVFAEWNNTELNSYLVEITADILGYKDEDGEPLVEKILDTAGQKGTGKWTGINALDLGIPLTLISESVFSRCLSALKEQRVEAEKLFGK

SEQ ID NO: 21304 - protein, 769 aa, Ustilago maydis
MGVITHPNIRDGWFHETNSQWPGQAMSLEVQRILHHEKSLFQDVLVFESTTFGNVLVLDGVIQCTERDEFSYQEMIAHLPIASHPNPERVLVIGGGDGGVLREVVKHDSVKEAVLCDIDEAVPRVSKQYLPHMAEGLTHPKSTVIIGDGFAFLQDPKNKASFDVIITDSSDPVGPAEALFQQPYFALLKEALKPGGHISTQAECVWIHLNLIGELRRSTKELFPVADYAFTTIPTYPSGQIGFVVCSLDANRNVREPLREVPDCRYYNSQVHKAAFTVPEFARKVIEDGAPAPGRVIPTGEGIAKTQRAPKKILLLGSGYVAGPFAQYVTRFPEYSLTVASSKLEHSERLTQGLHNASAAAVDVNDAAALSALVKGHDIVISLIPYIYHAAVIKAACEHKVNVVTTSYVSDAIRALEPEIQKAGITVMNEIGLDPGLDHLYAVKAIDDVHAEGGKIKSFLSYCGGLPAPEAADNPLGYKFSWSSRGVLLALRNTAKFWQDGQELTVSGHELMAAAKSFYINPAFAFVAYPNRDSTPFKQWYNIPEAETVIRGTLRYQGFPEFILALVKLGFLDEESKPFLAYNTKATWAEVTANMVGASSTSETDLIAAVKAKVSFKSAQEEETIIRGLRWLDLFSTTAPVTVRGTAAQEAAQVAGNPLDSLCATLEDKCAYAPGERDMVMLQHKFEIETASGEHKTLTSTLLDYGIPHGVTSMAKLVGVPCAIATRLILEGHPALSKTGILAPYTKDICDPIRLELEKEGIALEERYV

SEQ ID NO: 21305 - protein, 421 aa, Pseudomonas syringae
MTESVLDYMTRLGRAAREASRVIGRASTAQKNRALQATAAALDEARAELSAANALDLANGQANGLEPAMLERLALTPARIDGMIVGLRQVAALADPVGAIRDMSYRPSGIQVGKMRVPLGVVGIIYESRPNVTIDAASLCLKSGNATILRGGSEAIHSNRAIAACIERGLAEAGLPAAVVQVVETTDRAAVGALISMPEYVDVIVPRGGKGLIERVSRDARVPVIKHLDGICHVYVSAHADLPKAQKIAFNAKTYRYGICGAMETLLVDQTIAADFLPSMAAQFREKGVELRGCERTRELIDVIPATEDDWHTEYLDAILSIRVVSGLDEAIEHINHYGSHHSDAIVSDHQSQVRRFMAEVDSSSVMVNAPTCFADGFEYGLGAEIGISTDKLHARGPVGLEGLTCEKYIVIGDGQLRGQA

SEQ ID NO: 21306 - protein, 693 aa, Oryza sativa
MASGNSSSSSGSMAATAGGVGGWLGFSLSPHMATYCAGGVDDVGHHHHHHVHQHQQQHGGGLFYNPAAVASSFYYGGGHDAVVTSAAGGGSYYGAGFSSMPLKSDGSLCIMEALRGGDQEQQGVVVSASPKLEDFLGAGPAMALSLDNSAFYYGGHGHHQGHAQDGGAVGGDPHHGGGGFLQCAVIPGAGAGHDAALVHDQSAAAVAAGWAAMHGGGYDIANAAADDVCAAGPIIPTGGHLHPLTLSMSSAGSQSSCVTVQAAAAGEPYMAMDAVSKKRGGADRAGQKQPVHRKSIDTFGQRTSQYRGVTRHRWTGRYEAHLWDNSCKKEGQTRKGRQGGYDMEEKAARAYDLAALKYWGPSTHINFPLEDYQEELEEMKNMSRQEYVAHLRRKSSGFSRGASIYRGVTRHHQHGRWQARIGRVSGNKDLYLGTFSTQEEAAEAYDVAAIKFRGLNAVTNFDITGYDVDKILESSTLLPGELARRKGKDIVSTVDAAGAPPRAPHMSMAATSLGNSREQSPDRGVGGGGGGGVLATLFAKPAAASKLYSPVPLNTWASPSPAEQRVGFAKPNSLWWCLSSQSKLKAHSRSNGGRKPSRGSEKNPPNPCMTFSASLDRTNEFEDATLHVDVILLKVHLVYTLGVSSVAASPRVTEDVALSCVFLHYSLTWELIPSAQPSFVRYVQPSSECKLTD

SEQ ID NO: 21307 - protein, 257 aa, Propionibacterium freudenreichii
MTTTLLPGTVTLVGAGPGDPELVTVAGLRAVQQAEVILYDRLAPQDLLSEASDDAELVPVGKIPRGHYVPQEEINQLLVAHAREGRKVVRLKGGDSFVFGRGGEEWQACAEAGIPVRVIPGVSSATAGPALAGIPLTHRHLVQGFTVVSGHVSPSDERSEVPWRQLAKDRLTLVILMGVAHMRDIAPELMAGGLPADTPVRVVSNASLASQESWRTTLGDAVADMDAHHVRPPALVVVGTLAGVDLSHPDHRAPSDH

SEQ ID NO: 21308 - protein, 494 aa, Unknown
  marine gamma proteobacterium HTCC2207
MTSSALDTPNLVLRAPYQNIGLIAGPALFALMMLLGTQQNIMGTEAWRTAAVGLWMAIWWATEAIPVPVTAFLPLVTFDFLGIANANEAAAPYSNPIIYLFLGAFILALSIERWNLHKRIALIILSHTGTEGRRLIFGFMLVAALLSMWMTNTSTTMMLMPIAISVAKVIVDNVDGLSARQGRDFQIAMLLGLAFAATIGGMATLVGTPPNALLAAFLSENYGIEISFVRWMMVGLPLSIIMLPLAWVVLTRIAFNVEVPESDTVRNYLVQRKQEMGPVSVPEKRVAIIFALVITGWMLRRPISGWMSIEGLSDTGIAMAGALVLFLIPSGDRHQPHLMTWHDITGLPWGVLILFGGGLSLASAVAKSGLALWLGESLLPISSMGMIFMIIAATGLVIFLTELTSNLATTAIFLPVVAAIAIQSGIPPLIICIPVTLAASCAFMLPVSTPPNAIVYSSGMLTIPNMVKAGVLLNLAGICFLTILAIWLTPIVFG

SEQ ID NO: 21309 - protein, 95 aa, Glycine max
  misc_feature (74)..(74): Xaa can be any naturally occurring amino acid
FYFSPGIMLLIYAKASSHVPLKILSIEDGTGLKSFSHLLYRNKKVDFIEQFNEKLLVKQENENLQILDVRTFDXTEVCRSEFMTPSAFIFLYENQ

SEQ ID NO: 21310 - protein, 547 aa, Pseudomonas aeruginosa
MAKAADVVVQCLENEGVQYVFGIPGEENLDLLESLRKSQIRLVLTRHEQSAGFMAATYGRLTGKTGVSLSTLGPGATNLVTAGAYAYLGGMPMLMITGQKPIKKSKQGRFQILDVVGMMQPLTKYTHQLASADNIPSRVREAFRLAEEEKPGAVHLELPEDIAAEQTDSLPIPPSLSRRPLAEYKAICAAVEKLRAARSPILVIGAGANRKMTAKVLKQLIDKTGIPFVTTQMGKGVVDERHPRFLGNAALSAGDFVHRAVEAADLIVNVGHDVIEKPPFFMVRGGTEVIHVNFRSAEVDPVYFPQIEVVGDIANAIWQIGEALDDTAHWDFTRLLAIREANEAQVAEGADDPRFPLYPQRLVADVRRALPSQGIVALDNGMYKIWFARNYKAHMPNTVLLDNALATMGAGLPSAMAAHLVYPDRPIVAVCGDGGFMMNSQELETAVRLKMNLTVIILRDNGYGMIRWKQSNMGFADFGLDYGNPDFVHYAEAYGAHGHRVDSAEGFLPLLERCLGTPGVHVIDCPVDYSENDRILNVELRERALAV

SEQ ID NO: 21311 - protein, 555 aa, Triticum aestivum
SQKPSFFPLSTSCLPTGSLPAMESVGVAPAPAAVAVAEQKMKLLEPRKEPLASAAAAAAKAPCKWAMKKKLVGGDAGYVLEDVPHLTDYMPELPTYPNPLQDNPAYSVVKQYFVNTDDTVTQKIVVRKNSARGTHFRRAGPRQRVYFQPDDVNAAIVTCGGLCPGLNTVIRELVCGLYDMYGVTSVVGIEGGYKGFYSRNTVTLTPKSVNDIHKRGGTILGTSRGGHDTAKIVDSLQDRGINQVYIIGGDGTQQGASVIYEEVRRRGLKCAVVGVPKTIDNDIAVIDKSFGFDTAVEEAQRAINAAHVEAESAENGIGVVKLMGRNSGFIAMYATLASRDVDCCLIPESPFYLEGKGGLLEFVERRLKDSGHMVIVVAEGAGQDLIAQSMNFVDTQDASGNKLLLDVGLWLSQKIKDHFKKKTNFPITLKYIDPTYMIRAVRSNASDNVYCTLLAHSALHGAMAGYSGFTVAPVNGRHAYIPFYRITEKQNKVVITDRMWARVLCSTNQPCFLSHEDVENMKHDDDERHHLHNTQLLDGSPAKCSPNCNGSAGAE

SEQ ID NO: 21312 - protein, 66 aa, Zea mays
NSEGNCWTMKVRTEEQLKEAIATATGAKKDCLCFIEVIVHKDDTSKELLEWGSRVSAANSRPPNPQ

SEQ ID NO: 21313 - protein, 540 aa, Gibberella zeae
MRLSTSALVLGAASSAMGLEQQILGGDSKPLIDLDVNAWTKPLEKFFGEISSEAKAVWDEVTLLAPDAVEAFKKQVLTEPKKVNRRPDSHWDHVVKGADVQSLWTEKNGEKHREVGGKLENYNLRAKKVDPSKLGVDKVKQYSGYLDDEEEDKHLFYWFFESRNDPKNDPVVLWLNGGPGCSSLTGLFLELGPASVNKKIEIVNNPESWNNNASVIFLDQPVNVGYSYSGGSVSNTVAAGKDIYALLTLFFHQFPEYAKQDFHIAGESYAGHYIPVFANEILSHDDRNINLKSVLIGNGLTDGYTQYAYYRPMACGDGGYPSVLSESECQSMDNALPRCQSLIKGCYESGSAWSCVPASIYCNNAMMGPYQRTGQNVYDIRGKCEDGNNLCYSGLGYIADYLNREEVKEALGAEVSSYDSCNMDINRNFLFAGDWMQPYHQLVPNVLDKIPVLIYAGDADFICNWLGNQAWTDKLQWSGQKDFSHADLKPLKHAGKEYGKVKSSGNFTFMQIYGAGHMVPMDQPEASSDFFNRWLSGEWF

SEQ ID NO: 21314 - protein, 916 aa, Dechloromonas aromatica
MQKTLLRQLKRSIGVGSEAELADLLASIRTAGTTLEPAFRGILEGLGDLLSRVDASYEQYERDLELRTRSLEISSAELSAANEKLRQSLAGRDNALRSLRKTIRDHLPEANEDAETLAEEDIAVLSRRVAAMVAESEHGLRELANQKFALDQHAIVSITDTAGIITYANDRFCAISGYAREELIGQNHRIVNSGIHPPELFRDMWHTIVLGKVWHGEVCNRARDGHLYWVNATVVPLLDAKGEPERYIAIRTEITDRKRMEAQLSEQLHLVEELIENIPLPIYLKDGSGRYIRLNRAFEQFFEVRREAFIGRTLHDLLPAEDARQHAEMDADLFAAKGTQTYEATVHSQDGIAHETIYRKAVLTRRDGSVSGLLGIIVDITDRKRAEIEVLRAKEAAEAANRAKSDFLANMSHEIRTPMNGVIGMTDLALETALTEEQREYLNIAKSSAESLLTVINDILDFSKIEAGKLQVEDIPFDLHRLIADTLKPLALRAHEKDIEILSDVVHDVPRFVKGDPSRIRQVLVNLVGNAIKFTEQGEIALQADLMQLQNGHAVIHFAVRDTGIGISADKQMLIFDAFAQEDSSTTRKYGGTGLGLSICRRLVELMGGTLWLHSEPGKGSTFHFSVQLQISENAIPLVIHPVDVTGRHMLIVDDNATNRRILRGMLATLHVTCQEADSGKTALALMREQGSQFDCILLDAQMPEMDGYELARHLHAEHPALPPMLMLSSGALRGDALRCQEAGIAGFFAKPISSDELLSALGRLFDNSPKESSPEPSPLLTRHSLREAQRVLNILLVEDHPTNQKLALGLLNKWGHHGTLAQNGQEALDILASQSFDIILMDMQMPVMSGVEATQRIRAREAAMQLPRTPIIAMTAAAMQDDRDACLAAGMDDYLAKPIKVKELQALLLAYTSAP

SEQ ID NO: 21315 - protein, 106 aa, Ureaplasma parvum
MLIKLESNQNLNELLKENHSKPILIDFYADWCPPCRMLIPVLDSIEKKHGDEFTIIKINVDHFPELSTQYQVKSIPALFYLKNGDIKATSLGFIDENSLVNKLRSI

SEQ ID NO: 21316 - protein, 199 aa, Salinibacter ruber
MASNMPATRDLLETPVQPTDAAVTVQGERFRRYLSAERIKKRVAEMGKTIARDYATTTPILVSVLNGAFMYTADLMRAIDTDCEIDFIKLSSYGDEKVSSGEVRELKSVDAELEGRDVLVVEDIVDTGLSMEFMKRRLAEYNPASLRVSTLLHKPTATEPDLTLDYVGFRIPDLFVIGYGLDYGQLARNLSDIYILDEG

SEQ ID NO: 21317 - protein, 83 aa, Glycine max
SRADSARGKLFYNAVTVKCCRPFPKKLDTPRKSEIVFIAPTGDEISTKKQLEQYLKAHPGNPVISEFDWGTGETPRRSARISE

SEQ ID NO: 21318 - protein, 555 aa, Unknown
  Burkholderia sp. 383
MFCYQCEQTDRTGARPGCASAKGNCGKDATTADLQDLLVHAVKGIAQYGAIARAMGAPDRDADRFVLYAMFTTLTNVNFHAARFVALLREAAQMRDRVKAACDASARAAGTVVPAQHGPAMWQPADDLAGLLEQAARVGVDNGLDKVGADIVGLRALVLYGLKGVCAYAHHARVLGYERDDIYEGIEAALAFLARDPDDVNALLTQALGLGRLNLTVMELLDSANTGRFGAQQPTAVRVSPVAGKAILVSGHDLGDLHALLEQTAGTGIHVYTHGEMLPAHAYPVLKAFPHLVGNYGGAWQDQQSDFAHFPGPILMTSNCIIEPMPQYRQRIFTTGPVGWPGVRHLEHHDFSTLIRAAQALPGFPATAAEETITVGFGRHAVLGVADKVIDAVKAGQIRHFFLIGGCDGAAPGRNYYTEFAEQAPDDTVVMTLGCNKYRFNRHAFGDIGGIPRLLDVGQCNDSYSAIRIATALADAFECGVNDLPLSLVISWFEQKAAAVLLTLLALGLRNIRLGPTLPAFVTPGVLAVLVEQFGIQPIGDAGTDLAASLARHAA

SEQ ID NO: 21319 - protein, 576 aa, Desulfitobacterium hafniense
MAARSGDAQTQPGSGREAVSSMKELYDLIIIGSGSAGMAAGIYAGRSKLKTLVIDRDRAGGQIKITSEVENYPGILNISGEELSQAMRRQAEKFGVKFRQAAVESVDLAGDIKKIRTAEGDYEALAVIIATGSVPRKLGFIGEEEFRGRGIGYCATCDGEFFTGMDVFVIGGGLAAAEEGIFLTRYARKVTMIVRGDGFSCPQTISERVLAHPKIEVKFNTELREAGGDAVLRYAEFVNNRSGERWRYDVREQKQTFGVFVFVGYIPQSAEYAQEVRIDERGYIPTDESMGTNVEGVYAAGDIRPKELRQLVTAVADGTIAATSAEKYLVGKKERLGLGELGELGESGERDELSDEEKTPVTRQGTSLLDDSLKEQLVPILERLENRIGLLAFLEGSSGFSEELRSFLSEFAGLTDKVEVEFLNRGEDAVREKEAKITLFPAVAVLGPDGVYTGVQFHGIPGGHEINSFILALYNAAGPGQAVGEETLAKIRRVSRKVNFKIGVSLSCTLCPDVVTLAQLMALKNPLIEAEMIDVAHYPDFKNKYGIMSVPAIVVNDEKVVFGKKNLEELLELAGG

SEQ ID NO: 21320 - protein, 293 aa, Photorhabdus luminescens
MASLEHFIGNTPLVKLQRITDKLGGEIWVKLEGNNPAGSIKDRTALSMIQQAELRGEISPGDVLIEATSGNTGIALAMIAAVKGYHLKLLMPDNMSLERQASMRAYGAELILVSRAMGMEGARDLAQQMERNGEGKVLDQFNNPDNPLAHFTTTGPEIWQQTQGRITHFVSSMGTTGTITGVSRYLKSQSNRVQIIGLQPAENSHIPGIRRWSPAYLPGIFRKELVDQVLDITQKEAEDTMRLLAQKEGIFCGVSSGGAVAGALSIAAQNPGSVIVTIICDRGDRYLSTGVFN

SEQ ID NO: 21321 - protein, 294 aa, Staphylococcus kloosii
VLGVSKDASKDEIKKAYRKLSKKYHPDINKEEGADEKFKEISEAYEVLGDENKRANYDQFGHSGPQGGFGGQGFGGQDFSGFGGGGFEDIFSSFFGGGRQRDPNAPRKGDDLQYTMTVTFDEAVFGTEKEISIRKDVTCHTCDGEGAKPGSKKKTCHYCNGAGHVSVEQNTILGRVRTEKVCPVCEGSGQEFEEPCETCHGKGTENKTVKIKVTVPEGVDNEQQIRLAGEGTPGENGGPHGDLYVVFRVKPSEKFERMGDDIYYSLDITFPQAALGDEIKVPTLKSSVMLTVPA

SEQ ID NO: 21322 - protein, 340 aa, Unknown
  Musa x paradisiaca
MATKASLSIKGFALLVSVLVAVPTRAQSIGVCYGMLGNNLPPPSEVVSLYKSNNIARMRLYDPNQAALQALRNSNIQVLLDVPRSDVQSLASNPSAAGDWIRRNVVAYWPSVSFRYIAVGNELIPGSDLAQYILPAMRNIYNALSSAGLQNQIKVSTAVDTGVLDKSYPPSAGAFSSAAQAYLSPIVQFLASNGAPLLVNVYPYFSYTGNPGQISLPYALFTASGVVVQDGRFSYQNLFDAIVDAVFAALERVGGANVAVVVSESGWPSAGGGAEASTSNARTYNQNLIRHVGGGTPRRPGKEIEAYIFEMFNENQKAGGIEQNFGLFYPNKQPVYQISF

SEQ ID NO: 21323 - protein, 294 aa, Staphylococcus lentus
VLGVSKDASQDEIKKAYRKLSKKYHPDINHEEGADAKFKELSEAYEILSDENKRAQYDRFGHNASQQGFGGGSQGFGGQDFSGFGGFEDIFGSFFGGGARRDPNAPRQGDDLQYSMTLSFEEAVFGTEKDITVRKDVECDTCHGNGAKPGTKKKTCSYCNGQGHVTVEQNTILGRMQTQKVCPECNGTGQEFEEKCPDCQGKGTQNKKVTIKVKVPAGVDNDQQIRLAGKGGPGVNGGPAGDLYVVFRVRPHDKFKRDGDDIFYDLNLSFPQAALGDEVTVPTLNGSVALTVPA

SEQ ID NO: 21324 - protein, 537 aa, Glycine max
MEEISSSVAVPFTLGVGNLIQKESAVTTHMEITGLKLMANTAAAALMLNPAVECLKENQVGAALVSEMVIECESNWVLNEGLNQAIKEDELMLAVDFQSLHSSSSQSVANGKSDPCREEAAALKSSFSEIDSPIMIKVDDDVDGKSGISELCPSMKPPVEETVSVAMDITSEDQSGSDESDPKPSAVLLDQLPGESKTWRTGNPNALELNSGPLWGCSSICGMRQEMEDAISVKPRLFQVSSQMLVNDHVNENEKQSLAHFFAVYDGHGGLQVANYCQERLHSKLIEEIETAQSTSAETNGRGDWQDQWKKAFINCFQKMDDDVGGIGASNRGNNSGGSESNIKTVAPETAGSTAVVAILSQTHIIVANCGDSRTVLYRGKEAMPLSSDHKPNREDEWARIEAAGGRVIHWKGYRVLGVLAMSRSIGDRYLKPWVIPEPEVNIVRREKNDQCLILASDGLWDVMTNEEACEVAKKRILLWHKKYGDNGTTGRSEGADPAAQSAAEYLTKLAIHRGSQDNISVIVIDLKAQRKIKRKP

SEQ ID NO: 21325 - protein, 369 aa, Brassica juncea
MSVSAIGFEGYEKRLEVSFFEPSLFVDTHGKGLRALPKSQIDEILAPAECTIVSSLSNDELDSYVLSESSLFIFPYKIIIKTCGTTKLLPSIEPLLRLAGELSLEVKSVRYTRGSFLCPGGQPFPHRNFSEEVSVLDGHFAKMGLSSVAYLMGDDDETKKWHVYSASAPARNGNGNNNNNVYTLEMCMTGLDKEKASVFYKNESSSAGSMTDNSGIRKILPQSQICDFEFEPCGYSMNSVEGDAISTIHVTPEDGFSYASFEAVGYDFTTMDLSHLVSKVLTCFEPKQFSVAVHSSVAQKSYDSGLSVDLEDYGCRETTIESLGEERGTVMYQSFEKLGRYCGSPRSTLKCEWSSSSSCTSEDEKEEGI

SEQ ID NO: 21326 - protein, 435 aa, Pseudomonas fluorescens
MTTEIIKTDTLVVGAGQAGVAMSEHLSKLGVPHLVLERSRIAERWRTGRWDSLVANGPAWHDRFPGMEFDDVDPDGFAHKERVADYFEAYAKKFNAPIRTGVDVKSVVRNVGRPGFTVDTSEGVIEAARVVAATGPFQRPVIPPIAPKDERLLQIHSADYRNPQQLPAGAVLVVGAGSSGVQIADELQRSGKQVYLSVGAHDRPPRAYRNRDFCWWLGVLGEWDQAAMKPGREHVTIAVSGAHGGRTIDFRGLAHRGMTLVGVTESFSNGVVTFKQDLRDNLKRGDENYLALLDAADAYIERNGLDLPLEPEARETYPDPECVKNPLADLDLAAAGITSIIWATGFAVDYSWLKVAAFDDNGKPQHQRGVSSESGVYFLGLPWQSRRGSSFIWGVWHDAKHVADHIATQRKYLAYRDAEQREAALHNHAVDTVDA

SEQ ID NO: 21327 - protein, 293 aa, Staphylococcus lugdunensis
VLGVSKDASKDEIKKAYRKLSKKYHPDINKEEGADEKFKEISEAYEILSDDNKRANYDQFGHSGPQGGFGNQGFGGQDFSGFGGGFEDIFSSFFGGSRQRDPNAPRKGDDLQYTMTIDFEEAVFGATKEISIRKDVKCHTCNGEGAKPGTSKKTCSYCKGSGRTSVEQNTILGRVRTEQTCPKCQGTGQEFEEPCPTCHGKGTENKVVKLEVNVPEGVDNEQQIRLGGEGSPGENGGPNGDLYVVFRVRPSKKFERDGDDIYYNLNISFPQAALGDEIKVPTLKGNVMLTIPS

SEQ ID NO: 21328 - protein, 130 aa, Sesbania rostrata
MELQDCAGQIGYALVPMIARGVMLGPDQPVILHMLDIPPAAESLNGVKMELVDAAFPLLKGVVATTDVVEACTGVNIAVMVGGFPRKEGMERKDVMSKNVSIYKSQASALEKHAATNCKVLVVANPANTN

SEQ ID NO: 21329 - protein, 374 aa, Coxiella burnetii
MAKRDYYEVLGVNLNATEAEVKKAFRRLAMKYHPDRNPGDKDAEVKFKEAREAYEVLCDSRKRASYDQFGHAGVEQTFGGAGAGGFGFGDLGDIFGDIFGDIFGGARGGQAREQRGADLAYELVLSLEEAVHGLSRTIKVPTWINCKTCNGSGAKGSSPATCPRCNGSGQMRMQHGFLQVQQTCSVCRGRGQVIKDPCTDCHGQGRQQQTKTLSVKIPPGIDTGDRIRLAGEGEAGLFGAPPGDLYVQVRVKPHPLFHREGNDLHSEVPIDFTTAALGGEMEIPTLDGSVRLTIPPETQGGKQFRLRGKGVKALRSGAVGDLICHIVVETPVKLSPEQKDYLKQFAELLKKDEKNHSPRTRNWFDSVKDFFTSK

SEQ ID NO: 21330 - protein, 294 aa, Staphylococcus lutrae
VLGVSKGASKDEIKKAYRNLSKKYHPDINKEEGSDEKFKEISEAYEVLSDDNKRAQYDQFGHSGPQGGFGQGFGGQDFSGFGGAGFEDIFSSFFGGAQRQRDPNAPRRGDDLQYTMTVTFEEAVFGTKKEISIRKEVTCHTCDGEGAKPGTKKKTCSYCNGAGHVSVEQNTILGRVRTEQVCPECNGSGETFDEPCPTCHGKGTEMKNVKLEVTVPEGVDNDQQIRLSGQGGPGENGGPAGDLFVVFRVKPSDKFKRDGDDIIYHHDIGFAQAALGDEVKIPTLNGHVMLTIPE

SEQ ID NO: 21331 - protein, 264 aa, Helicobacter hepaticus
MVTMKDLLECGVHFGHQTRRWNPKMKRFIFGVRKNIHIIDLQKTLRYFRYTYNIIKQAASEGKVIMFVGTKRQASETLKQYAESVNAPYVNYRWLGGMLTNFSTIKKSIRRLEIIEEMESSGQIDLLTKKEKLMLQRKKEKLDKYLGGVRHMKKAPDMIFVIDAAKEKIAVAEARRLGIPVVAPLDTNCDPDMVDYPIPGNDDAIRSIQLFCKEISEAILEGRSENKDEQNEQGEQIAPVTNEEKQEILDEVTAEVATQMQEEA

SEQ ID NO: 21332 - protein, 295 aa, Staphylococcus muscae
VLGLSKSASKDEIKRAYRKLSKKYHPDINKEEGADEKFKEISEAYEVLSDENKRANYDQFGHAGAQGGFGQGGFSGQDFSGFGGGGFEDIFSSFFGGAQRQRDPNAPRKGDDLQYTMTVTFEEAVFGTKKEISVRKEVVCHTCNGEGAKPGTKKHTCSYCNGTGHVSVEQNTILGRVRTQQVCPECNGSGQEFEEPCPTCHGKGTEVKTVKLEVTVPEGVDNDQQIRLSGQGSPGENGGPAGDLYVVFRVQPSDKFERDGDDVYYHHSISFAQAALGDEIKIPTLNGQGILTIPA

SEQ ID NO: 21333 - protein, 243 aa, Gracilaria tenuistipitata
MKDLNCHLIVSEQVASLKITIDKSKQLKMIEKILQSGKIGQEALLNLLVDRCVVQQQNVEGLDGLIFECLYFNGFDDIKQKLNSYFSYGLIKLNSGFKLNYQPLQDLLIIHDFEEADKLTQSYLCLLANLSQKYSRNWLYFTDVFSLPCEDLYILDKLWRIYSRDKFGFSIQRKIWLSTNCHWEQFWSIIGWHKNGIPVRYPREFTWNLNAPDGHLPLFNQLRGVQVISALLSHRAWAKDEFL

SEQ ID NO: 21334 - protein, 493 aa, Yarrowia lipolytica
MLGLDTNPDCAPVLLKSSTELPEYLVGGTLYRTGPGGVGDSADKMKIKHFFDGFTQNHRFHIKDTSTVEYACRSSCNALKQMYKEGSPDMARVTSFGPRDPCQTYFQKFMSVVKMPLSESNVKTDDGLPADIVNVGVTIKRDITGLVARTDSNVFQILDPVTLEPLTKYNYSKFSGQSLDGQLTASHVEFSADGKTEYNYNLKLGKMPEYVVFSKTDGHITELARFQAPGTYLHSFWTTDKYVVLALWQAEFWGGGIGVPLNKNVLQGITQEWNSERETVFYVIDKDPSKSRDFKTYKGPAFFAFHTINAFEQDGEPVLDVCTYDNNRVLFDFMLDKFKNDMAGVQKNKAFVTRFKLHDGLAQTVFCYDTPLANLELPTINPRFQNKEHRYVYGVNMQDKGQFLFEAIIRMDLKTGETLYFIEEDETPGEALFVPDPESDEDDELAGVLLSVSLNLKTGKSALLVLDPATMTVTARVQMDSKVNYGFHGSWAM

SEQ ID NO: 21335 - protein, 231 aa, Mantoniella squamata
MACIASSFVGSVAALKGTKVQAKSVSTVVKADIYPEFGTYPGGGESPIIPFGSEKNAEREVIHGRWAMLGVTGAWAAENGTGIPWFTAGTLCTPDDCTAVADKFPGAVAPLAPEGSGYPSFWAVLAIEVVLVGLAEAYRTGLSDSPFEELTVGDVSPGGRFDPLGLAGSGDLEELKIKELKHCRLSMFAWLGCIFQALATQEGPIANWQAHVADPVHANVLTNAASGFGFY

SEQ ID NO: 21336 - protein, 504 aa, Zea mays
  misc_feature (197)..(197): Xaa can be any naturally occurring amino acid
  misc_feature (457)..(457): Xaa can be any naturally occurring amino acid
  misc_feature (484)..(484): Xaa can be any naturally occurring amino acid
MQFSSVLPLEGKACMSPVRRGSGGYGSERMRINCCSIRRNKALRRMCFSARGAVSSTQCVLTSDAGPDTLVVRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFQGTADAVRKFIWVLXGDQLYRMDYMELVQKHVDDNADITLSCAPVGESRASDYGLVKFDSSGRVIQFSEKPKGAALEEMKVDTSFLNFAIDSPAEYPYIASMGVYVFKRDVLLDLLKSRYAELHDFGSEILPKALHEHNVQAYVFTDYWEDIGTIRSFFDANMALCEQPPKFEFYDPKAPFFTSPRYLPPTKSDKCRIKDAIISHGCFLRECAIEHSIVGVRSRLNSGCELKNTMMMGADLYETEDEISRLLAEGKVPIGVGENTKISNCIIDMXCQGWKERLHNKQRGRPRSRPAGRRILXIRSGIVVVLKNATIKDGTVI

SEQ ID NO: 21337 - protein, 293 aa, Zea mays
MTEQLNREYDIGDEIGRGRFGVVRRCVSRATGDAFAVKSVDRSLLGDDLDRALAELEPKLARLAGGEGDGNPGVLQVRAVYEDDAWTHTVMDLCTGPDLLDWIRLRRGAPVPEPDAARVVAQLAEALAGCHRRGVVHRDVKPDNVLLDVDPAGEAPPRVRLADFGSAAWLGEGARGRAEGLVGTPHYVAPEVVAGGEYGEKVDVWSAGVVMYALLSGGALPFGGETAADVFAAVLRGSLRFPPALFAGVSPAAKDLMRRMMCRDVSRRFSAEQVLRHPWIQSGGGGRELVRPT

SEQ ID NO: 21338 - protein, 115 aa, Yersinia pestis
MLYLFRGRREFDLIREGANMKLVTVVIKPFKLEDVREALSSVGIQGLTVTEVKGFGRQKGHAELYRGAEYSVNFLPKVKIDIAIADDQLDEVIDVISKAAYTGKIGDGKIFVAEL

SEQ ID NO: 21339 - protein, 128 aa, Pseudomonas aeruginosa
MRILHTMIRVGNIDRSIDFYTRVLGMTLLRKNDYPDGQFTLAFVGYGNEADSAVIELTHNWGVDAYEIGTGYGHIAIEVDDAYQACDDIRYNGGQVTREAGPMKHGTTVIAFVTDPDGYKIELIQKSS

SEQ ID NO: 21340 - protein, 432 aa, Lactobacillus delbrueckii
MTELISIRESSKHVDEEVRMHVWLTDKRSSGKIVFLQLRDGTAFFQGVVRKNDVSEEVFEAAKGLRQEASFYLTGTIHEDARSHFGYEIQISDLEVVSNNEGYPITNKEHGIDFLLDHRHLWLRSRRPFAIMQIRNRIFKATVDFFENEGFVKFDAPLLMHSAPEGTTELFHIDYFNHDAYLSQSGQLYGEVGAEAFGKIFTFGPTFRAEASKTRRHLTEFWMMEPEMAWMHQDESLDLQERFLSYVVGQVLEHCEYELSILGRDLDKLRPAAEGNYTRLSYDDAVKMLQEAGKDFKWGDDFGAPDEAFLSEQFDRPFFIVNYPVAIKPFYMKKNPENPLTYLCADVEAPEGYGEIMGGSEREADYDTLKAQIEEAGLNLDDYSWYLDLRKYGSVPHSGFGMGFERVIAWICKLDHVREAVPFPRMINRMQP

SEQ ID NO: 21341 - protein, 963 aa, Xanthomonas campestris
MTPAVMQQQATTAAQRVSERGVGVAMTGAMRLRVVLYRLCRRARDGRPGTTQQPLQRSLRAGCMALICLCTTAGVVTAAEPTNAPRERISLNADWRFRRGDPPGNTVRLEYDVRPEVVRSEDGKVADARPEQAQRIDADARNVLKPWILPTANSLIADPTQRHVRPPGHPGSAVAYVQPMFDDSAWQRVDLPHDWAIAGPFLADGPHGGMGRLPSWGVGWYRKALQIPASDRGRSLFLDLDGAMSYATVWLNGKLVGGWPYGYTSWRVDLTPYVVPGGHNQLTIRLDNPPDSARWYPGGGLYRNVWLTKTGPLRVAQWGTQLSTPQVSAERAQVQLAVQLDNAGAAPVQAQVSTALYALDDASGLRRGPAVAQIAAVQVQVAAGGNARVQGSTQIEAPRRWGPPPTQQPHRYVAVTEVSQGGRVVDRVETPFGVRSVVFDPDKGLVINGEHVPIRGVNNHHDLGALGAAFNVRAAERQLQLLQHMGANAIRMSHNPPAPELLELTDRMGLLVVDEVFDSWEMKKTPLDFHLIFPQWHEPDLRAMLRRDRNHPSIILWSVGNEVGEQYTGEAGAAIARRLHAIVHAEDPTRPATAAMNYASPEMPLPAALDVISLNYQGEGIRDTPEFEGTERIRKPPQYPAFHAKFPRKAILSSETASALSSRGVYLFPVSAQSSAPVRDGRGGDSVAHQVSAYELHAVDFGSSADKVFAALDRHPFVAGEFVWTGFDYLGEPTPYYSSRSSYSGILDLAGFPKDRYWLYQARWRPELPMAHLLPHWSWPGREGQVTPVHVFTSGDEAELFVNGVSQGRKRKAPLQYRLRWDAVVYQPGELRVQAYKHGRPWASDRVQTAGRATRMQLSADRNQIRGDGKDLSFITVRLLDADGRPAPTAGDRLRFRVEGAGELVATDNGDPTNLEAFVLPERNAFNGLCLVIVRAKPGAQGPITVHVQSDTLQSASVQVLAE

SEQ ID NO: 21342 - protein, 191 aa, Archaeoglobus fulgidus
MKDRQDYYYWKAKKEGYRSRAAYKLLQMNRTFKLIREGDLVLDLGATPGGWSQVAALLGARVVAVDINPMKPLENVTFIRGDITLPETLEKIREISPDYDVVMSDASPKISGKWTIDHLRSIDLARASFSIAKEVLKPGGNFVVKVFQGEEIQKFFNELKPHFRFKKFHSPQASRKRSAEVYFIGKRFRKI

SEQ ID NO: 21343 - protein, 319 aa, Unknown
  Synechococcus sp. CC9311
MTDYIDTDVLIIGGGPAGCSCALYTSRSSLKTYILDKNKSVGALAITHKIANYPGVSNEISGSDLLDMMRDQAISYGTNYLRAQVFSLDLSGDQKLVYTPEGVFRSRTIVLATGAMGRTSTLPGEKEFLGRGVSYCATCDAAFYRDEDVLVYGSNQEAVDEALVLAKFAKTVHWVTSGKPSRSTNRVELLTDLPNVKQWERTKLLSIHGTDSGLNFAKVQSTRDKETFSLDVTGAFLYSTGTLPITDFLHGMIPLRADGGVDVDENMMTSIPGVWAIGDIRNTPFKQAVVACSDGCIAAMSIDKFLNSRTEFRVDWVHK

SEQ ID NO: 21344 - protein, 258 aa, Triticum aestivum
  misc_feature (129)..(129): Xaa can be any naturally occurring amino acid
NILIEKICLCLGLGLLLSSSSSPFPCSCFRIGLSPVMGATSPSGLELTMAVPGLSSSSGSEGFVCNNNISNNGGGNMRGLDMNQPASGGEEEDFLMGGVEEDEEERGAGGPHRPKKLRLSKEQSRLLEXSFRLNHTLSPKQKEALAIKLKLRPRQVEVWFQNRRARTKLKHTEMECEYLKRCFGSLTEENRRLQREVEELRAMRMAPPTVLSPHTRQPLPASALTMCPRCERVTAATGPRITRPPASPFHPRRPSAAF

SEQ ID NO: 21345 - protein, 711 aa, Vibrio parahaemolyticus
MFEKPVVKTFQYGNHTVTLETGVIARQATAAVMVTMDDTAVFVSVVGKKEAVAGQDFFPLTVNYQERTYAAGKIPGGFFKREGRPSEGETLTARLIDRPIRPLFPDAFKNEVQVIATVVSVNPDVQPDIPTMIGTSAALAISGIPFNGPIGAARVGHIDGQLVLNPSQTELNASRLDLVVAGTESAVLMVESEADNLTEEEMLAAVVFGHDQQQVVINAINEFKAEVATPAWDWVAPEENTALKTKIAELAEAKLVEAYQITEKMARYDRIHEIAAEVNEALLAQDPEADTKEIHTIFHDLEKTVVRRSIIAGNPRIDGREKDMVRALDVRTGVLPRTHGSALFTRGETQALVTATLGTQRDAQIIDELTGERKDHFLLHYNFPPYCVGETGFVGSPKRREIGHGKLAKRGIAAVMPSVDEFPYTVRVVSEITESNGSSSMASVCGTSLALMDAGVPIKASVAGIAMGLVKEGDDFVVLSDILGDEDHLGDMDFKVAGTSTGVTALQMDIKIEGITKEIMQIALNQAQGARKHILSVMDEALAGARDDISEFAPRIHTMKISAEKIKDVIGKGGAVIRALTEETGTTIEIEDDGTIKIAATEGAAAKEAIRRIEEITAEVEVGRIYTGKVARLADFGAFVTVLPGKDGLVHISQIAEKRVEKVSDYLTEGQEVQVKVLEIDRQGRVRLSMKEAVEKPAEEAAAEAPAAKEE

SEQ ID NO: 21346 - protein, 317 aa, Photorhabdus luminescens
MNKIYEDNSLTIGRTPLIRLKHFGNGRILAKVESRNPSFSVKCRIGSNMIWDAEKHGILQPGKELVEPTSGNTGIALAYVAAARGYKLTLTMPETMSIERRKLLKALGAQLVLTEGAKGMKGAIEKANEIKASDPDRYIILQQFSNPANPEIHEKTTGPEIWEDTDGEVDVFVTGVGTGGTLTGVARYLKNTKGKNITTVAVEPEESPVISQTLAGEEVKPGPHKIQGIGAGFIPDNLDLTLVDRVFKISSEEAIKTAREIMVKEGILAGISSGAAVAAAVKLSQEPEYKDKNIVVILASSGERYLSSVLFADLSDE

SEQ ID NO: 21347 - protein, 238 aa, Unknown
  Silicibacter sp. TM1040
MAKKPTGKNTSGRGQRDLTVKVKTARGRRLSSTRWLQRQLNDPYVKRAQAEGYRGRAAFKIMELDDKYRFLVPGARVVDLGCAPGGWAQVAVPRINALGEKSGKAIGRFIGIDLQEVEPLAGAEFHQLDFMDEGADDQVKEWLGGQADVVMSDMAASSSGHKQTDHLRIMSLCETAAYFAFDVLEEGGTFVAKVLAGGAEGELQKLLKQKFKSVANVKPPSSRADSSEKFVVATGFRG

SEQ ID NO: 21348 - protein, 447 aa, Moorella thermoacetica
MKGTDVLVIGGSAAGLTAAITAKRYFKDKKVTVVRKEEKVLVPCGIPYIFGTVGSPDKNLIPDATLVNNGIELVIDEVIGIDRQSKAVSTVKSGSITYEKLVLATGSSPVVPPVKGADLEGVFVVKKDVAYLEQLKKALDKAKNLVIVGGGFIGVEFADECRKGRELNITIVELLPHCLALAFDDEVCTMVEDKLRSQGINIITGTKVEEFLGNGKVEQVRLSNGETLPADIVIFGIGVAPNIELAQMAGLKVDHRFGIWVDDYMRTSDPSIFAIGDCAKKSSFFGHGPSLIKLASVATHEARVAGANLFGLRRSRVAAVGVFSTIVGDLALGSVGLTERAAREAGIEVVTGTAKAPDRHPGSMPGTRELGVKLIFTKDTGVILGGQVYGGTSVGELTNLLAAAVQHKMRADELETMQVGTHPALTASPVAYQVTNAAEDAVLKLRS

SEQ ID NO: 21349 - protein, 326 aa, Triticum aestivum
  misc_feature (255)..(255): Xaa can be any naturally occurring amino acid
  misc_feature (271)..(271): Xaa can be any naturally occurring amino acid
MEAETAAKRARENEGAAAADGAGEQAGISAVIPGWFSEISPMWPGEAHSLKVEKVLFQGKSDYQDVLVFQSSTYGKVLVLDGVIQVTERDECAYQEMITHLPLCSIKDPKKVLVIGGGDGGVLREVSRHSSVEQIDICEIDKMVVDVSKQFFPHLALGFEDPRVSLHIGDGVAFLKNAPEGTYDAVIVDSSDPVGPAQELFEKPFFQSVSRALRPGGVVCTQAESIWLHMHIIEDIVTNCRQVFKGSVNYAWTTXVPTYPSGVIGFMLCSXTEGPSVDFQHPVFSIEEDEYSTKSKGPLKFYNSEFHTASFCLPSFARRVIEAKAN

SEQ ID NO: 21350 - protein, 867 aa, Aspergillus niger
MATVTEVLTEPFTAQGVTLKSGPIKVHQEELPAVELSDIPLPPPSKEPTEVLSIDKPTPDYHVPRDPRLIRLTGVHPFNVEPPLTALYDEGFLTSPELFYVRNHGPVPLVKDEDIPNWEISIEGLVEKPLVLNFRDILQQYDQITAPITLVCAGNRRKEQNVVRKTKGFSWGSAGLSTALWTGPMMADILRSAKPLRKAKYVCMEGADKLPNGYYGTSIKLNWAMDPNRGIMLAHKMNGEDLRPDHGRPLRAVVPGQIGGRSVKWLKKLILTDAPSDNWYHIYDNRVLPTMVSPEMSSSDPNWWRDDRYAIYDLNVNSSVVYPEHKEVLDLASAGPSYNVKGYAYAGGGRRITRVEISLDKGKSWRLANISYAEDKYRDFEGDLFGGRVHMSWRETCFCWCFWSLDIAIPELENTDAILVRAMDEALALQPRDMYWSVLGMMNNPWFRVTITKENGTLRFEHPTDPTGPGGWMERVKKAGGDLVNGYWGERQAGEEPTEPEPEKEINMKKEGVNRIIDLQEFKKNSSDEKPWFIVNGEVYDGTAFLEGHPGGAQSIISSAGIDVSEEFLAIHTQTAKAMMPDYHIGTMDKASLEALKNDNAPQSDEPRATFLQSKSWTKATLVKRTDVSWDTRIFTFQLQHDKQTLGLPIGQHLMIKVADPTSKEAIIRSYTPISDTNQEGTMDLLVKIYFDTPTVKGGKMTMALEKLALGSEIDCKGPTGRFEYLGNGKILVSGKERHVSSFKMICGGTGITPIFQVLRAVMQDKQDPTSCVVLDGNRQEEDILCRADLDAYEALDSKKCKVVHTLTKAPDSWTGRRGRISEDLLKEHAIPDGKSMVLICGPEAMEKSARKILLEQGWAESDLHFF

SEQ ID NO: 21351 - protein, 982 aa, Neurospora crassa
MEAPALEQRQSLHDSSERQQRFTSLILPNGVGCSSREEPQGSGGLLVPHNDNDIDNDLASTRTASPTTTDFSSSSSDDNSTTLETSVNYSHSSNTNTNTSCPPSPITSSSLKPAYPLPPPSTRLTTILPTDLKTPDHLIRDPRLIRLTGSHPFNVEPPLTALFEHGFLTPQNLHYVRNHGPIPSSVATPPATINKEEDDSLLNWEFTVEGLVEHPLKISVRELMDASKWDNVTYPVTLVCAGNRRKEQNVLRKSKGFSWGAGGLSTALWTGVGLSEILARAKPLTKKGGGARYVCFEGADQLPNGTYGTSVKLAWAMDPNKGIMVAHKMNGENLHPDHGRPVRVVVPGQIGGRSVKWLKRIVVTKGPSENWYHVFDNRVLPTTVGPEESGEKTEEMERVWRDERYAIYDLNVNSVICEPGHGEVVSLRGDEGAGTYRLRGYAYAGGGRRVTRLEVTLDQGKSWRLAGIEYPEDRYREAQDGEELFGGRLDVSWRESCFCWCFWDLEIPLSELRKAKDVCIRAMDESLALQPKEMYWSVLGMMNNPWFRVVIHHEGDTLRFEHPTQPMLTSDGWMDRVKKEGGNLANGFWGEKVPGAEENVVKEEPVKEISMVDEKVTRLITLEELRQHDGEEEPWFVVNGQVYNGTPFLEGHPGGAASITGAAGQDVTDEFLAIHSENAKAMMPTYHIGTLTPSAPAALKSSSTSDPALSDPSRPIFLQSKTWNSAILTFKESVSPDTKIFHFALSHPAQSIGLPVGQHLMMRLPDPAKPTESIIRAYTPISDGTLERGTLRVLVKIYYASPTEDIKGGQMTQALDALALGKAVEFKGPVGKFVYQGRGVCSVNGRERKVKRFVMVCGGSGVTPIYQVAEAVAVDDQDGTECLVLDGNRVEGDILMKSELDELVERAKPMGRCRVKYTLSRPGAEWEGLRGRLDKTMLEREVGEGDLRGETMVLLCGPEGMQNMVREVLKGMGWKDEDVLVF

SEQ ID NO: 21352 - protein, 909 aa, Unknown
  Petunia x hybrida
MAASVENRQFSHLEPGLSGVVRSFKPRSDSPVRGCNFPLNNELTNFQKKPNTTIYLDCSSSEDDDDDDDKNEYLQMIRKGKLEVEPSVHDIRDEGTADNWIERNNSMIRLTGKHPFNSEPPLARLMHHGFITPVPLHYVRNHGPVPKGMWDDWTVEVTGLVKRPMKFTMEQLVNEFPSRELPVTLVCAGNRRKEQNMVKQTIGFNWGAAAVSTTVWRGVPLRAILKRCGIYSRTKGALNICFEGADVLPGGGGSKYGTSIKKEFAMDPSRDIIIAYMQNGEKLTPDHGFPLRMIIPGFIGGRMVKWLKRIIVTTQESESYYHYKDNRVLPPHVDAELANAEAWWYKPEYIINELNINSVITTPCHEEILPINSWTTQRPYTLRGYSYSGGGKKVTRVEVTMDGGETWNVCTVDHPEKPNKYGKYWCWCFWSLEVEVLDLLSAKEIAVRAWDETLNTQPEKLIWNVMGMMNNCWFRVKTNVCKPHKGEIGIVFEHPTQPGNLSGGWMAKERHLEISAEAPPTLKKSISTPFMNTASKMYSMSEVKKHNSADSAWIIVHGHVYDATRFLKDHPGGIDSILINAGTDCTEEFDAIHSDKAKKLLEDFRIGELITTGYTSDSSPNNSVHGSSSFSGFLAPIKELAPAVRSVALIPREKIPCKLVDKKSISHDVRKFRFALPSEDQVLGLPVGKHIFLCAIIDDKLCMRAYTPTSTVDEVGYFELVVKIYFKGIVPKFPNGGQMSQYLDSLPLGAFVDVKGPLGHIEYQGRGNFLVHGKRKFAKKLAMLAGGTGITPVYQVMQAILKDPEDETEMHVVYANRTEDDILLKDELDSWAVKLPERVKVWYVVQDSIKEGWKYSTGFITEAVLREHIPLPSQTTLALACGPPPMIQFAVNPNLEKMGYDIKDSLLVF

SEQ ID NO: 21353 - protein, 470 aa, Bacillus subtilis
MNSAHNKNETTFQRSMKSRHLFMLSLGGVIGTGLFLSSGYTIQQAGPAGTILAYLVGAGIVYLVMLCLGELSVAMPVTGAFHTYAAKYIGPGTGFTVAWLYWLTWTVALGSEFTAAGLLMQRWFPHTSVWMWSAVFALFIFLLNAFSVKFFAESEFWFSSIKVLAIVLFILLGGSAMFGIIPIKGGEAAPMLSNFTAEGGLFPNGFVPILMTMLSVNFAFSGTELIGIAAGESVDPDKTIPKAIKTTVWRLSLFFVGTIFVLSGLIPIQDAGVIKSPFVAVFDRVGVPYAADIMNFVILTAILSAANSGLYASSRMLWSLSKEKTLHPTFAKLTSKGTPFNALVFSMIGGILSLLSSVFAPDTVYVVLVSISGFAVVVVWMGIAASQFMFRKRYIEAGNKVTDLKYRTPLYPFVPIAAFLLCLASVVGIAFDPNQRIALYCGVPFMAICYAIYYVKNRKSQPAADMTHSK

SEQ ID NO: 21354 - protein, 271 aa, Neurospora crassa
MDPQNPSSAGHNQQQRQQPVYDTSQGGHYGASAALSQQGFAPSDLYTGTWANVHQGHQGNYKENLTAYWQQTINHLENDTHDYKLHQLPLARIKKVMKADPEVKMISAEAPILFAKGCDIFITELTMRAWIHAEENKRRTLQRSDIASALSKSDMFDFLIDIVPREEASTHAKRATGQSAAAAAQAAQNAAQQAQGMPGVAAPNHGGQHPMAAPDYTLGGHAIAPEADYRQQNMYSGQVQPGAPAPYGQPQPPMYDVDGMYYSTMPPQQNA

SEQ ID NO: 21355 - protein, 175 aa, Fusobacterium nucleatum
MKYRIENLIDKEAVEKRIKELARQIEKDYAGEEIYCVGLLKGSVIFLSDLVKELNIPVIIDFMSVSSYGSETVSSGDVKILKDTDLDLRGKHVLIVEDIIDTGLTLEHVIKYFKEGKGVKSLRTCTLLSKPERRKVDVKVEYIGFDVPDKFVIGYGLDYNQKYRNLPYIAVVIPE

SEQ ID NO: 21356 - protein, 427 aa, Photobacterium profundum
MSVYDTICIIAAVAVFISLFNHRVGKFQTTIAITGWSVIISLALLFLSNMNYIPLNKEHELINIIQNIQFDDFLLKGVLGFLLFGGALNIKLPHLKDQKFEITILALASTLFSTFFIGTVLWLLFSLVGINMAFIHCCLFGALISPTDPIAVLAIVKKMNAPQRVSTQIEGESLFNDGIGLVIFVTLFEVAFGETAPTVSSTIALFTHEALGGIAFGLVLGLVFHYLIKHSHDSMMRLILTMLIPTSGYVLGQHLGVSAPLAMVVSGIMIGNWTRNSIAEDESNQLNHLWELADEILNAILFLLIGLIMLTFSFHYIDIVAVAIAIPLVLCSRYLSVKIAYLGFNRYRTYNPESIKILTWGGLRGGLALAMAMAIPSGIATGFSPEIDVKEIIVLMTYAVVVFSIIIQGSTITPMIHKAKELEKTGY

SEQ ID NO: 21357 - protein, 555 aa, Clostridium difficile
MKNWWKKATVYQIYPKSFKDSNNDGIGDINGIIEKLDYLYSLGVDLLWLTPMYVSPQRDNGYDIEDYYNIDPKYGTMSDFEKLLKEAHKRDIKIMMDMVLNHTSTEHKWFKESKKSKDNPYRDYYFWKDAKPDGSVPNNWISRFSGTAWKYDETTNQYYLHLFEETQADLNWENEKVREECYKILEFWADKGIDGFRLDVVNLLSKTPGLPDDPITGPKGDGRTHYADGPRIHEYLHNMNQKVFKPKNIVTVGEMSSTTPEECINYTRENREELSMVFSFHHMKTDYKGGAKWTNEMFSLDKLKKAQSDFQYKMYEGKGWNALFYSNHDQPRALSRFGDDRFFRQESAKMLAITLFGLQGTTYIYQGEEIGMTNAYFTKIDEYDDAESKNAYYHMIKSGIDEKEALLILQQKSRDNARTPMQWDNTIYKGFSNHKPWLKVNNDNISVENELNDSRSVFYTYQRLIKYRKQYDIFTEGTYRLLDENHKNLFVYEREYKNQNLLVISNFTHDNVVYKLPETYLNKLNYTILETNYTRDIIENKMEIKPYESIMIYYK

SEQ ID NO: 21358 - protein, 761 aa, Pinus sylvestris
MQIFVKTLTGKTITLEVESSDTIDNVKAKIQDKEGIPPDQQRLIFAGKQLEDGRTLADYNIQKESTLHLVLRLRGGMQIFVKTLTGKTITLEVENSDTIDNVKSKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKSKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTAKTITLEVESSDTIDNVKAKIQDKEGIPPDQQRLIFAGKQLEDGRTLADYNIQKESTLHLVLRLRGGL

SEQ ID NO: 21359 - protein, 349 aa, Cryptococcus neoformans
MPHSHHSHSGQFCRHAKDNLEDVILEAIRQGFQSFGLSEHAPRWRVEDLFPEEADLCPSDLLSTYEDFLKTALILRSKYDSQISLLVSLETDYITPLDSEKLTSFLVEHTEIDYIVGSVHHVNGVSIDFDRPTWLRAVKLAKEGRIGKTMDPGPPPTLELGDPNDPELMTTYTPDLLSVQPFFEAYFDAQYDLIVKHQPEVLGHIDLCSLWIPNISLMEQEPVWQKVIRNVKAVIAYGGLFEANAAAIRKGWKTSYPCRDILQLIQELGGRVCLSDDSHGISYVGLNYLKMRDYLKGMGLERTWYLVSSSRRQTGDYTVGERGRVAARPLDGWYDHPFWAKLSDAQRRK

SEQ ID NO: 21360 - protein, 257 aa, Oryza sativa
MEVGREFFRLPAEEKAKLYSDDPAKKIRLSTSFNVRKETVHNWRDYLRLHCYPLHQFVPDWPSNPPSFKEIIGTYCTEVRELGFRLYEAISESLGLEGGYMRETLGEQEQHMAVNYYPQCPEPELTYGLPAHTDPNALTILLMDDQVAGLQVLNDGKWIAVNPQPGALVINIGDQLQALSNGKYRSVWHRAVVNSDRERMSVASFLCPCNSVELGPAKKLITDDSPAVYRNYTYDEYYKKFWSRNLDQEHCLELFRT

SEQ ID NO: 21361 - protein, 476 aa, Lactobacillus sanfranciscensis
  misc_feature (378)..(378): Xaa can be any naturally occurring amino acid
MADKKANIGVIGMAVMGKNLALNIESRGYTVAIYNRSASKTEQVMKDHSDKHLVPAYNVKDFVDSIEQPRTILMMVKAGKPTDAVINEILPLLSKGDTLIDGGNTNFHDTIARNEELAKSGINFIGMGVSGGELGALQGPSLMPGGQKEAYDRVAPILEKIAAKAEDGKPCVAYIGSNGAGHYVKMVHNGIEYGDEELIDEVFNILRNAAGYSVDDLAKIFSDWNKGELNSYLIEITADILTRKDDLGDDKNKPIVDMILDRGANKGTGKWSSEDALDEGAPQSVITESVYARFVSMLKDERVAASKVLHGPAKKPKFGSDDIVEDMRQALYFGKIMSYAQGFEQMRMASDNHKWGLKYGELAQIWREGCIIRAQFLXEITKAFEKNPSLDNLLMDPFFGDIANKYQDSARRVVAFATEYGIPVPSLAAALSYFDSYRAEVLPANLLQAQRDYFGAHTYERTDRPGNFHYPWYVEQ

SEQ ID NO: 21362 - protein, 270 aa, Oryza sativa
MAAEAEQQHQLLSTAVHDTMPGKYVRPESQRPRLDLVVSDARIPVVDLASPDRAAVVSAVGDACRTHGFFQVVNHGIDAALIASVMEVGREFFRLPAEEKAKLYSDDPAKKIRLSTSFNVRKETVHNWRDYLRLHCYPLHQFVPDWPSNPPSFKEIIGTYCTEVRELGFRLYEAISESLGLEGGYMRETLGEQEQHMAVNYYPQCPEPELTYGLPAHTDPNALTILLMDDQVAGLQVLNDGKWIAVNPQPGALVINIGDQLQVTIPLRSS

SEQ ID NO: 21363 - protein, 373 aa, Lactobacillus buchneri
  misc_feature (271)..(271): Xaa can be any naturally occurring amino acid
KNLALNIESRGYTVGIFNRTGSKTEAVMKDHGDKKLVPSYKIEDFVKSLETPRRIILMVKAGKPTDAVIDELLPLLDKGDVLIDGGNTNFHDTMARNARLDKSGINFIGMGVSGGELGALQGPSLMPGGQKEAYDLVEPILKQIAAKAPADGEPCVTYIGPNGAGHYVKMVHNGIEYGDEELIDESYNILRNLAGYSVDELADIFKDWNKGELDSYLIEITADILTHKDDIGADKTKPIVDMILDRGANKGTGKWSSQDALEVGVDQSVIXEAVYARYISMIKNERVAASKVLPKPEGKVDFDKKEIVEKVREALYFGKVMSYAQGFAQLKAASDQYKWDIQLGEMAKIWRAGCIIRARFLQNITDAYDKNPD

SEQ ID NO: 21364 - protein, 450 aa, Lactobacillus brevis
INIESRGYTVGIYNRSANKTEQVMKDHSEKKLVPSYTVEDFVKSLETPRRILLMVKAGKPTDAVIHELLPLLDKGDVLIDGGNTNFHDTMARNAELDKSGINFIGMGVSGGELGALQGPSLMPGGQKEAYDLVAPILEKIAAKAPQDGKPCVTYIGPNGAGHYVKMVHNGIEYGDEELIDESYNIMRNVAGISVDDMADIFKEWNKGELDSYLIEITADILTRKDDLGDDKNLPIVDAIKDRGNNKGTGKWSSEDALDVQVPQSVITESVYARYISMLKDERVKASKVLPAAEKQGKADIADKDKFVEEVRQALFFGKLMSYAQGFEQLRFASEANDWDLKFGELAQIWRGGCIIRAQFLQNITDAFDKDPKLSNLLFDDYFKDIAGKYQQSIRDVVAMAVQAGIPVPSLSAAITYYDSFRAEVLPANLLQAQRDYFGAHTYERNDREGN

SEQ ID NO: 21365 - protein, 904 aa, Arabidopsis thaliana
MAVSATGFEGFEKRLEISFFETTDFLDPQGKSLRSLTKSQLDEILTPAECTIVSSLTNSFVDSYVLSESSLFVYPYKIIIKTCGTTKLLLSIPHILRLADSLCLTVKSVRYTRGSFIFPGAQSYPHRSFSEEVALLDDYFGKLNAGSKAFVMGGSDNNPQRWHVYSASSTEESAVCDKPVYTLEMCMTGLDNIKASVFFKTNSVSASEMTISSGIRNILPGSEICDFNFEPCGYSMNSIEGDAVSTIHVTPEDGFSYASFETVGYDLKALNFKELVDRVLVCFGPEEFSVAVHANLGTEVLASDCVADVNGYFSQERELEELGLGELTDKGVNFEVVALIGIKSSLTDPHGVLMNWDDTAVDPCSWNMITCSDGFVIRLEAPSQNLSGTLSSSIGNLTNLQTVLLQNNYITGNIPHEIGKLMKLKTLDLSTNNFTGQIPFTLSYSKNLQYLDLSYNNLSGPVPRSLAKTFNVMGNSQICPTGTEKDCNGTQPKPMSITLNSSQNKSSDGGTKNRKIAVVFGVSLTCVCLLIIGFGFLLWWRRRHNKQVLFFDINEQNKEEMCLGNLRRFNFKELQSATSNFSSKNLVGKGGFGNVYKGCLHDGSIIAVKRLKDINNGGGEVQFQTELEMISLAVHRNLLRLYGFCTTSSERLLVYPYMSNGSVASRLKAKPVLDWGTRKRIALGAGRGLLYLHEQCDPKIIHRDVKAANILLDDYFEAVVGDFGLAKLLDHEESHVTTAVRGTVGHIAPEYLSTGQSSEKTDVFGFGILLLELITGLRALEFGKAANQRGAILDWVKKLQQEKKLEQIVDKDLKSNYDRIEVEEMVQVALLCTQYLPIHRPKMSEVVRMLEGDGLVEKWEASSQRAETNRSYSKPNEFSSSERYSDLTDDSSVLVQAMELSGPR

SEQ ID NO: 21366 - protein, 345 aa, Bacillus subtilis
MKKVTMLGAGSWGTALALVLTDNGNEVCVWAHRADLIHQINELHENKDYLPNVKLSTSIKGTTDMKEAVSDADVIIVAVPTKAIREVLRQAVPFITKKAVFVHVSKGIEPDSLLRISEIMEIELPSDVRRDIVVLSGPSHAEEVGLRHATTVTASSKSMRAAEEVQDLFINHNFRVYTNPDIIGVEIGGALKNIIALAAGITDGLGYGDNAKAALITRGLAEIARLGTKMGGNPLTFSGLTGVGDLIVTCTSVHSRNWRAGNLLGKGYKLEDVLEEMGMVVEGVRTTKAAYQLSKKYDVKMPITEALHQVLFNGQKVETAVESLMARGKTHEMEDLVNTFENQVK

SEQ ID NO: 21367 - protein, 444 aa, Oryza sativa
MDPCPFVRVLVGNLALRMPVAPPAAGAGAGVHPSTAPCYCKIRLGRMPWQVAAAPLVVADGGEQAPSGALAAAFHLSKADLEWFARKPSLLFSSSSSSRGPATLKVAVYAGRKGTTCGVSSGRLIGKATIPVDLKGAEAKAAVVHSGWICVGKKSGGKGGSAAAELSLTVRAEPDPRFVFEFDGEPECSPQVLQVRGSMKQPMFTCKFGCRSNSDLRRSVVQTERDAAAAAGKERKGWSVTVHDLSGSPVALASMVTPFVASPGTDRVSRSNPGAWLILRPAGDGSWEPWGRLECWRERGGAGASDSLGYRFDLLLPGVDHAVPLAESSIAASKGGKFAIDLTSMQPQSRGGTPGCSPRGSGDFSQWPLASYSYRGFVMSSSVQGEGRCSKPTVEVGVPHVGCAEDAAAFVALAAAVDLSMDACRLFSHKLRKELSHLRSDVLR

SEQ ID NO: 21368 - protein, 504 aa, Magnaporthe grisea
MEKFPDLDVGITNHNANKLNGHANGIANGGSHSQPVGVRWTPASSTYSGSGRSGGHSRQKSISEAIRTIRSRHGSVSQNAHEIADALKAPLSPRLIFAFVCGYCLLLSWLASISPGLRTAVPALKHGIRYPSRDVIQTTMPLAAFQIFGHLLSSTATSKIPVSLVHTIKGLSPLFTVLAYRIVFNIRYPAATYLSLVPLTLGVMLACSGKHKFGGEILGIVYALVATLIFVTQNIFSKRLFNEAARAEAEGMGHKSRKLDKLNLLCYSSGMAFILTVPIWFWSEGIGIIGDFLRDGSVDLTTAPGTFDHGRLFIEFVFNGTFHFGQNIMAFVLLSMVSPVTYSVASLIKRVFVIVIALVWFRSPTTKIQAVGIALTFVGLYLYDRTKEGNRADKRATYLGDKGAKDSLLPLSTKSNGVNGGLVFESPASAGPDGFDGGINAPRPYVNGYALPVRTEGDNKKSDDQTPGRGGRQRGASTTSWLPPGTRQEDTWRVGDRSSGGPVR

SEQ ID NO: 21369 - protein, 999 aa, Oryza sativa
MHLRLLLLLVGVAAAAADADADADALLAAKAAMSDPTGALASWGGNGTRTNTTAAAAAHCAWAGRDVQLPRRGGWPRRVRAQPLRRAAGGADRAPRAHAAFLTYLNLSNNAFNGSFPAALARLRGLRVLDLYNNNLTSPLPMEVVQMPLLRHLHLGGNFFSGEIPPEYGRWGRMQYLAVSGNELSGKIPPELGNLTSLRELYIGYYNSYSGGLPPELGNLTELVRLDAANCGLSGEIPPELGKLQNLDTLFLQVNSLAGGIPSELGYLKSLSSLDLSNNVLTGEIPASFSELKNLTLLNLFRNKLRASRCLQLWENNFTGGVPRRLGRNGRLQLLDLSSNRLTGTLPPELCAGGKMHTLIALGNFLFGAIPDSLGECKSLSRVRLGENYLNGSIPKGLFELPKLTQVELQDNLLTGNFPAVSGAAAPNLGEISLSNNQLTGALPASIGNFSGVQKLLLDRNSFSGVVPPEIGRLQKLSKADLSSNALEGGVPPEIGKCRLLTYLDLSRNNISGKIPPAISGMRILNYLNLSRNHLDGEIPPSIATMQSLTAVDFSYNNLSGLVPGTGQFSYFNATSFVGNPGLCGPYLGPCRPGVAGTDHGGHGHGGLSNGVKLLIVLGLLACSIAFAVGAILKARSLKKASEARVWKLTAFQRLDFTCDDVLDCLKEENVIGKGGAGIVYKGAMPNGDHVAVKRLPAMGRGSSHDHGFSAEIQTLGRIRHRHIVRLLGFCSNNETNLLVYEYMPNGSLGELLHGKKGGHLHWDTRYKIAIEAAKGLCYLHHDCSPLILHRDVKSNNILLDSDFEAHVADFGLAKFLQDTGASECMSAIAGSYGYIAPEYAYTLKVDEKSDVYSFGVVLLELVTGRKPVGEFGDGVDIVQWVRMMTDSNKEQVMKVLDPRLSTVPLHEVMHVFYVALLCIEEQSVQRPTMREVVQILSELPKLAPRQGEVLSHAVDGFASNPPAPVPSGSAEALTGDAKDQQQQQTNSESTTPPDLISI

SEQ ID NO: 21370 - protein, 737 aa, Caulobacter crescentus
METPARRNTPMDAKVEDNIAGKCPMGHGRGPANRDWWPQSLRLEGLNQHAPRSNPMGEAFDYAEAFKSLDLDAVVSDLHALMTDSQEWWPADFGHYGGLFIRLAWHAAGTYRITDGRGGAGGGQQRFAPLNSWPDNTNLDKARRLLWPIKQKYGAKLSWADLYVLVGNVALESMGFKTFGFAGGRADQWEPEELYWGPESTWLDDKRYSGERELDSPLGAVQMGLIYVNPEGPNGNPDPLASARDIRETFARMAMNDEETVALIAGGHTFGKAHGAGDASLVGVEPEGGAIEAQGFGWASKHGTGKGPDAITGGPEVIWTQTPTRWSNHFFDNLFKYEWELTQSPAGAKQWQAKNAPADIPDAFDPNKTHVPRMLTSDLALRFDPAYEKISRRFYENPDQFADAFARAWFKLTHRDMGPIGRYLGPLVPKEELIWQDPIPAVDHPLADDKDIAALKAKILATGLSASDLVSTAWASASTYRQSDKRGGANGARIRLAPQKDWAVNNPPVLAKVLAALEGVQKDFNASAGGGKKISLADLIVLGGAAAIEKAAKDAGTSVTVPFAPGRMDASAEQTDAHSFEALEPRSDGFRNYRGPGKHYMAPEEALVDRAQLLGLSGPELTVLVGGLRVLGANADGSKDGVFTNRPGALSNDFFVNLLSMETTWSPTAANAFAGHDRKSSEPRWTATRVDLIFGSHAELRAFAEVYACADSQEKFVCDFVTAWNKVMNADRLDLAA

SEQ ID NO: 21371 - protein, 1292 aa, Ustilago maydis
MPPSARHSAHPSHHPHAGGRDLHHAAGGPPPQGGPGMPPGPGNGPMHHPHSSYAQSMPPPPGLPPHAMNGINGPPPSTHGGPPPRMVMADGPGGAGGPPPPPPPHIPRSSSAQSRIMEAAGGPAGPPPAGPPASTSPAVQKLSLANEAAWVSIGSAAETMEDYDRALSAYEAALRHNPYSVPALSAIAGVHRTLDNFEKAVDYFQRVLNIVPENGDTWGSMGHCYLMMDDLQRAYTAYQQALYHLPNPKEPKLWYGIGILYDRYGSLEHAEEAFASVVRMDPNYEKANEIYFRLGIIYKQQNKFPASLECFRYILDNPPRPLTEIDIWFQIGHVYEQQKEFNAAKEAYERVLAENPNHAKVLQQLGWLYHLSNAGFNNQERAIQFLTKSLESDPNDAQSWYLLGRAYMAGQNYNKAYEAYQQAVYRDGKNPTFWCSIGVLYYQINQYRDALDAYSRAIRLNPYISEVWFDLGSLYEACNNQISDAIHAYERAADLDPDNPQIQQRLQLLRNAEAKGGELPEAPVPQDVHPTAYANNNGMAPGPPTQIGGGPGPSYPPPLVGPQLAGNGGGRGDLSDRDLPGPGHLGSSHSPPPFRGPPGTDDRGARGPPHGALAPMVGGPGGPEPLGRGGFSHSRGPSPGPPRMDPYGRRLGSPPRRSPPPPLRSDVHDGHGAPPHVHGQGHGQGHGQGHGQGHGQGHGQSHGHSHGGEFRGPPPLAAAGPGGPPPPLDHYGRPMGGPMSEREREMEWEREREREREREQAARGYPASGRITPKNEPGYARSQHGGSNAPSPAFGRPPVYGRDEGRDYYNNSHPGSGPGGPRGGYERGPGAPHAPAPGMRHDERGPPPAPFEHERGPPPPHQAGDLRYDSYSDGRDGPFRGPPPGLGRPTPDWERTRAGEYGPPSLHDGAEGRNAGGSASKSRRGPKAKDELEAAPAPPSPVPSSAGKKGKTTSSRAGSPWSAKGGVAAPGKNGKASTPFGTGVGAPVAAAGVGGGVGSKKGAAISLRPQEDQPDSRPGSPQSRRDASPASSDGSNEPLAARAPSSRMVDEDYDEGAADALMGLAGAASASSASVATAAPAPVSPVATSDRASSAEKRAESSLGKRPYAEEERAVDEPEDSYKRAKSGSAAEIEADATSGGRLNGVSVSAKPEATAAEGTEQPKETRTETPPLAVAQATSPEAINGKAESESAVQPMDVDGREPSKAPSESATAMKDSPSTANPVVAAKASEPSPTAAPPATSMATSEAQPAKADSCEKNNNDEDEREEEEGQIHEDPIDAPAKRADEDGAK

SEQ ID NO: 21372 - protein, 540 aa, Zea mays
MGLGVVAELVRLGVLSSTSDHASVVSINLFVALLCACIVLGHLLEENRWVNESTALIVGLGTGTVILMISRGVVIHVLVFSEDLFFFYLLPPIIFNAGFQVKKKQFFRNFITITLFGAVGTLISFTVISLGALGLISRLNIGALELGDYLALGAIFSATDSVCTLQVLSQDETPFLYSLVFGEGVVNDATSVVVFNALQNFDITHIDAEVVFHLLGNFFYLFLLSTVLGVATGLISALVIKKLYFGRHSTDREVALMMLMAYLSYMLAELFALSGILTVFFGCIVMSHYTWHNVTESSRITTKHAFATLSFLAETFLFLYVGMDALDIDKWRSVSDTPGKSLAISSILMGLVMVGRAAFVFPLSFLSNLAKKTEHEKISWKQQVVIWWAGLMRGAVSMALAYKKFTRAGHTQVRGNAIMITSTIIVVLFSTMVFGLLTKPLINLLIPHRNATSMLSDDSSPKSLHSPLLTSQLGSDLEEPTNIPRPSSIRGEFLTMTRTVHRYWRKFDDAFMRPMFGGRGFVPFVPGSPTERNPPDLSKA

SEQ ID NO: 21373 - protein, 297 aa, Bacillus cereus
MQVGLIGLGKMGLNLGKNLMDHKHEVAAFDLNTSAVEEMKEYGAIGVSSLSELVQSLESPRILWVMVPHAVVDSVISEITPLLSKGDIVIEAGNSHYKESIRRYEQLKKDGIHFMDAGTSGGMEGARNGACYMIGGDQEAWDIVEPIFRDTAVENGYLYAGKAGSGHFLKMVHNGIEYGMMAAIGEGFEILEKSEFDYDYEKVSRVWNNGSVIRSWLMELTENAFSKDAKLDEIKGVMHSSGEGKWTVETALDLQTATPVIAMSLLMRYRSLDNDTFTGKVVAALRNEFGGHAVEKK

SEQ ID NO: 21374 - protein, 578 aa, Tortula ruralis
MGNSCVGAAGYFQGFTSVIALGGRSSRSPSEVSPTPSKAESRGGSRAEAESPETQRKPPRPAHIPAVEPAETQQFKEVIEAMKKGREMKPVPGQSLTHSVLQRKTENLRDLYVLGKKLGQGQFGTTYLCIEKATNREYACKSIAKRKLISKEDVDDVRRELQIMHHLSGHPNIVMIKGAYEDPASVHLVMELCAGGELFDRIIQRGQYSEAKAAVLTRTIVGVVETCHSLGVMHRDLKPENFLFSSTKEDAALKTTDFGLSVFFKPGEVFRDVVGSPYYVAPEVLRKNYGPEADVWSAGVILYILLSGVPPFWAETEQGIFEQVLKSELDFASDPWPKISDSAKDLIRKMLTPQASKRLKAHQVLAHPWICEDGVAPDRPIDSAVQSRLKHFSAMNKLKKIAIRVIAESLSEEEIAGLKEMFKMMDTDNSGSISYEELKAGLKKVGSNLKEEDVRQLMDAADVDGSGAIDYGEFLAATLHLNKVERDENMFAAFSYLDKDNSGYLTVDELQHALAEFNMGDVSVEELLREVDQNNDGQIDYTEFVTMMRKGNMGGGAGRSSLRNSQQLSLTDVLGIGG

SEQ ID NO: 21375 - protein, 392 aa, Chlamydophila pneumoniae
MDYYSILGISKTASAEEIKKAYRKLAVKYHPDKNPGDAAAEKRFKEVSEAYEVLSDPQKRDSYDRFGKDGPFAGAGGFGGAGGMGNMEDALRTFMGAFGGEFGGGSFFDGLFGGLGEAFGMRSDPAGARQGASKKVHINLTFEEAAHGVEKELVVSGYKSCETCSGQGAVNPQGIKSCERCKGSGQVVQSRGFFSMASTCPECGGEGRIITDPCSSCRGQGRVKDKRSVHVHIPAGVDSGMRLKMEGYGDAGQNGAPSGDLYVFIDVESHPVFERRGDDLILELPIGFVDAALGMKKEIPTLLKTEGSCRLTVPEGIQSGTILKVRNQGFPNVHGKGRGDLLVRISVETPQNLSEEQKELLRTFASTEKAENFPKKRSFLDKIKGFFSDFTV

SEQ ID NO: 21376 - protein, 112 aa, Prochlorococcus marinus
MKKVEAIVRPFKLEDVKLALVNAEIIGMTVSEVRGFGRQKGQVERYRGSEFTVEFLQKLKVEVVVDDDKVEAVVNAIAEAAKTGEIGDGKIFISPVDSVVRIRTGDRDSKAL

SEQ ID NO: 21377 - protein, 209 aa, Vibrio parahaemolyticus
MSKQKHSASSGRWLKEHFDDKYANEARKKGYRSRAYFKIDEIQTKDKLLKPGMTVVDLGAAPGGWSQYAAKIVGDSGQIIACDLLPMDPIAGVSFLQGDFRDDAVLEALLDRIQPLMVDVVMSDMAPNIAGNNSVDQPRAMYLVELALDMCRQVLAPNGSFVVKVFQGEGFDQYVKEVRDMFKVVKIRKPDSSRARSREVFVVATGYKG

SEQ ID NO: 21378 - protein, 864 aa, Volvox carteri
MTIPELPLGGIVSQAVELGAPYEPPLTPDHPEWKVHVPAAAVDKKDQDTPDNWVRRDPRILRLTGRHPLNCEPPMDVLMEYGFITPPAVHFVRNHGAAPRIPWAEHRIEINGLVDKPLFLTMDELVALPSITFPCTLVCAGNRRKEENMLKKSIGFNWGPCATSTTYWTGVRLRDLLLLAGIKSPEQGANFVCFRGPKGELPRGSDGSYGTSLTYAKAMDPSSDVIIAYKQNHRWLTPDHGFPVRMIIPGFIGGRMVKWLSEITVTEVESQNFYHFMDNRVLPSHVDEALAKEEGWWYKPEFIINDLNINSAVARPWHDEVVRLDANKPYTMRGYAYAGGGRKIIRCEVSLDDGKTWRLGDIQRFEKPNEYGKYWCWVHWSLDVMTFDFLNAKEVLLRAWDETMNTQPAIITWNVMGMMNNCYYRIKIHPQVDSDGVMGLRFQHPAPVELGERGNMGWREEDNLVAQALAAVKEGATAAAAPAAPPPVVAAAANGGPRQYTMEEVAAHNTEESCWFVHGGKVYDATPYLDEHPGGAESILIVAGADATDEFNSIHSSKAKAMLAQYYIGDLVASKPAAAGATVPEPQPVASTSSPAVDPLVVLNPRQKVKLPLIERIELNRNTRIFRFGLPSPQHRIGLPVGKHVFTYATINGENVMRAYTPISGDEELGRLDMLIKVYFANEHPAFPDGGKMSQHFESLRIGDTVEFKGPLGHFVYDGRGSYTLNGKLHKHATHMSFVAGGTGITPCYAVIKAALRDPEDKTQISLVFANNTEEDILLREELDELANNHPDRFHLWHTVSQTNSSDWKFSTGRVTLEMFKQHLFACSGPECLALMCGPPAMLEHCCVPFLESMGYSKEQMIHF

SEQ ID NO: 21379 - protein, 148 aa, Triticum aestivum
  misc_feature (88)..(88): Xaa can be any naturally occurring amino acid
  misc_feature (112)..(112): Xaa can be any naturally occurring amino acid
  misc_feature (122)..(122): Xaa can be any naturally occurring amino acid
  misc_feature (134)..(134): Xaa can be any naturally occurring amino acid
MGRRPARCYRQIKNKPYPKSRYCRGVPDPKIRIYDVGMKRKGVDEFPYCVHLVSWEKENVSSEALEAARIACNKYMTKSAGKDAFHLXRVRVHPFHVLRINKMLSCAGADKXQTGMRGAFGXPQGHCAKVDIGXLLSVRCKDNNAAMQ

SEQ ID NO: 21380 - protein, 413 aa, Mycoplasma mycoides
MNTKISPLIKESLNKELKRQQSHIELIASENYVSKAVLELNGSVLTNKYAEGYPGKRYYGGCEFIDEIESLGIQTAKELFHAEHANIQPHSGSQANDAAYKALLEPKDRVVAMSLDAGGHLTHGYPINFSGYTYDFRFYGVNKDTEQLDYQEIEKIVLEHKPKLIVAGASAYSRIIDFKKFKEIADKVGAYLMVDMAHIAGLVAAGVHPNPLEYADIVTTTTHKTLRGARGGLILCKQEFAKKVDLAVFPGSQGGPLENLIAGKTQALLEASTDEFKEYGKQIVKNTKALANVLQENGLRLVAGGSDNHLINVDVKSTLRITGKKAEKILESIGIICNKNMIPFDTEKPFYTSGIRLGTPAMTTRGFKEEEFKQVGLIIVNALKDPSEENLEKLAKQVTSLCEKFPIYQNIKY

SEQ ID NO: 21381 - protein, 470 aa, Photorhabdus luminescens
MDYLPIFVELKGRLVLLVGGGEVAARKATLLLRAGALLQVVAPELCSELQQRYQAGELEWYQGEFQPEYLDGIFLVIAATDDRILNHQVFSEADKRSILVNVVDDQVHCSFIFPSIIDRSPVLVAISSAGKAPVLARLIREKLEALLPSSLGTMAKIAGKWRERVKQRLTSMRQRRSFWEQAFNGRFAMLVANGQIQQAEKQLEQQLEQSDLQGELALVGAGPGDPGLLTLKGLQVIQQADVVLYDHLVSSDVLDLIRRDADKICVGKRAGNHSVSQEETNRLIVKFARQGKKVVRLKGGDPFIFGRGGEELQVAASAGIPFQVVPGITAAIGATAYAGIPLTHREHSQSITFITGHCREKGNELDWPALARGHQTLVIYMGTVKAALISHQLILHGRAEDTPVAVIGCGTRLEQQVLTGTLLELEQLAQQAPSPALLVVGEVAQLHHQIAWFGQQSIAKISRPAVVDFA

SEQ ID NO: 21382 - protein, 1152 aa, Salinibacter ruber
MAGGPFSRSAVNVPTFNVPTFQRSTRMPDDFLDDPLWYKDAVIYELHVRSFYDSNNDGYGDFQGLREKLPYLESLGVNTLWLLPFLESPLRDDGYDTADYFKVLPIHGDLDDFRAFLDDAHARGMRVITELVLNHTSDQHPWFQEARDPDSDKHDWYVWSDTDERYDDVRVIFTDTEDSNWAWDPKAEKYYWHRFFSHQPDLNFDNPEVREKMKEVMFFWLDMGVDGLRLDAVPYLFEREGTSSENLPETIAYVKELRAAVEERYGPGKVLLAEANQWPEDTLPYFGEDAEGESTGVQMAFNFPVMPRLYMALRRENRRPVVEMLDLTSGIPDDAQWALFLRNHDELTLEMVTDEERDYMYHEYGADDRFRINVGIRRRLTPLLGGERRRIELMNALLLSLKGSPIIYYGDEIGMGDDPFLGDRNGVRTPMQWSPDKNGGFSRAPHHKLFMPPINRGKYSYEFVNVEDAEADPYSLLHFMRRLIALRQQHKNIFGRGSLELLPVENQSILAFLREYEGERILVVNNLSRFTQSVHIPAREDLQGLAPVELSGQSAFPPIEDDDYHLTVGPHHFYWFKLVPKEDVQRDDTRRSGLQPLEDKNGRTRPVLPVAEGLQNVLVPTMAQRRGPEQIEALLPEFINEQRWFGGKGEGIEGVEVEDAVRLQSDPVVYLSVLRVDLPEDTSFYTLPLMAAPEPEASDILDEHPNATLAWLEVEDTEERRLVYDATVNPRFWATLFRWWQRGGTGRSLKGLYTAEPSEAMGDAPPDDVRLLTGEQSNTSAIVNNDYFLKLYRRLEEGPNPEKELLEHLTDIDFTFSPRLHGTLNFRRRHRQYTLGVLQEALAVDADAWSYTLSCTTTFLDRVENSPFPHEQAKNTGPSADGPQWTADRFSDATVPVWLEELAPELISFARTLGVRTAEMHHALAQAGGDEMRPVEAPTDAGAELGTRIRTEMEETRALLDRQPDRVSGHVPSDPAWSAARDRLAPLDDVPGTHDRIRIHGDYHLGQLLRAEGDIYVLDFEGEPTRPLDERRRRKNALRDVAGMLRSLEYAVLASWQDHADVDPDYEPWIDALLYWTETTFLDAYADTTGDAAFLPAAPARYSFLWAFLLDKALYEVRYELNHRPDWAWLPLHGLHRLLAPRDATASDPLDA

SEQ ID NO: 21383 - protein, 359 aa, Unknown
  Dehalococcoides sp. CBDB1
MSKVCIIGTTTWGITLGTIIAHKGREVMLWARTEDEAMLLSTQRRPADFLPENYHFPEFMNVTACLEEAVAGADMVLLAVPSQRMRPNIRLVAPLLTKSMLICSAAKGLEIGTAKRMSQVITDEISPDFAKNICVLSGPNLAMEILKGLPAVTVLAADTEKTAKKAAKLITAANFSAYTNTDIIGVELGGSLKNIIALGAGIVDGLNLGNNAKSALITRGLTEISALGAALGANPLTLSGLAGLGDLIATCSSNLSRNHFVGVELTKGRSLNDIMYNMSNVAEGVSTTAVAYEMARSMDLEMPVTENIYNVLYNNADPKEAARILMDAQATHELAGRKWNLFKMFRKRKARKTPELNPD

SEQ ID NO: 21384 - protein, 123 aa, Arabidopsis thaliana
MAKYNEIAKKKREAKADRKRAIHGDPLTNKLKTRTPVPSVSGKRQRKLLRKWRREQKDMVEKGLVTMEDVEMASAQAASEDSKKSPRKFSVKKSLKLNKLNNKGKKKKNQKASGEKSADCMLE

SEQ ID NO: 21385 - protein, 359 aa, Unknown
  Dehalococcoides sp. CBDB1
MVNKRDYYEVLGLERSASDEDIKKAFRKMAMKHHPDRNHEEGAADKFKEVNEAYEVLSNPEKRAAYDRFGFSAGADSFGQGGFENFDFGGLGSIFETFFGGATQGAKRGPRRGPDMSYDIKISLEEAATGVEKDITTERLEYCTECSGTGAKAGTSPVKCTSCNGTGQVYQVQKSVFGRFTSVTPCPKCRGEGTIIGEPCTKCRGTGKEYVKRTVQVKIPAGVADGNQIRLNGYGGVGDKGASAGDVYINVGIAEHADFKRDGDDVIYELEINFAQAALGTEVNVPGLNTEHKLKIPSGSQNGKYFVLKGKGIPHLNRFGSGDEMVHLNVVTPEKLSRKQKQLFEELEKSFAEDKKQAT

SEQ ID NO: 21386 - protein, 529 aa, Unknown
  Burkholderia sp. 383
MNARTLPFGPPGHDGLDETIDIAIIGTGFAGLGMAIRLRQTGVTDFVVLEKAASVGGTWRDNHYPGCACDVQSHVYSFSFAPNPRWTRMFAPQPEIRAYLEDCVQRFGIGAHLRLNHELQRAEYDEAAQRWRLTFANGKRLSARVLVSGMGGLSRAALPSIPGVENFKGRAFHSQQWDHDYSLEGKRVAVIGTGASAIQFVPQIAPRVKELALFQRTPPWIMPKPDRNLTGLEKWLFRTLPFTQKAVRSSIYWMLESRVLGFAIHPSLMKNVQKLALRHIRKQIPDPELRKTVTPNYTLGCKRVLISNDYYPALSRKNVDVITTGIDHIEADAVVTTDGRRHEVDCLIYGTGFQVADPYPRGAIIGRGGLDIVDAWRDGAHAYLGSTLPGYPNFFMIVGPNTGLGHNSMVFMIESQIEYILGALQAMRRERADALEVRPLVEAQFNSDLQGKLKKAIWSTGGCKSWYLDPRTGKNTTLWPGFTWRFRQATAHFSIADYHAYRAPQHDTTARPAAAPAASASTSPSAEAA

SEQ ID NO: 21387 - protein, 424 aa, Lactobacillus lindneri
KNLALNIESRGYTVAIYNRSASKTEQVMKDHADKHLLPAYNLKDFVESIEKPRTILMMVKAGKPTDAVINEILPLLDKGDTLIDGGNTNFHDTMARNEELAKSGVNFIGMGVSGGELGALQGPSLMPGGQKEAYDRVAPILEKIAAKAEDGKPCVVYIGPNGAGHYVKMVHNGIEYGDEELIDESYNILRNAAGYSVDDLAKIFKDWNKGELNSYLIEITADILTRKDDLGDDKNKPIVDAILDRGANKGTGKWSSEDALDEGAPQSVITESVYARFVSMLKDERVAASKVLHGPAKKPKFGSDDIVEDMRQALYFGKIMSYAQGFEQMRMASDNYDWNLKYGELAQIWREGCIIRAQFLDEITKAFEKNPDLKNLLMDPFFGDIANKYQDSARRIVAFATEYGIPVPSLAAAVSYFDSYRAEV

SEQ ID NO: 21388 - protein, 1035 aa, Oryza sativa
MERARRLANRALLRRLLAAAASTTSPAPSRGISTLAKAPGAGSRPRAPPRPAPHQYTTGRRPVSASALQPSDTFPRRHNSATPAEQAAMASECGFGTVDALIDATVPAAIRAPEMRFSGRFDAGFTESEMIEHMQRLAAMNRAYKSFIGMGYYNTHVPAVILRNLMENPAWYTQYTPYQAEIAQGRLESLLNYQTMVADLTGLPMSNASLLDEATAAAEAMAMCNGILKSKKKTFLIASNCHPQTIDVCQTRAAGFDLNVIVADAKDFDYSSGDVCGVLVQYPGTEGEVLDYAEFVKDAHAHGVKVVMATDLLALTSLRPPGEIGADIAVGSAQRFGVPMGYGGPHAAFLATSQEYKRLMPGRIIGVSVDSSGKPALRMAMQTREQHIRRDKATSNICTAQALLANMAAMYAVYHGPEGLKAIADRVHGLAGTFAHGLKKLGTVTVQELPFFDTVKVKVADANAIAQEACKNEMNLRVVDATTITVAFDETTTLEDVDKLFKVFNGGKPVNFTAESLASEVSSSIPSSLVRKSPYLTHPIFNMYHTEHELLRYLHKLQSKDLSLCHSMIPLGSCTMKLNATVEMMPVTYPSFANMHPFAPTEQAAGYHEMFDDLGDLLCKITGFDSFSLQPNAGASGEYAGLMVIRAYHRARGDYHRDVCIIPVSAHGTNPASAAMCGMKIVAVGTDSKGNINIEELRKAAEANKDNLAALMVTYPSTHGVYEEGIDEICRIIHENGGQVYMDGANMNAQVGLTSPGFIGADVCHLNLHKTFCIPHGGGGPGMGPIGVKKHLAPFLPSHPVITTGGFPLPEKTDPLGTISAAPWGSALILPISYTYIAMMGSKGLTDASKIAILNANYMAKRLEKHYPVLFRGVNGTVAHEFIIDLRGFKTTAGIEPEDVAKRLMDYGFHAPTMSWPVPGTLMIEPTESESKAELDRFCDALISIREEIAEIESGKADVNNNVLKSAPHPPQLLMSDSWTKPYSREYAAFPAAWLRGAKFWPTTCRVDNVYGDRNLICTLQQGSQVAEEAAAATA

SEQ ID NO: 21389 - protein, 405 aa, Sinorhizobium meliloti
MSGRLVVVGGGQAAFALVAKLRALKDMRPITVVAAEASLPYQRPPLSKKYLLREMTLDRLLYRPEAWYAEHEIDIRLSTTVTRVDRLAKQVALSDGSMLTYETLAFATGATPRRLPAAVGGDLAGVFVVRDFRDADRLAEEMQPGRRVLVVGGGYIGLEAAAVARTSGLEVTVIEMADRILQRVASAATSAIVREIHRSHGVDIRERTGLHRLIGDNGRVTAAELSDGSVIPVDIVIVGIGVAANDALAHEAGIETANGIVVDSHGRTSDPTIVAMGDCAVLPWDGMRIRLESVQNAVDQAEAVAAVLAGGTDPYDPKPWFWSDQYDVKLQIAGFGLGHDETLVRQGQRQGSVSVWYFRQGKLIAVDAINDAKAYVTGKKLLEAGATPDRLLLADPQVDLKALLV

SEQ ID NO: 21390 - protein, 333 aa, Candida albicans
MSYPTIPWPTFADLKQMLHGFWASKPTYTESQYPDLQDKVVIVTGGNTGLGYETVKSLAGSTKARIYVFSRNKEKTLAAIKQIQLEIAEEYNVSNSDIRFIQVDLSDLTTIKPAVEEFLKQEQRIDIIIHNAGIMGPPVGSKSKQGYELQWGTNVVGPHLLQRLLDPLFIKTSETNPPGFSRIVWVSSTAHLFAPQGGVFWDNVNYENLKLSQTQVRTTLYAQSKAGNLIQARTWSRKHNYPNVISSSLCPGYLYTDLIRNLNSFEQCFVKRLIYPRRYGAYTELYAAFSPDVKDGAHTIGFGVPSHARTDLTSEAVGDKTWAYLDKETDAYL

SEQ ID NO: 21391 - protein, 193 aa, Oryza sativa
DPRVRLHVGDAVEFLRNAPEGTYDAIIVDSSDPIGPAQELVEKPFFDTIARALRPGGVLCNQAESMWLHTHLIQDMLSICRETFKGSVHYAWTSVPTYPSGVIGFLLCAKEGPPVNFLTPANPIEKLEGAMEAGRDIRFYNSEMHRAAFVLPTFARRELEAYCTTVEREQQEETTAEPLKMNIMPNSEILTAS

SEQ ID NO: 21392 - protein, 340 aa, Unknown
  Frankia sp. CcI3
MKMQLGMIGLGRMGANLVRRLIRGGHECVVYDVNPEAVKALAAEGATETRSLAEFAAALRPPRAAWIMVPAGLTGETVSALAEHFAPDDVIIDGGNSYYRDDILRAASLVERGIHYVDVGTSGGVFGLERGFCLMIGGEPGVVARLEPLFETIAPGVGTIPRTPGRTGEITQAEKGYLYCGPNGAGHFVKMVHNGIEYGMMAAFAEGFAVLDKANIGTTSAEHNAETAPLGNPEYYQYDLDTTAIAEVWRRGSVVSSWLLDLTAAALQEDPGLTEFSGRVSDSGEGRWTVLAAVEEGVPAHVLTASLYERFSSRGEGLFADKLLSAMRKQFGGHAEKPAG

SEQ ID NO: 21393 - protein, 323 aa, Glycine max
MWWPFSRIGSSGFSSYSTAEEVTHGIDGSGLTAIVTGASSGLGAETARVLALRGVHVIMGVIDMIGAKTIKEAILKEIPIAKVDVMELDLSSMTSIRNFASNFNSSGLSLNILINNAGICAAPFALSKDNIELQFAINYLGHFLLTNMLLDTMKKATSESKKQGRIINVSSIGYRFTYREGIIFDKINDQSSYNNWCAYGQSKLANILHANELARRLKEDGIDITANSVHPGATVSTNIHIHSGLLNGLHKIAWLFGLEKILGYMAKNVQQGASTTCYVALHPQVSGISGKYFEDNNLAEVYSHGRDMNLAKKLWDFSINLTK

SEQ ID NO: 21394 - protein, 227 aa, Zea mays
MAGADDLKVLGLWTSPFVIRVRIVLNLKGLAYEYVEDDLGNKSALLLSSNPVHKTVPVLLHAGRPVNESQIILQYIDEVWAGTGPAVLPRDPYERAAARFWAAYIDDKVKSAWLGMLFECRDEGERAEAVARAGEALGTLEGALRGKPFFGGDGVGFVDAVLGGYLGWFGAVGRIIGRRLIDPTKTPLLAAWEDRFRAADVAKGVVPDDVDKMLAFLETLLANYYSK

SEQ ID NO: 21395 - protein, 391 aa, Pseudomonas syringae
MTQVSNRETPRGVAVLSRFLASESAGGIVLMAAALAALIVANSSLSASYFSILHSVWLGLSVELWINDGLMAIFFLMVGLEIKREVLAGGLATWGQRALPGFAAAGGMLVPALIYIAINWGNPQTLSGWAIPAATDIAFALGVLSLLGNRVPTSLKVFLAALAILDDLGAVTIIAFFYSSGLNLPMLAAAFATLAVLIALNRLNVRRLLPYLLLGALLWFFVLQSGVHATLAGVALALCIPMGKPEEEARSPLLFLEEKMHYWVAFAVVPIFGFANAGVSLSGITLANLIDPVPMGVALGLFVGKQIGVFLAAVLAIRAGLATLPENSNWVQLYGVAILCGIGFTMSLFIGNLAFPGSQHLIDEVKVGVLIGSGLAAIAGILLLRTRFSRH

SEQ ID NO: 21396 - protein, 831 aa, Saccharophagus degradans
MTVTRRDFVRHQALATAAAAAGVAVPAAATNIVTTAADNKLVWSKAPCRFCGTGCSVNVATKEGRVVATHGDIKSPVNRGLNCVKGYFLSKVMYGEDRLTQPLLRKKNGVYAKDGEFEPVTWEEAFTIMAEKFKKTLKEKGPEGIGMFGSGQWTVWEGYAASKLMKAGFRSNNIDPNARHCMASAVGGFMRTFGIDEPMGCYDDFEHADAFVLWGSNMAEMHPILWTRIADRRLSYPHVQVAVMSTYEHRSFDLADLGVVFTPQSDLAIANFIANYIIQNKKVNWDFVKKHTNFRVGTTDIGYGLRPEHPLQKAAKNADSAGASEPIDFETYAKFVADYTVEKASEISGVSEDKLIKLAKLYADPNIKVMSLWTMGVNQHTRGVWMNNLIYNIHLLTGKISEPGNSPFSLTGQPSACGTAREVGTFSHRLPADMVVTNPKHRAYAEKIWKLPEGSIPEKVGAHAVLQSRKLKDGEINAYWVQVNNNVQAGPNINEEVLPGYRNPQNFIVVSDAYPTVTAQAADLILPSAMWVEKEGAYGNAERRTQFWHQLVNAPGDARSDLWQLVEFSKYFKVEEVWPADLIAKMPEAKGKTLFDILYKNGKVNKFPLAQVSKDYENKEADAFGFYIQKGLFEEYAEFGRGHGHDLADFDRYHEERGLRWPVVNGEETLWRYREGSDPYVEKGKGVQFYGKPDGKAIIFALPYEPPAESPNKEYPFWLCTGRVIEHWHSGSMTQRVPELYKAFPDAVCFMHPEDARSAGLRRGDKVKLQSIRGHIITRIETRGRNKPPKGLVFVPWFDARQLINKVTLDATDPISKQTDFKKCAVKVERV

SEQ ID NO: 21397 - protein, 906 aa, Pseudomonas syringae
MTSLAIQTTRVTASTCCYCGVGCGVLIEHDGQNILGVSGDPKHPANFGKLCSKGSSLHLTGDIEARALYPELRLSKGLARSVTDWDTALEHAANVFADSIREHGSDSVAFYISGQLLTEDYYAFNKLARALVGTNNIDSNSRLCMSSAVAGYKRSLGADAPPCSYEDIELSDCVMIVGSNMAYAHPILFRRLEEAKSRRPQMKLIVIDPRRTDTCELADLHLPIQPGTDVALFHGILHVLISESLIDPEFIAAHTQGYEALSALVRDYPPERVANLCGITQEQLYTCASWVGEAPGFLSLWCMGLNQSTAGSAKNSALINLHLATGQIGRPGAGPFSLTGQPNAMGGRETGSLSNLLPGHRDAANSEHRAQVAHYWGVDSLPAKPGLSAIELFEQLQNGTIKALWIACTNPAQSLPDQNRIRQALETCPFVVLQEAFKTTETARYADLLLPAASWGEKEGTVTNSERRISNVRKAIAPPGEARSDWAITVDFAQRLQKRLQPDAPALFDFHTPKALFDEFKGLTAGRDLDMSGIDRQLIDLHGPQQWPFPRGASVGTPRLYTDGIFPTDSGRAQFLSEPYIAAKELRDADYPLTLNTGRLRDQWHGMSRTGTAARLFGHVSEALLSLNPRDMQRYDLQPGDLVKLISRRGELLLPVGGDDSVACGQAFLPMHWGDRFLKGGVNALTQPAFDPISKQPELKHSGVKIEKAHLPWQFFALIEGNVQQQMERLRPLCDVFTYLSMGLAGRERPALIIRAASAEAPDPMLLQHIDQVLGLDEGPVMAYDDPKRSIGKRVRIDNGRITAIRLAGETLARHWLQALWLEERIDASLRRWLLAPLSSEPGKDSTQAFDKTLCNCMNVSQSAVKECIERGLDLNQLKTQLGCGTQCGSCVPEIKRLINTVAVTQ

SEQ ID NO: 21398 - protein, 613 aa, Arabidopsis thaliana
MASLSGLYSSSPSLKPAKNHSFKALPAQSRDSFSFPHTSKPTNLPLTLSSARSVARDISHADSKKELLKDPDALWKRYLDWFYQQKELGLYLDISRVGFTDEFVAEMEPRFQAAFKAMEDLEKGSIANPDEGRMVGHYWLRNSKLAPKPTLKTLIENTLDSICAFSDDIISGKIKPPSSPEGRFTQILSVGIGGSALGPQFVAEALAPDNPPLKIRFIDNTDPAGIDHQIAQLGPELASTLVVVISKSGGTPETRNGLLEVQKAFREAGLNFAKQGVAITQENSLLDNTARIEGWLARFPMYDWVGGRTSIMSAVGLLPAALQGINVREMLTGAALMDEATRTTSIKNNPAALLAMCWYWASNGVGSKDMVVLPYKDSLLLFSRYLQQLVMESLGKEFDLDGNTVNQGLTVYGNKGSTDQHAYIQQLRDGVHNFFATFIEVLRDRPPGHDWELEPGVTCGDYLFGMLQGTRSALYANGRESISVTIQEVTPTSVGAIIALYERAVGLYASIVNINAYHQPGVEAGKKAAAEVLALQKRVLSVLNEATCKDPVEPLTLEEIADRCHAPEEIEMIYKIIAHMSANDRVLIAEGNCGSPRSIKVYLGECNVDDLYA

SEQ ID NO: 21399 - protein, 328 aa, Prochlorococcus marinus
MSRIYEDNSFAIGHTPLVKLNSITKNAKATVLAKIEGRNPAYSVKCRIGANMIWDAEKKGLLNKDKVIIEPTSGNTGIALAYTAAARGYKLILTMPESMSIERRRMMAVLGAELILTEAAKGMPGAIAKAKEIADSDPKKYFMPGQFDNPANPEIHFKTTGPEIWDDTDGQIDVLVSGVGTGGTITGVSRFIKQEKNHSLLSVAVEPTHSPVITQTLNGEEVKPGPHKIQGIGAGFIPQNLDLSVVDQVEQVSNDESIAMALRLAQEEGLLVGISCGAAAAVALRLAEKEEFSGKTIVVVLPDLAERYISSVMFENVPTGVIKEPSLA

SEQ ID NO: 21400 - protein, 166 aa, Oryza sativa
MGASSSLDLVKTMAASGFLLRCPAAPSAVPIWGRSGRGGGGGLAFSASSSNGRFLVRFVLAFVFPFATSGAAVPSSLSDSEKKGPVVMEIPLDKIRRPLMRTRANDPAKVQELMDSIRVIGLQIDVLEVDGVYYGFSGCHRYEAHQRLGLPTIRCKVRRGTKETLR

SEQ ID NO: 21401 - protein, 847 aa, Unknown
  Rosa hybrid cultivar
MEMPGRRSNYTLLSQVPDDHFAAATATSFYESEGKNNNNKAKGDSRGFDWETGGGEYRAAPANRIGNVYSSVGLQRQSSGSSFGESSLSGEYYAPTLSTTAANEIDGFGYVNDDGFKTGGGGGEFRGKGGGMDGGVGPPGGSSSGKSWAQQTEESYQLQLALALRLSSEATCADDPNFLDPVPDESSSRLSSSADAVSHRFWVNGCLSYFDKVPDGFYLIHGIDSYVWSMCTDVQESGRIPSIESLKSVDPGTGSSIEVVLIDRRSDPSLKELQNRVLSISYACITTTEIVDQLAKLVCSRMGGSASVGEAEFFSIWRESSDDLKDCLGSVVVPIGSLSIGLCRHRALLFKVLADTIDLPCRIAKGCKYCTRDDASSCLVRFGIDRELLVDLIGNPGCLCEPDSLLNGPSSISISSPLRFPRLRTVEPTIDFRSLAKQYFSDCQLLNLVFDEAPAGSAGDEDNKGFSMYPKQKFTDGNNLFLVSGLGDDTSMHVDDRNPQFLKSFNPSQNIVHQQTVLKDQIPLKRIPPIGHRDISRLDTSKDSRFGEGLQVVPSKPNKELTLDVDDLDIPWSDLVLKERIGAGSFGTVHRADWHGSDVAVKILMEQEFHAERFNEFLREVAIMKRLRHPNIVLFMGAVTKPPNLSIVTEYLSRGSLYRLLHKPGPILDERRRLYMAHDVAKGMNYLHRRNPPIVHRDLKSPNLLVDKKYTVKVCDFGLSRLKANTFLSSKSAAGTPEWMAPEVLRDEPSNEKSDVYSFGVILWELATLQQPWGNLNPAQVVAAVGFKNKRLEIPRDLNPQVASIIEACWANEPWKRPSFASIMESLRPLIKAPTPQPSHADMPILT

SEQ ID NO: 21402 - protein, 985 aa, Bacillus clausii
MARQFEVTLNGKKETVTNPRSLLTFLAEKKVEVPSLCYHPSLGAIETCDTCIVEVNGEFVRSCSTDIKPGDTIHTKSAGVHEAQLIAMDRILGNHELYCTVCDYNNGNCEIHNAVKEMKMTHQETEHSSKKAEVQRNAFYRYDPDQCILCGRCVEACQDVQVTETLSIDWSLERPRVIWDKHSPIDESSCVNCGHCSTVCPCNAMMEVGMEGEAGYLTAIKENSMRPMINITKNVETGYQSLMAVSDVEAIMREERINKTKTVCTYCGVGCSFDVWTKGRQILKVEPQPEAPANGISTCVKGKFGWDFVNSEERLTKPLIREGDGFRETNWEEALDVIARKFKEAIDQNGPDALAFISSSKCTNEESYLMQKLARAVVGTNNIDNCSRYCQSPATKGLWRTVGYGGDSGGIEDIAKAGLVISIGSNTTESHPVLATRVKRAQKLHGQKVIVADIRKHELAERADVFIKPAPGSDLVWLSAVTKYIIDQGWHDEAFLRKHVNNVQTFIDSLAVYTLDYAEKATNLSKDEMIAVATAIHEADTTCILWAMGVTQHGGGSDTSTAISNLLLVTGNYMKPGAGAYPLRGHNNVQGASDFGSMPDRFPGYQFVSDDEVRQRYEQKWGVKIPAEPGLNNHEMVDAIHEGKLNILYLKGEDMGIVDSNANYVQAAFEKLDFFVVQDVFFSKTAQFADVVLPASPSLEKEGTFTNTERRVQRLYQVLEPLGDSRPDWMIIRDIANRLGAAWSYKHPSEIMDEAASLAPLFAGVRYDRLEGYNSLQWPVAEDGTDTPLLFKDKFPLPEGKAHLYPVTWTKPLEFGDEYDIHVNNGRLLEHFHEGNLTYRSKAISGKTPEVFLEVSKELAKDRGITDGTKVRLTSPYGSVKVRCVVTERVAGKEVYLPMNTSGEGAINYLTSSHSDKDTDTPAYKEVAAKLEVLEPQGKNPLPKTNHRYGNPQPQIGVRVQEKWARKDYVFPGDVVKERRAQSNG

SEQ ID NO: 21403 - protein, 542 aa, Ustilago maydis
MSTPILPAWPPSLSDEARDYLSHQATDYALSHGIVYRPLPTPPSAAPPTSSTIHAPFSLFPSPFPRTLFDKAQSIQPAYDLLYAQVSSNHTFLQRVIGDSVVQVDSFQKQLWDIYVTVKDDLVQPLSLGLFRSDYLLHDAQSESKAADEMGSRSGQLELKQVEFNTISASFGALCTKVNGLHRHLSSTTNYLGVGKDLDKLENLPENKAQDVLVGGLAAAHAAYLNQQGYEAPAAKNVYVLFVVQEGERNAFDQRPLEHALQGKGIRVVRQSFAEIASRMTLKPDDAKRTLLLNHPVLGLIEVSTVYFRAGYGPSDYTSESEWNTRKQLERSLAIKCPSIAVQLAGAKKVQQVLAEPDQLESLLSNLGADASTAQKLRETFTDLYPLDESPLGKKGYELATTAPQNYVLKPQREGGGNNVYRHDIPPFLAQIESCSPSSLAYNVSKKQAYILMSLIKPPAGLGNYLVKSATATTPGTPVLAKDTVSELGVYGAVLFQNTETDTPVEIKHHQSGGYLLRTKGRDSDEGGVAVGFSVIDSPFLI

SEQ ID NO: 21404 - protein, 295 aa, Anabaena sp.
DVPVNLYRPNAPFIGKVISNEPLVKEGGIGIVQHIKFDLTGGNLKYIEGQSIGIIPPGVDKNGKPEELRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETY

SEQ ID NO: 21405 - protein, 296 aa, Brassica napus
MEVEKSQENTTGGEDDESKIIYRGWKVMPFIIGNETFEKLGIVGSSSNLVIYLTTVFNMKSITAATVVNIYGGTSNFGTIVAAFLCDSYFGRYKTLSFAMIACFLGSVAMDLTAVINQLHPAKCGKEIGSVCKGPSIGQIMFLAGAMVLLVIGAGGIRPCNLPFGADQFNPKTKEGKRGVDSFFNWYFFTFTFAQMVSLTLIVYVQSNVSWSIGLAIPAILMLLGCIIFFAGSKLYVKVKASGSPIHSITRVIVVAIKKRRLKHIGSSSEGLYNYIAKDFKNSKLSHTNQFRFLDK

SEQ ID NO: 21406 - protein, 137 aa, Escherichia coli; identical to SEQ ID NO: 391

SEQ ID NO: 21407 - protein, 302 aa, Tulipa gesneriana
MAIPVIDFSMLNGSERTQTLAQIANGCEEWGFFELVNHGIPVELLDRVKKVCSECYKMEREEGFKAASEKLLKKMENSGKEDVDWEDVFLLQDDNEWPSNPRDFKETMKAYRAEIKNLAERVMEVMDENLGLDKGYINRAFCGGDTVQQPFFGTKVSHYPPCPRPDLVNGLRAHTDAGGVILLFQDDEVAGLQILKDGRWIDVQPLPNSIVINTGDQIEVLSNGQYKSVRHRVLPTPDGNRRSIASFYNPAMKATIGPATKLVAQAAAVASYPDFVFGDYMDVYAKQKFLAKEPRFQAVRAM

SEQ ID NO: 21408 - protein, 259 aa, Bacillus megaterium
MGKVYLVGAGPGDPDLITLKGLKAIQQADVILYDRLVNKDLLEYAKSDADIIYCGKLPNYHTLKQETINNFLVKFAKKGKIVTRLKGGDPFVFGRGGEEAEALVQQGISFEIVPGITSGIAAAAYAGIPVTHREYSASFAFVAGHRKDSKHDAIKWDSLAKGVDTLAIYMGVRNLPYICQQLMKHGKTSATPIALIHWGTCADQRTVTGTLGTIVDIVKEEQIENPSMIIVGEVVNFHDRLNWFEKTGQHYYSYAQEAY

SEQ ID NO: 21409 - protein, 455 aa, Streptomyces griseus
MSVAVVLFTSDLRLHDNPVLRAALRDADEVVPLFVRDDAVHRAGFDAPNPLAFLADCLAALDAGLRHRGGRLIVRRGEAATEVRRVAEETGAARVHIAAGVSRYAARREQRIREALADSGRELHVHDAVVTALAPGRVVPTGGKDHFAVFTPYFRRWEAEGVRGTQTAPRTVRVPDGVASDPLPDRDCVENLSPGLARGGEEAGRKLVTSWLNGPMADYEDGHDDLAGDATSRLSPHLHFGTVSAAELVHRAREKGGLGGEAFVRQLAWRDFHHQVLADRPDASWSDYRPRHDRWRSDADEMHAWKSGLTGYPLVDAAMRQLAHEGWMHNRARMLAASFLTKTLYVDWREGARHFLDLLVDGDVANNQLNWQWVAGTGTDTRPNRVLNPVIQGKRFDARGDYVRGWVPELAEVEGSAIHEPWKLQGLDRAGLDYPDPVVDLAEARARFERARGLD

SEQ ID NO: 21410 - protein, 484 aa, Erwinia carotovora
MKTKTSYGLNWLAMIVILVIAAFFWQMEPPAGLNPAAWHSAVIFVATIVCIVANVLPIGAIGIISITLFALTYAAGDKTASGAIQTALSDLNSSLIWLIVVAFMIARGFIKTGLGRRIALQMIRLLGKRTLGLAYGLAFADLVLSPAMPSNTARCGGIIYPIADSLSRSFDSKPEDASRSKIGTFLITCIGNVNDVTAAMFMTAYTGNLLAVKLAANAGVTITWGSWFLAALVPCLISLAIVPLLVYWLTKPEIRHTPDAPKLAVAELAKMGSISRGEWLMAFTVILLLVLWIFGDRLGVDATTASFVGLSFLLLTGVLSWEDVKNEKGAWDTLIWFAALLMMANQLKKLGFTNWFGDLIGSNIGHLMQGTSWVLVLLLLNAAYFYTHYFFASGNAQIAALFAVFLGVGINLNIPAVPMAFMLAFTSSLYCSLTQYTHARGPILFGAGYVPTAVWWRTGFVVSLVNQAIFMGAGLLWWKAIDLY

SEQ ID NO: 21411 - protein, 315 aa, Oryza sativa
MGGGGGGTPRSSIGHILPGAGFVAVGVWHLFNHVKLFSQRPDTYVAPAWFPVPGARYLELALIIAGSGVEFAMEMFVGHSTLLPFAADGSIPSDRLHNHEHAIICLSLAVYAAAALHLDRARAPARGTLGLLLVAAVFAQELLVFHFHSTDHAGVEGQFHWLLQVVVAACLATSLLGVGYPRSFAVGLARSACVAFHGLWLAVIGAMVWVPSLVPRGCELVREDGRDTVRCRSKESLHRAKALANLQFGWYLSFMTVFVVALYLYVSNRYPAAEEAAYAPLRKAGAGDGDDDGDDDAHKGGGAGVHGFAALEIEV

SEQ ID NO: 21412 - protein, 411 aa, Moorella thermoacetica
MKRTDILVAGGGIAGCTAALAARRYYSDKKITLVRREVRALMPWGLAYACGAGSLNEYILGDSRLYKEGIELVIDEVTAIDPGGKRVTTAFGEKIAYDKLILAIGSSPVTSLLQGTELPGVFVLKKELPYLKSLKEHLARARNVVIVGGGLNGVELAAACSANHQLHITLVEQLPHCLSGVFNDDTCILIEEKLRRKGVAIITGAAAEGLEGCHRVEGVRLTGGRTLPADVVVLATGIVPNTLLARQAGLATDENAGILVDEYMQTSATDVFAIGDCAAQKSLVPTGGSLTRQAGPAGHEARVAAANLFGLKRAREITVKKISVAIGDLVFGSVGLIKISLAETGTGMPTTALAHDVIAKDLAVKVVYVRETGATLGAEVYGKPLIRVRETMNNLASAIERQTPFAGLALA

SEQ ID NO: 21413 - protein, 344 aa, Oryza sativa
MGTMVGHVAPGAGFILIGMWQLFNHIRLFALRPSSYAAPVWFPVRGVRHLELILVIVGAAISILMELVIGPARHQPFDDDGTIPSNHLHNFEHASISLALLVYAAVTIHMDRARAPMRDAVSQLVAAAAFAQQLLIFHLHSADHMGVEGQFHWLLQTVIAVTLATTVLGIPCPRSFAISLVRSASLVFQGVWFVVMGVMLWTPALIPKGCFLNLEEGHDVVRCRTDEALPRAKSLVNLQFSWYLTATVVFVVVFYLHLTKLYPEEPRYLPLVKGGGGGGDGDSDGGRFSIGDDEDDLEAAKGGFGHVAGGGNAVEIERVQRRAKPIKTAFQGFRFTSFGGNITL

SEQ ID NO: 21414 - protein, 434 aa, Unknown
  Silicibacter sp. TM1040
MARTPPGEEKGKDMKDLENIPALMEDIGKRAKAAAQQLATASAAQKEQALNAAADAVWAQRGEIIAANAKDLEFGRDKGLSSAMMDRLMLDEARIQGIVDGLRAVAAQADPVGAVLDEWTQPSGLRIQRVRTPLGVIGVIYESRPNVTADAGALCLKSGNAVILRGGSESLHSAQAIHGCLAAGLRAADLPEDAVQLVPTRDRAAVQELLTMTAYVDVIVPRGGKGLVGLVQREARVPVFAHLEGIVHIYLDKDADRKKAIDVVLNAKTRRTGICGAAECLLIHEDIADSIGKDVLDLLAMGGVEIHAEEGLPGPDSMQVATSEDWGKEYLDAIIAAKKVASIDEAIAHIRRYHSAHTDCIITENDAAVAQFFSELDSAILMHNASTQFADGGEFGMGAEIGIATGKMHARGPVGATQLTSFKYLVRGDGTVRA

SEQ ID NO: 21415 - protein, 382 aa, Spinacia oleracea
MPSRPSRVVKEQHPTKKSFLDLESLNELPDSFAWGSFEDPCSIDNPSGYGPDSVPVINLQDPQAQQLVGLACRSWGVFQVTNHGIQKSLLDDIEAAGKSLFALPVNQKLKAARSSCGVTGYGPAGISSFFPKRMWSEGFTILGSPLDHARQLWPNNYNKFCDIIEKYQKEMNQLAKKLMQLVVGSLGISNQDIMNWADLLEGANGAMQLNSYPIRPDPNRAMGLAAHTDSTLLTILHQSNTTGLQVFRERSGWVTVPPISGGLVINIGDLLHILSNGRYPSVYHRAMVNRVQHRLSVAYLYGPASGVRVQPLPKLIDATHPPLYRPVTWSEYLGIKSEHLTKALSLIRINHNTNPSLTGLIGNDEPKSINVDSDKTILAVFG

SEQ ID NO: 21416 - protein, 238 aa, Brassica napus
MMKQARTLLSRSLCNQSNSLFEGSSRSLAFRGFATWVDSSTTKRADAKPSGRVFAPYAIFKGRAALSVEPVLPTFTKIEPGNLRIDRRGSVMMTFMPAVSERKYDWEKKQLFALSPTEVGSVISMGPQDSSEFFHDPSMKSSNAGQVRKSLSIKPLADSTGYFFQLSVTDNIQNSNDRIVVPVSKAEFAVLKSAFSFALPHILGWDRITGGDVGIAAQGVASLPKADPMQLELEWGKE

SEQ ID NO: 21417 - protein, 137 aa, Solanum lycopersicum
KPAEKKPAEKTPVAEKAPAEKKPKAGKKLPKDAAAGDKKKKRSKKAVETYKIYIFKVLKQVHPDIGISSKAMGIMNSFINDIFEKLAQEASRLARYNKKPTITSREIQTAVRLVLPGELAKHAVSEGTKAVTKFTSS

SEQ ID NO: 21418 - protein, 142 aa, Solanum lycopersicum
MAPKAGKKPAEKKPVEEKKAEEVPAEKKPKAGKKLPKDAGADKKKKKSKKSVETYKIYIFKVLKQVHPDIGISSKSMGIMNSFINDIFEKLAQESSRLARINKKPTITSREIQTAVRLVLPGELAKHAVSEGTKAVTKFTSN

SEQ ID NO: 21419 - protein, 560 aa, Oryza sativa
RAVKDMAIAMHFELRVVKSDRSRFIAKCAREGCPWRVHVAKCHGVPTFTVRTLHGEHTCDGVRDLHHHQATVGWVARSVEATLRDNPQYKPKEILQDIREQHGVAVSYMQAWRGKERSMAAVHGTLEDGYRFLPAYCEQIVQTNPGSVAIYKGTGPDNSFQRLFVSFHASIHGFLNACRPLLEIDKADLKGKYLGTLLCASAVDAENMMFPLAFGIVDAESDENWMWFFSELRKMLGVNTDKMPVLTILSERQSQVVEAVEVNFPTAFHGFCLRYVSENFRDEFKNPKLLNIFWSAVYALTAAEFDSKVNDMVQVQDVMPWFQRFPPNLWAVSYFEGIRYGHFNLGITEILYNWAMECHEFPIVQTVEHIKHQLTCWFVERQNLALSYNSILVPSAEKLISEAIADSGCYQVLRANKVEFEIVSSERTNIVDTQARCCSCRRWQIYGIPCAHAVAALLSCGEDPRLYAHECFSIMKYRETYSQPIYSIPDRSQWNLPFSFAQGAGSKAYAVLRPPKIRRPPGRPKMKILKIESLKRPKRIVQCGRCHLLGHSQKKCSLRN

SEQ ID NO: 21420 - protein, 173 aa, Zea mays
MSRSVEPLIVGRVIGEVLDSFNPCVKMIVTYNSNKLVFNGHEIYPSAIVSKPRVEVQGGDLRSFFTLVMTDPDVPGPSDPYLREHLHWIVTDIPGTTDASFGRQIISYESPRPSIGIHRFIFVLFKQQGRQTVTVPSFRDHFNTRQFAEENDLGLPVAAVYFNAQRETAARRR

SEQ ID NO: 21421 - protein, 896 aa, Alteromonadales bacterium
METLNTCSNTPLLKQTTCAYCGVGCGVDISLLNNTPTKLEGTREHPANFGRLCVKGTHLLDTTGSDNRLTSPLIDNEPASWDAATKFVANRFNAIIKEHGPESVAFYVSGQLLTEDYYVANKLMKGYIGSGNIDTNSRLCMSSAVAGYKRAFGEDVVPCTYDDLEQTELLILIGSNAAWTHPVLYQRMERAKKLNPNMKVVVIDPRKTDTAELADTFLNIKPGSDAALYNGLLTYLSEHNYLDTQFINEHTNGFETALVEAKKWSVKAVSDFCDIDAQLVSDFYALFAKSPTAISFYSMGINQSSSGVDKCNAIINAHLASGKLLKPGCGPFSITGQPNAMGGREVGGLANQLAAHLDIENEAHQQLVQRFWQSPTIAKKAGCNAIDMFDEIAKGKIKAIWVMATNPMVSLPNNAAIQHALEQCELVVVSDCIAKSDTLKFANVAFPSTGWGEKNGTVTNSERRISRQRPLVEPFSGAKNDWQIMCLVAQKMGFEGFDFTDPSGIFEEWAQLTDFENNGDRLLNLSALVGLSQQQYDNLKPVMWPVLKNEPYKNGQVFVNNQFSTADKKARFIPITPKLPVQQTSSDYPFVMNSGRIRDQWHTMSRTGKSTALSTHITRPYIEINPIDASKLNIKANDLITANAKTGQVTAHAKITDAVRKGECFMPIHWNKQFASSATVSGLYQSVVDPISGQPECKHGAVDLVKAQFAQYMQIFSKTELKITSDFWLKVNASNCVNYQLALNEQQNDLLYYCQTLTGLQGQWSAIGSAKAMHIQCIENEQLVFVAVVSLAQKDISLEWINHLFAEPLITFSQLQSLLYAMPDEEFTQGAQVCSCFKVREQPIINAIKCGENTVEKLGSKLKCGTNCGSCKTQLSQLIKQHTTQHANSIDVAVEM

SEQ ID NO: 21422 - protein, 508 aa, Alteromonadales bacterium
MPSKQRVVVVGNGMVGHHFVQQLVSQQGDNKNVDITVLSGEDRLAYDRVQLSSFFNGKTEDDLALTCSKTYQDWQVCFHTHSKVVDINRDAKKVTTAKGESFEYDKLILATGSFAFVPPIPGKDRDHCLVYRTINDLHAIKKSAQGSKVGVVIGGGLLGLEAANALKQLGLQTHVIEFAPQLMGVQIDGAGGRLLKNKITELGVKVHTSVATEQITEGENSRYKMCFKGGQTLETDMIVFSAGIRPYDNLAREFNLEIGERGGIVINNHCQTSDKNIYAIGECALWNNFIFGLVAPGYAMAKVAAGHVLQQLSSNKALHTTSNNSSNSADEFSGADMSTKLKLMGVEVGSIGDAHARSEGAISYYFEDQLSGIYKKVVTNEQGNKLIGAVLVGDTSEYDKLLQYHLNSIELSVPAESLIMPLAGDTGELSADDLPSDAIICACHKVTKHTIEHAVMQGCSDLSDVQQATKASTGCGGCEKLVQSVISSSLNNKIATLTPVDEPVSQSA

SEQ ID NO: 21423 - protein, 467 aa, Myxococcus xanthus
MVRSTCASGSSPLQDPFMSQVRLPPGPQGHFIAGNLVEFSEDPLGFLTRCAREYGDVVRLGKRNFLLNHPDLIERVLVNGDGNFVKLAGVGQGKRHKGGFPEAMMNSEGEDWLRKRRLVQPAFHRKHVAACGDTVVALTETMLQTWRPGDARDVHADVSALALDIVSRFLFHTPIDDEARHVADAVDAVMRHTDSPLRPPIWVPTPTNLRLRRALGRLNTLLATLVRRYREQPESRTDLLALLLSAPVPLSENQLRDELATMIMSGHETTADALVWAWYLLAQHPEAEARLVAELETVLGGRLPGAEDLPRLRYTEAVVKEAMRLYSPAWITSREALRDCELGGFHVPAGTMLAVSQWVTHRDARYFDAPESFRPDRWLSEDAQRMHRYVYFPFGGGPRFCIGSALAMMETVLITACVARRFRLELAPGCVVRPRPALALQPLGVWLIPRHRSHTTQEGEVRHAAGA

SEQ ID NO: 21424 - protein, 175 aa, Unknown
  Synechococcus sp. WH 7805
MSIPEGYRLRRMLRSAMAPSVSNVSVRTPDGSEKSLGSYAGQVLLIVNVASRCGFTKQYAGLQSLQDTFGPRGLQVLGFPCNDFGAQEPGTLDEIKSFCSTTYGASFELFDKVHATGSTTEPYTTLNQTEPAGDVAWNFEKFLVGKDGTVLARFKSGVAPEDAELSAAIEAALQA

SEQ ID NO: 21425 - protein, 197 aa, Hordeum vulgare
ECFPGRTDVQCLHRWQKVLNPELIKGPWSKEEDDIIVEMVKKYGPKKWSTIAQALPGRIGKQCRERWHNHLNPGINKDAWTQEEEITLIHAHRMYGNKWAELTKFLPGKTDNSIKNHWNSSVKKKIGSYMSSGLLAQVSRLPLVEHHAHFSSSPAITQQNSEDSESNAVREVEDSSGCSQSSLGIVSSRKCRHASLG

SEQ ID NO: 21426 - protein, 328 aa, Medicago truncatula
MGEVAYTNGNGNDKSHSPPNGYRKSCWYEEEIEENLRWCFALNSILHTGASQYQDIALLDTKPFGKALVLDGKLQSAETDEFIYHECLVHPALLHHPMPKNVFIMGGGEGSTARELLRHKTIDKVVMCDIDEEVVEFCKSYLVVNKEAFHDSRLEVVINDAKAELEGKEEKYDVIVGDLADPIEGGPCYKLYTKDFYELTLKPKLKKGGIFVTQAGPAGIFSHTEVFSCIYNTLRQVFKYVVPYSAHIPSYADIWGWVLASDSPLDLSAEELDIRMRQRIIEENRYLDGKTFVSSSTLSKAVRNSLNNETHVYTEGAARFIYGHGKNA

SEQ ID NO: 21427 - protein, 385 aa, Unknown
  Silicibacter sp. TM1040
MSKRDYYEVLGVSKGASADEIKKGFRKKAKELHPDRNADNPDAEAQFKEANEAYDVLKDPERKAAYDRYGHAAFENGMGGGGGGRAGGHPGGDFSSAFSDVFDDLFGDFMGGGGGRAGARQRATRGADLRYNLRLSLEEAFAGLHKTINVPTSVSCTSCEGTGAEGGAEPTTCPTCSGMGKVRAQQGFFTVERTCPTCSGLGQMIKNPCKTCNGHGRVEKDRSLSVNIPAGVETGTRIRLAGEGEAGLRGGPPGDLYIFIEVARHELFEREGNNLHCRVPVSMAKAALGGAIEVPTIDGGRGRVQIPEGSQSGRQMRLRGKGMPALRGGGTGDMFIELAVETPVNLTPRQKEILKEFDEISEENTNPETRSFFSSVKSFWDGMKG

SEQ ID NO: 21428 - protein, 489 aa, Alteromonadales bacterium
MQPSTGFNLISFSGKMKILHLSWMVFFISFFVWFNHAPLLGAIAGSLGITMAQVKTLLILNVALTIPARVVVGMLTDKFGPRIVYASLLILCSIPCFMFAMATTFEQAAIARFALGFIGAGFVVGIRMVSEWFPANELGAAEGIYGGWGNFGSAAAAMLLPVLALMFGGDDGWRYAIGLTGVLSVIFGVIWYINVTDTPKGGTYFKPKKVGAMEVTSKGDFVLLLIMKLPMYGALALLTWKLSPTGANLLSENFVIGTYVFLVLLYLYEVYKTYDINGHIFKQPVPESHRYEFKQVAVLNILYFTTFGSELAVVSMLPLFFSEVFGLDMVYAGLLASAYAFMNLASRPGGGWISDRMGRRKTLIVLTTGLAVGYFVMGLVDASWPLWLAVAAAMACSFFVQAGEGAVFAAVPLIKRRLTGQIAGMTGAYGNVGAVVYLTALSLVDYQTFFMIIAASALLGLGALFFMKEPDGHITEVNEDGTVELISVT

SEQ ID NO: 21429 - protein, 1052 aa, Vibrio cholerae
MKRMLINATQKEELRVALVDGQRLFDLDIESPGHESKKANIYKGRITRIEPSLEAAFVDYGAERHGFLPLKEIAREYFPDGYSYQGRPNIKDVLNEGQEVIVQIEKEERGSKGAALTTFISLAGSYLVLMPNNPRAGGISRRIEGDERTELKSALSSLELPQGMGLIVRTAGVGKSAEELEWDLNVLLKHWSAIKQASDSNPAPFLIHQESNVIVRAIRDYLRRDIGEILIDSNSIYERALEHIRLVRPDFVNRVKKYEGEVPLFSHFQIESQIESAFQREVRLPSGGSIVIDPTEALTSIDINSARATKGGDIEETALNTNLEAADEIARQLRLRDLGGLVVIDFIDMTPVRHQREVENRLREAVRVDRARVQIGRISRFGLLEMSRQRLSPSLAEASHHICPRCKGTGVIRDNESLALSVLRLIEEEALKDNTSQVLAVVPVSIASYLLNEKRRSINHIEKAQQVRITIVPNSDMETPHFEVIRVREGEEQDVLSYLIPKKLEAMKEAEGKEVVDVELKPKRIEEPVLKGFAAPAEAVPAPTPKPKAEPQPVAEVQQPAQPGFFSRVFKAIASLFSATPEAAKVEAPVTQNSEQDKPRRERNDRNNDRRRNPRDKNRRRGNEENNERNDKETSNSNRKPQERKPKQERGERNERNDRNERPETERPERQDRRNKRDESKTAKLLEQGRQLAAEAQQEVKAVEPKEEKAAVVKERRQRRKLSKQIRVKDQLAAEELDNLSTAPVDNAFDAPAPVNLPVTDDFADSAQEDNEQDDQKQRRNRRSPRHLRASGQRRRRGRDRRPNPFRLRKGGVASPEMAMGKVMPRYDLAPRPQSRHETAEGAQHVTHVTPTAATAVVESEKVAAPRVLGGVAFPEMAMGKVIVRRETAAVQPEPVVQEPVITDVIAETLIAPVEPVVVEATVIEAPVIEESATETAALETVVAKVAEVEEPATISDEVVAQTTVEVIADKMAEPIKVVKPVTVSATSLTAKAVIQQPYASSPMTKAPGSDDIREVQVNAAPLRAERYQARGAGSQVARNQASAGMSKPQSF

SEQ ID NO: 21430 - protein, 304 aa, Klebsiella pneumoniae
MRFCQALMTELYRHLGADTDVPAGDIGVGGREVGFMAGMMKKLSNNTACVFTGKGLSFGGSLIRPEATGYGLVYFTDAMLKRHGLGFEGMRVAVSGSGNVAQYAIEKAMALGARVITASDSNGTVVDEAGFTTEKLARLCQIKSQQDGRIADYAKEFGLTYLEGQQPWGVSVDIALPCATQNELDAPAARILIANGVKAVAEGANMPTTIEATDLFLEAGVLFAPGKAANAGGVATSGLEMAQNAARMGWKAEKVDLRLHHIMLDIHQACVEYGGEDKQTHYVRGANIAGFVKVADAMLAQGVL

SEQ ID NO: 21431 - protein, 353 aa, Caulobacter crescentus
MAKAAPWPLDAWYVACTPDEIADRPLGRRICGKAMVFHRGKDDRPVALEDFCPHRGAPLSLGFVRDGELVCGYHGLTMGCEGRATAMPGQRVAAFPAIRAFPVLERYGFIWVWPGDPAQADPAKLHPLFWADSPDWAYGGGLYHIACDYRLMVDNLMDLTHETYVHATSIGQKEIDEAPVTTRLEGEEVVTSRFMEGIHAPPFWRMALRGAGLPENALVDRWQICRFSLPSHVMIEVGVALAGHGGYHAPADKKVSSVVVDFITPETETSHHYFWGMARSFAVGDAALTDTIREGQGKIFSEDLEMLERQQKNLLAYPDRKLLKLNIDAGGVRSRMAIDKAIAAETALAAQAK

SEQ ID NO: 21432 - protein, 590 aa, Pseudomonas syringae
MCGLAGELRFDHQPADLAAVERITHELAPRGPDAWGFHSQGPVALGHRRLKIMDLSDGSAQPMIDSNLGLSLAFNGAIYNFPELRAELESLGYQFHSGGDTEVLLKGYHAWGADMLPKLNGMFAFAIWERDSKQLFIARDRLGVKPLYLSKTDKRLRFASSLPALLKGGDISGMLDPVALNHYLNFHAVVPAPRTLLAGVEKLPPASWMRIDASGKVEQKVWWTLPYGPHEDEKNLTLEDWRDRVLDSTREAVAIRQRAAVDVGVLLSGGVDSSMLVGLLREVGVEDLSTFSIGFQDAGGERGDEFQYSDLIAKHYGTRHHQLRIQEREIIEQLPAAFRAMSEPMVSHDCIAFYLLSREVSKHCKVVQSGQGADELFAGYHWYPQVDGASDPVAAYRDAFVDRSYAEYAETVQPKWRTANDAAGDFVRDHFAQPGASAAVDKALRLDSTVMLVDDPVKRVDNMTMAWGLEARTPFLDYRLVELSARIPGKFKLPDGGKQVLKEAARMVIPSEVIDRKKGYFPVPGLKHLQGDTLNWVRELLTDSSQDRGLFNPAMVDKLLTNPEGQLTPLRGSKLWQLAALNLWLSEQGL

SEQ ID NO: 21433 - protein, 477 aa, Oryza sativa
MEARRISASPRPCSGRRVVARKRPEARGGGEQRAEAAAAGDQLLPRPGLLHERRAGALPQHTAPGFRFRMEEFDTHDPKENSLLLPYLRKRSKIIEIVAARDIVFALSQSGVCAAFSRETNRRICFLNGSPDEVIRSLFYNKNNESLITVSVYGSENFSALRCRTTRIEYIRRAKPDAGFPLFESESLKWPGFVEFDDVNGKVLTYSAQDSTYKVFDLKNYTLLYSISDKNVQEIKISPGIMLLIYTRTSSSVPLKILSIEDGTVLKSFNHLLHRNKKVDFIEQFNEKLLVKQEGENLQILDVRNFQLTEVSRTEFMTPSAFIFLYELQLFLTFRNRSVAVWNFRGELVTSFEDHLLWHPDCNTNNIYITSDQDLIISYCKADSNDSSSEENAGSINISNILTGKCLAKIKASDLCKQKKAWKFQSTALEALEDITALYYDEERDEIYTGNRQGLVHVVPATKRCLEKAVKSHSIFR

SEQ ID NO: 21434 - protein, 230 aa, Arabidopsis thaliana
MSQCIDGFKHVCSSFFRCFDIDIYKQSGGLGDPELLARETVFSVSEIEALYELFKKISSAVIDDGLINKEEFQLALFKTNKKESLFADRYQSQVFDLFDTKHNGILGFEEFARALSVFHPNAPIEDKIDFSFQLYDLKQQGFIERQEVKQMVVATLAESGMNLSDEIIESIIDKTFEEADTKHDGRIDKEEWRTLVLRHPSLLKNMTLQYLKDITTTFPSFVFHSQVEDT

SEQ ID NO: 21435 - protein, 155 aa, Sorghum bicolor
FASKLPWKETLSFRYSDDQGDGDVVVDYFVDKLGDAYRHHGEVYGRYCSEMSRLSLELMEVLGESLGVGRRHFRRFFQGNGSIMRLNYYPPCQRPYDTLGTGPHCDPTSLTILHQDDVGGLQVFDGTGPGTGRWRSIRPHPGAFVVNIGDTFMAL

SEQ ID NO: 21436 - protein, 854 aa, Xanthomonas campestris
MSGINRRELLRGMLASGVSAALPMGAAGTLASPGATAAPAAKNTVSTAALGDAALAPRERLLFDFGWRFHLGHASDAPRDFEFGTFQRTFAKAGKDTATAAQLAFDDSAWQQVDLPHDWAVGLPFRQEPISAFMTEEDPAAAHGYKPLGTSFPENSVGWYRRTLQIPASDLGKRISLVLDGVFRECIVFCNGHIVGRHASGYCGFEVDLSEVLDYGKPNIIAIRVDATLGEGWFYEGAGIYRHVWLQKTDPLHIPQDGVFVRGSVQDGNATAQLSTEVRNDGTAPRQCVVQARIAAPDGRTVAQAASAAITVAPGQVQVVEQTLPLGQAALWSIDTPQLYSLTTSVHSDGTALDALVTPFGVRSIAFDAQRGFLLNGAPLKLHGTNNPQDHAGVGTAIPDALHAWRLRQLKSMGCNAYRSSHNPATPELLALCDRLGMLVIEETRRMSTDPEAMGELETMVRRGRNHPSVILWSLGNEEPQQVTERGARIVTRMQQRVRQLDPTRPTTFAMDKGFGDGVGQVVDVVGFNYRTSQMDGFHAQYPHIPIYGSETGSTVSVRGNYQRDDQRGHTRAYDLDHPWWASTAEAWWSYVAQRPYIAGGFIWTGFDYRGEPTPYNRWPNVASQFGVLDSCGFPKDNYWHYRAQWTSEPVLHLFPHWNWDGLLQPDDNGRIAVWCHSNLEAVELLVNGISQGLQQVPAYGHVQWRVVYAPGMIEARGYRGGKLVLSERRQTTGKPAAIRLSCDRNALRADAEDVAVVKVEIVDAQGRLVPTADNLVQFALRGPARPIGVGNGDPSSHEDDKAPRRKAFNGLCAALLQTTRSSGDIVLQATAPGLTASTLRLPAEPTRSRASVA

SEQ ID NO: 21437 - protein, 191 aa, Medicago truncatula
MSQQQLNLSSTTTNIEVEVVDNSPPMTLPSFNDYHQIDDKVLENIVYDALVFATLNGLLVGDKSVERSGRVPGVGLVHLPFSLLPPPLPETHWKQACDLSPLFNELVDRVSLDGKFLQQSLSKTKKADEFTSRLLDIHAKMLEMNKKEEIRMGLFRSDYMLDEKTKSLLQIEMNTISTSFSGVGVVMTELH

SEQ ID NO: 21438 - protein, 256 aa, Unknown
  Silicibacter sp. TM1040
MALPEFTMRQLLEAGVHFGHQTQRWNPRMSPFIYGARNGIHIMDLTQTVPMLDQALTAIRDTVAKGGRVLFVGTKRQAAAPIAEAAEKSAQYYMNHRWLGGTLTNWKTVSQSINRLKEIDERMAAGAEGLTKKERLGMERDQEKLQASLGGIRDMGGVPDLLFVIDVKKEALAIAEANKLGIPVVAVVDTNCSPDGVDYIIPGNDDAARAISLYCDLVARAALDGMSAQLGAAGVDLGALEEAPVEEAVAEEAAGA

SEQ ID NO: 21439 - protein, 197 aa, Methylococcus capsulatus
MNRRTAEVERYTLETQIRVQVDLDGTGKGKFRSGVHFLDHMLDQVARHGCMDLEVEAKGDLHIDAHHTVEDIGIALGQAFAKALGDKRGIHRYGHAYVPLDEALSRVVIDFSGRSGLFYEVEFPRDRIGDFEVDLFVEFFRGFVNHAQATLHIDNLKGLNAHHVAETIFKAFGRAVRAAVERDARTAGVLPSTKGLL

SEQ ID NO: 21440 - protein, 281 aa, Zea mays
MAQELHETSSCSATTTSSCTTSCCSSTVTDSSSSPPSPAAANAAPATRKRQALEAEAEAEAGGEEEEEEEEGCAGNKAAPAKKRPRGSEGKHPTFRGVRMRAWGKWVSEIREPRKKSRIWLGTFPTAEMAARAHDVAALAIKGRAAHLNFPDLAGALPRAASAAPKDVQAAAALAAAFTSPSSEPGAGAHEEPAAKDGAAPEEAAADAQAPVPVALPPPAASRPGTPSSGVEDERQLFDLPDLLLDIRDGFGRFPPMWAPLTDVEEVVNAELRLEEPLLWE

SEQ ID NO: 21441 - protein, 162 aa, Zea mays
  misc_feature (20)..(20): Xaa can be any naturally occurring amino acid
  misc_feature (106)..(106): Xaa can be any naturally occurring amino acid
  misc_feature (120)..(120): Xaa can be any naturally occurring amino acid
MGREALARCYRQIKNKPYPXSRYCLGVPDPKIRIYDVGMKRKGADDSPYCVHLDSWEKENVSSEALEAVRIACNKYMTMSVGKDAFHLMVRVHPFHVLRINKMLLXAWADRLHTEMRGAXFGKHQGTCAMVDNGHGLLSVRCEDNNAAHASEALRRAKVKFP

SEQ ID NO: 21442 - protein, 386 aa, Oryza sativa
MATAVASQVAVSAPAGSDRGLRSSGIQVRGLVPLMGSNNISFSNKSWVGTTLAWESKATRPRHANKVLCMSVQQASESKVAVKPLDLESANEPPLNTYKPKEPYTATIVSVERIVGPKAPGETCHIVIDHGGNVPYWEGQSYGIIPPGENPKKPGAPHNVRLYSIASTRYGDSFDGRTTSLCVRRAVYYDPETGKEDPSKNGVCSNFLCNSKPGDKVKVTGPSGKIMLLPEEDPNATHIMIATGTGVAPFRGYLRRMFMEDVPKYRFGGLAWLFLGVANTDSLLYDEEFTSYLKQYPDNFRYDKALSWEQKNKNAGKMYVQDKIEEYSDEIFKLLDGGAHIYFCGLKGMMPGIQDTLKKVAEQRGESWEQKLSQLKKNKQWHVEVY

SEQ ID NO: 21443 - protein, 137 aa, Geobacillus kaustophilus
MGEQWQTLYEAIGGEETVAKLVEAFYRRVAAHPDLRPIFPDDLTETARKQKQFLTQYLGGPPLYTAEHGHPMLRARHLRFEITPKRAEAWLACMRAAMDEIGLSGPAREQFYHRLVLTAHHMVNTPDHLDRKEHTLE

SEQ ID NO: 21444 - protein, 287 aa, Streptomyces peucetius
MTASTPHHGTPRGGLSGRTVLVTGATSGIGRAAALAVARQGARVVLVGRDPERLRTVTNEVARTAGPAPDAFRADFAELRQVRDLGERLRDRYPRIDVMASNAGGMFWSRTTTQDGFEATIQVNHLAGFLLARLLRERLAGGRLILTSSDAYTQGRIDPDDLNGDRHRYSAGQAYGTSKQANIMTAAEAARRWPDVLAVSYHPGEVRTRIGRGTVASSYFRFNPFLRSAAKGADTLVWLASAPAEELTTGGYYSDRRLSPVSGPTADAGLAAKLWEAGAAAVGDTAH

SEQ ID NO: 21445 - protein, 207 aa, Magnaporthe grisea
MTVMAGGALASRHLPASPRPAGRRAAPSSRRPHSTFVTWRESQLTPAAAEKGEETPLADYKGKVVLVVNTASKCGFTPQYAGLEALYKKITEKHPEDFTILGFPCNQFGGQEPGTDDDIQNFCQVNYGVTFPIMKKVDVNGDNADPLFKWLKEEMPGIMGLKRVKWNFEKFLIGRDGKVKGRWASTTKPESLEKDILKEIEAPKPSI

SEQ ID NO: 21446 - protein, 446 aa, Pseudomonas putida
MIESVDNFLARLQQRDPGQPEFHQAVEEVLRTLWPFLEANPHYLQSGILERMVEPERAVLFRVSWVDDQGKVQVNRGYRIQMSSAIGPYKGGLRFHPSVNLSVLKFLAFEQVFKNSLTSLPMGGGKGGSDFDPKGKSDAEVMRFCQAFMSELYRHIGADCDVPAGDIGVGAREIGFMFGQYKRLANQFTSVLTGKGMTYGGSLIRPEATGYGCVYFAEEMLKRQDKRIDGRRVAVSGSGNVAQYAARKVMDLGGKVISLSDSEGTLYAEAGLTDAQWDALMELKNVKRGRISELAGQFGLEFRKGQTPWSLPCDIALPCATQNELGAEDARTLLRNGCICVAEGANMPTTLEAVDIFLDAGILYAPGKASNAGGVAVSGLEMSQNAMRLLWTAGEVDSKLHNIMQSIHHACVHYGEEADGRINYVKGANIAGFVKVADAMLAQGVV

SEQ ID NO: 21447 - protein, 351 aa, Aspergillus oryzae
MPDTIPLPPPFSTIPRTPLTLGPSPIHPLPRITADLNQTATIYAKRDDLNSGLAYGGNKTRKLEYLAADALAQNATTLVSIGGVQSNHTRQVAAVAARLGLKARLVQEHWVDWEDPGYDVVGNIQLSRLMGADVRMEDAGFGIEHKETLKKLREECEGNGERPYYIPAGASDHPLGGLGFARWAFEVREQEREMGVVFDDVVVCAVTGSTMAGMVAGFKLIEKLYPGEKKKRVIGIDGSAKPVETKAQVLRIARNTAVQIGLKEEDITEKDMILNEDYHAGTYGIPDKATWEAIEYAARMEAFITDPVYEGKSFAGMVDLIKKGEITGNVLYAHLGGQLALNAYSRLGETK

SEQ ID NO: 21448 - protein, 564 aa, Lachancea kluyveri
MSEITLGLYLFERLNQVDVKTIFGLPGDFNLSLLDKIYEVPGMRWAGNANELNAAYAADGYARVKGMSCVITTFGVGELSALNGIAGSYAEHVGVLHVVGVPSVSSQAKQLLLHHTFPNGDFTVFHRMSANISETTAWVTDIATAPAEIDRCIRTTYVTQRPVYLGLPATLVDLMVPASLLDTPIDMSLKPNDPEAEAEVVNSVLELIKEAKNPIILADACASRHDVKPETKQLIDITQFPAFVTPLGKGSIDEQHPRFGGVYVGTFANDDVKEAVESADLILSVGALLSDFNTGSFSYSYKTKNIVEFHSDYIKIRNATFPGVQMKFALQKLLSEIGAVVKDYKPVAVPPKPTPNPACDPSTPLKQEWVWNQVGRFLQEGDVVITETGTSAFGINQTHFPNNTYGISQVLWGSIGFTTGACLGARCAAEELDKNKRVILFIGDGSLQLTVQEISTMIRWGLRPYLFVLNNDGYTIERLIHGENAQYNEIQPWKNLDLLPTFGAKDYETHRVATTGEWDKLAQDEAFNKNSRIRMVEVMLPVMDAPSNLVKQAQLTASINAKQD

SEQ ID NO: 21449 - protein, 203 aa, Mycobacterium avium
MGVAQISSAITPAQPAELYPGDIKSVLLTAEQIQARIAELGREIGDNYRDAATETGQDLLLITVLKGAVIFVTDLARAIPLPTQFEFMAVSSYGSSTSSSGVVRILKDLDRDIQGRDVLIVEDVVDSGLTLSWLLRNLSTRHPRSLRVCTLLRKPDARGAHVDIAYVGFDIPNDFVVGYGLDYDERYRDLSYIGTLDPRVYQQ

SEQ ID NO: 21450 - protein, 628 aa, Ustilago maydis
MPASAARGAVSRLSSLCTPSSSTAVSAIAPRRSITSAATSTSTIPASARSLVSWSRASNNAPHSCSSCGSQLSSFSTSKRSFSSSVVRSASTKDPYSVLGVKKDADAKDIKRAYYGLAKKYHPDTNKDKGSKERFVEIQNAYDLLSDDKKRAAYDQYGTTDGQPGFDPFGGGGSSPFGAGGFGGFQDFGGFSNAGNAGSIFESLFGAFGGGGRPGAQRGPGFGGAGFAGEARGEDLETTINLTFEEACKGTKRKVVINPIEPCGTCTGSGLKPGAKKSTCATCNGTGTRTFVIQSGFQMATTCPSCGGAGSTVAPGDNCNTCDGIGRVRGRKEVQIDLPAGVDDGFRIRKDGFGDVPLSGTGTPGSLYVRINVAPSRIWRRQGSTLFYPATIPFHTAILGGKVRVPTLDGPVEVRVPAGTQVGEEMILPGRGVPSPTRRGQKGDLMVQFEVSMPRSLTKRQREILQQYADEVEGRSPATSSPPPPPASDDSPSSSKPSKASSGTSSTSTKDNSQSRPSTSSSAASSSSAKTSSAPSDNAQAASTKASTKKTSAGRFSIHPSSRSDDTSNLDGISGATTNSSARRATPDPARPASSHPQASTPSAAESSTQEHQKGFLGRAWDWMTSRK

SEQ ID NO: 21451 - protein, 197 aa, Novosphingobium aromaticivorans
MRTGSITRKTEETDIAVSVNLDGTGTYKVDTGIGFLDHMIEQFSRHSLIDIECRVKGDLHVDQHHTTEDSAIALGQAISQALGDKKGITRYGHTYSPMDEALCRVALDISGRPVLVWKAAFTQPRLGEMDTELFEHWFQSISQAAGITLHIESLYGSNNHHIIEGIYKGFARAMRAAIAIDPRKADAVPSTKGILGG

SEQ ID NO: 21452 - protein, 350 aa, Arabidopsis thaliana
MVRIIPMAASSIRPSLACFSDSPRFPISLLSRNLSRTLHVPQSQLFGLTSHKLLRRSVNCLGVAESGKAAQATTQDDLLTWVKNDKRRMLHVVYRVGDMDRTIKFYTECLGMKLLRKRDIPEEKYTNAFLGYGPEDSHFVIELTYNYGVDKYDIGAGFGHFGIAVDDVAKTVELVKAKGGKVSREPGPVKGGKTVIAFIEDPDGYKFELLERGPTPEPLCQVMLRVGDLDRAIKFYEKAFGMELLRTRDNPEYKYTIAMMGYGPEDKFPVLELTYNYGVTEYDKGNAYAQIAIGTDDVYKTAEAIKLFGGKITREPGPLPGISTKITACLDPDGWKSVFVDNIDFLKELE

SEQ ID NO: 21453 - protein, 472 aa, Glycine max
SARGPGSHIVVLAFVLLISSKLAECHNIVRFLPGFQGPLPFLLETGYVEVGETEAEEHAELFYYFIESENDPKGNPLLLWLTGGPGCSAFSGLVFEIGPLTFKNEEYNGSLPNLTLKPQSWTKVSSIIFVDLPAGTGFSYPKTERAVHQSSSKLVRHAHQFIRKWLIDHPEFLSNEVYIAGDSYCGIPVPVIVQEISNGNEGGMQPWIYIQGYLLGNPITTSTEKNYEIPFNHGMALISDELYESLQKNCRGEYRNIDPRNALCLRDMQSYEESISGIETGHVLAPLCDESDLRNDMEVTWRRSSLAHKTSAFFSPRLTLPPLYCRSHAYVLCSYWANDDNVRKALHVRKGSIGKWTRCNDDLKSKFNADIPSSFQYHVNLSRKGYRSLIYSGDHDMVVPFLATQAWIRSLNYSIVSDWRQWYYDGQVAGYTRTYSNRMTFATVKGGGHTAPEYKPEECLAMFSRWISNMPL

SEQ ID NO: 21454 - protein, 718 aa, Nostoc punctiforme
MAEVDKSISFDGRDIRLKVGLLAPQAGGSVLIESGDTSVLVTATRSQAREGIDFLPLTVDYEERLYAAGRIPGGIMRREGRPPEKTILTSRLIDRPMRPLFPSWLRDDLQIIALTLSMDELVPPDVLAVTGASIATLIAQIPFNGPMAAVRVGLVGDDFIINPTYAEIEAGDLDLVVAGSPHGVIMVEAGANQLPERDIIEAIDFGYEAVRDLIKAQQDLVAELGLVIVQEAPPEVDQTLENYIRDRASGQIKKILSQFTFTKPERDAALDVVKDEIATTIKELPEEDPIRVAATANNKALGNTFKDITKYFMRRQIIEDNVRVDGRKLDEVRRVSCLVGVLPKRVHGSGLFNRELTQVLSTCTLGTPGDAQNLNDDMQLDQHKRYLHHYNFPPFSVGETKPMRSPGRREIGHGALAERSLIPVLPSKEQFPYVIRIVSEVLSSNGSTSMGSVCGSTLALMDAGVPILKPVSGAAMGLIKDGDEVRILTDIQGIEDFLGDMDFKVAGTDTGITALQMDMKIPGLSLDVISQAVHQAKAARLHILEKMLACIDTPRIETSPYAPRLLTIKIDSDMIGLVIGPGGKTIKGITEETGAKIDIEDDGTVTISAVDENKAKRARNIIQGMTRKLHEGDVYAGRITRIIPIGAFVEFLPGKEGMIHISQLADYRVGKVEDEVAVGDEVIIKVREIDNKGRINLTRLGIHPDQAAAAREAAAVNR

SEQ ID NO: 21455 - protein, 923 aa, Magnaporthe grisea
MASHRPSPPMPVHMHHGPGAPLPPGAMPPGPQYSSAARRMAEATEVTWIQIGSCSEILGNLEDAMQAYERAITINPQSIPAMNAMSAILRTKEEFPKACEYLNAIIKLDPTNGEAWSAMGHCYLMMDELQQAYSAYQNALVNLQTPKDPKLWYGIGILYDRYGSLEHAEEAFSSVMQMQPDFEKANEIYFRLGIIYKQQSKFNQSLECFKYIVHSPPHPLTETDIWFQIGHVHEQQKDLDNAKAAYQRVLDGDPKHAKVLQQLGWLHHQQSSSFQSQERAIEYLEQSVAADNSDAQSWYLLGRCYMSQQKYPKAYEAYQQAVYRDGRNPTFWCSIGVLYYQINQYRDALDAYSRAIRLNPYLSEVWYDLGTLYESCNNQINDALDAYQRAAELDPSNPHIKARLNLLRTGQSNGSGPPSAPVPTDIHPQSYQASGPPGPQWNGAQGPQPPQQPNGPPPLTGPDNWPRLSAVNPPPQPPNPYEQQREPFRGPPPPPPRQPSPRQEQGPPPMRHYGQEGARPGPPPGPGPEPPRRGPSPISQGHYPPPPPPGQQPPPPQSLQQAQQQAQQQQHHHQAQQQQAQQAQQQPQQPRQSIPMDMVRNSRARQFPDEAMDAPPPPNAMLGYRRPNSPRSEQQRPTHDNRMPSPKSAYPQHQQPYPPHPNDTPGPSNVDGPSRPPPPPPPGASNPEPPMHREHDRPPSVGPKRMREWEDEPTSAKKPASDENRARLEDMRHRRQSTPPREREQYRRNSSEARRFEDQRRMDDQRRVDDHRRDDMRRAEEQRHANDNYHPSEAAHHPPAHAMQQSHLPPMQQGPVPPMQNMMREGPGPSPAGSAPKEFNQEERHHERQPQHPAAPHPPAAGEPERAARKMDVDEDYDDSGEDEKKNGIATSAASGPGSSSGESKPATNGAMNGLMGPKVESS

SEQ ID NO: 21456 - protein, 519 aa, Oryza sativa
MVSALAGLQDHLKLARDYALEGLYDTSIIFFDGAIAQINKHLTTLDDALIRTKWLNCKKAICDEVEIVKQLDAQLKAFKEAPGARRSSSPPIRSNNKSFVFQPLDEYPTSSPAPFDDPDVWAPPRDTPNRRPTRGQSSTRKSSQDGAWARGPSKTGTPSRGAKPNGSKGNSGARSSTASSTGGRKGKSSSSKADPVSSDAEEGKSKKGQYEGPDMDLAAMLERDVLDSTPGVRWDDVAGLSEAKRLLEEAVVLPLWMPEYFQGIRRPWKGVLMFGPPGTGKTLLAKAVATECGTTFFNVSSATLASKWRGESERMVRCLFDLARFYAPSTIFIDEIDSLCTSRGASGEHESSRRVKSELLVQIDGVNNSSTTEDGQPKIVMVLAATNFPWDIDEALRRRLEKRIYIPLPNFESRKALININLKTVEVATDVDIDEVARRTEGYSGDDLTNVCRDASMNGMRRKIAGKTRDEIKNMSKDEISKDPVAMCDFEEALAKVQKSVSPADIEKHEKWQAEFGSA

SEQ ID NO: 21457 - protein, 618 aa, Glycine max
AVVAVPDGLKAWELLKGRPHNVDLILTEVDLPSISGYALLTLIMEHEICKNIPVIMMSSQDSISTVYKCMLRGAADYLVKPIRKNELRNLWQHVWRRQSSTTGINGLQDESVAQQKVEATAENNAASNRSSGDAACIQRNIELIEKGSDAQSSCTKPDCEAESDPVGNMQEFSLLKCGEAYPSGTETQQVETSFRLGQTLMMHDCHAGGLNVSIRKNGEASTTNDKDTDTEHFGNASISGEAHDNPYVQINSSKEAMDLIGAFHTHPNCSLKNSTVNCTGNFDHSPQLDLSLRRSCPGSFENKLTEERHTLMHSNASAFKRYTTRQLQISMPAVLINFSDQQREQITNCEKNISHIATGSNSDSSTPMQRCIVSPTTVQSKESELATSHPPQGHSLPIPVKGVRFNDLCTAYGSVLPSVFHTQSGPPAMPSPNSVVLLEPNFQVNAFYQSNMKESSSEQLYESRGPNGNTTQNHIVYTQEHKSEHAEDRGHISPTTDQSVSSSFCNGNASHLNSIGYGSNCGSSSNVDQVNTVWAASEGKHEDLTNNANSHRSIQREAALNKFRLKRKERCYEKKVRYESRKKLAEQRPRVKGQFVRQVHPDPLVAEKDGKEYDHSDF

SEQ ID NO: 21458 - protein, 497 aa, Staphylococcus aureus
MSKVQNESNNVVKRGLKDRHISMIAIGGCIGTGLFVTSGGAIHDAGALGALIGYAIIGIMVFFLMTSLGEMATYLPVSGSFSTYATRFVDPSLGFALGWNYWFNWVVTVAADITIAAQVIQYWTPLQGIPAWAWSALFLVIIFSLNSLSVRVYGESEYWLALIKVITVIVFIAIGLLTIVGIMGGHVVGFEIFNKGEGPILGGNLGGSLLSILGVFLIAGFSFQGTELIGITAGESENPERAVPKAIKQVFWRILLFYILAIFVIGMLIPYDSSALMGGSDNVATSPFTLVFKNAGFAFAASFMNAVILTSVLSAGNSGMYASTRMLYSMSKDKLAFEAFGKTNKNGVPYMSLLVTAIIVVIIFVLQSLTKGAYEYIVAASGLTGFIAWVGIAVSHYRFRRAFDKQNYDKSKLKYTAKLFPFGPLFAGFLCIVVIIGQDVDFIKTGDFNFSRFLITYMGIPVFLAFFIYHKLRYKTKKIPLEQVDLRQDVSMDEIKG

SEQ ID NO: 21459 - protein, 155 aa, Escherichia coli; identical to SEQ ID NO: 409

SEQ ID NO: 21460 - protein, 303 aa, Solanum tuberosum
VILYPQAIFKDPFRGGNNILVICDTYTPAGEPIPTNKRHKAAQIFSDPKVASQVPWFGIEQEYTLLQPNVNWPLGWPVGGYPGPLGSYYCGAGVEKSFGRDISDAHYKACLYAGINISGTNGEVMPGQWEFQVGPSVGIEGGDHIWCARYLLERITEQAGVVLSLDPKPIEGDWNGAGCHTNYSTLSIREEGGFEVIKKAILNLSLRHKGHISAYGEGNERRLTGKHETASIDQFSWGVANRGCSIRVGRYTEKEARGYLEDRRPASNMDPYVVTALLAETTILWEPTLEAEALAAQKISLKV

SEQ ID NO: 21461 - protein, 894 aa, Oryza sativa
MPPWWGKSSSKEVKKTAKENLIDTFHRLLSPNEQKGRTKSRGNRRHSKDPTAEKGCWSTAQSRSASPSKEVSRCQSFAAARAHAQPLPLPRSRAMVARTASDITESKVVLEKRGKGQQLPLPTTNWVKERPETTEPVAELSTASISSHGSIDSDDPGDLRLQGPVANDTDNVAKVATTGNSSVVHKECSSAITRKGTKEVTMPTNAFLSNQILSTSPRGTVVADSYQSNLQNSRKVVLDSAPNSVMSSPSRSPRILCPDQIPSSAFWAVKPHTDVTFVGSAQCSSPGSGQTSGHNSVGGDMLAQLFWQPSRGSPECSPIPSPRMTSPGPSSRVHSGSVSPLHPRAGGMAPESPTRRLDEGKRKQTHRLPLPPLSICNNSTFLPNNSTPTSPISHSPGRVENPTSPGSRWKKGKLVGRGTFGHVYIGFNSDKGEMCAMKEVTLFSDDPKSKESAKQLCQEILLLNRLQHPNIVRYYGSEMVDDKLYIYLEYVSGGSIHKLLQEYGQFGEPAIRSYTKQILLGLAYLHAKNTVHRDIKGANILVDPNGRVKLADFGMAKHINGQQCAFSFKGSPYWMAPEVIKNSNGCNLAVDIWSLGCTVLEMATSKPPWSQYEGIAAVFKIGNSKELPPIPDHLSEEGRDFIRQCLQRNPSSRPTAVDLLQHSFIRNASPLEKSLSDPLLQLSTTSCKPDLKVVGHARNMSSLGLEGQSIYQRRAAKFSSVHSDIHVRSYISCPVSPCGSPHLRSRSPQHQNGIMSPSPISSPRTTSGASTPLTGGNGAIPFNHARHLAYNNEGFTITSRCLDEPLPNQPPDPVLGRFVRVKQPSLGFQERAVPEADILSPQFGRMGHVSVWNLHDKPLPSEHASQKGFEDRVKLKPPLDLRSGPPHLGCNHGH

SEQ ID NO: 21462 - protein, 625 aa, Cornus unalaschkensis
MASSGEQNQVGLLENLKNRLAIAVRSIQWSYAIFWSISSRQPGVLEWGDGYYNGDIKTRKTVQAVEFNADQLGLQRSEQLKELYESLAVTESNPQARKSSAALSPEDLTDTEWYYLVCMSFVFNIGQGLPGRTFANGQPIWLCNAHYADSKIFSRSLLAKSASIQTVVCFPFLGGVVELGVTELVLEDPNFIQHIKTSFLENPYRTVPKIPSYYASENTRTEKDLILAKPSHNLLDAALDAALECGEIDMCAPNNNSSGFLPNQRTEKSVMVEGLSGGASQVQSWQFMDDEISNCVQNSTNSSESISRTSENPEKDCCLTDLPECNLTKLTSLDLPNDDIHHHSVVSSLLKNSHQLILGPYFHKCNRGSSFMGWKKTPSDIQQRRRGTPQELLKKVLFEVARMHGGCLVESRQDNSRKDGLWRPEDDEIGTTDLFLERRRRDKTKERYSVLGSLIPSTSKDDKVSILDGTIEYLKELERRLEDSECLEARTRSKPQDTAERTSDNYENDRIGIGKKPMINKRKACDIVEAELEINLVQLKDSSTDDVSVRIIDKDVFIEIRCPWRERLLLEIMDAISNFHLDSHSVQSSNIDGILSLSIKSKFKGSTVASTGMIIQALQRIICKC

SEQ ID NO: 21463 - protein, 317 aa, Solanum tuberosum
SGPVDDPSKLPKWNYDGSSTGQAPGEDSEVILYPQAIFKDPFRRGNNILVICDCYTPAGEPIPTNKMCHNAAKIFSNPDVVVEEPWYGLEAEYTLLQRRNYWPLGWPIGGFPGLQGPYYCGIGSGKAFGRDIVDAHYKAYIYAGINISGINGEVMPGQWEFQVGLQVGIASGDEVWAARYILERITEIAGVVVSFDPKPIPGDWNGAGAHTNYSTKSMRNEGGYEVIKKAIEKLGLRHKEHIAAYGEGNERRLTGKHETADINTFKWGVANRGASIRVGRDTEKEGKGYFEDRRPASNMDPYIVTSMYAETTLLWNP

SEQ ID NO: 21464 - protein, 624 aa, Cornus suecica
MASSGEQNQVGLLENLKNQLAIAVRSIQWSYAIFWSISSRQPGVLEWGDGYYNGDIKTRKTVQAVEFNADQLGLQRSEQLKELYESLVVTESNPQARKPSAALSPEDLTDTEWYYLVCMSFVFNIGQGLPGRTFANGQPIWLCNAHYADSKIFSRSLLAKSASIQTVVCFPFLGGVVELGVTELVLEDPNFIQHIKTSFLENPYRTVPKIPSYASENTRTEKDLILVKPSHNLLDTDLDAALECGEIDMCAPNNNSSGFLPNQRTEKSVMVKGLSGGASQVQSWQFMDDEISNCVQNSTNSSESISRTSENPEKDCCLTDLPECNLTKLTSLDLPNDDIHYHSVVSPLLKNSHQLILGPYFHKCNKESSFMGWKKTPSGSQQRRRGTPQKLLKKVLFEVARMHGGCFVESRPDYSQKDGLWRSEDDEIGTTDLFLERRRRDKTKERYSVLGSLIPSTSKDDKISILDGTIEDLKEPERRLEGSECLAARTRSKPQGTAERTSDNYENDRIGIGKKPLINKRKACDIVEAELEINLVQLKDSSTDDVSIRIIDKDVFIEIRCPWRERLLLEIMDAISNFHLDSHSVQSSNIDGILSLSIKSKFKGSTVASTGMIIQALQRIICKC

SEQ ID NO: 21465 - protein, 624 aa, Cornus suecica
MASSGEQNQVGLLENLKNQLAIAVRSIQWSYAIFWSISSRQPGVLEWGDGYYNGDIKTRKTVQAVEFNADQLGLQRSEQLKELYESLVVTESNPQARKSSAALSPEDLTDTEWYYLVCMSFVFNIGQGLPGRTFANGQPIWLCNAHYADSKIFSRSWLAKSASIQTVVCFPFLGGVVELGVTELVLEDPNFIQHIKTSFLENPYRTVPKIPSYASENTRTEKDLILVKPSHNLLDTDLDAALECGEIDMCAPNNNSSGFLPNQRTEKSVMVEGLSGGASQVQSWQFMDDEISNCVQNSTNSSESISRTSENPEKDCCLTDLPECNLTKLTSLDLPNYDFHYHSVVSPLLKNSHQLILGPYFHKCNKESSFMGWKKTPSGSQQRRRGTPQKLLKKVLFEVARMHGGCLVESRQDNSKKDGLWGSEDDEIGTTDLFLERRRRDKTKERYSVLGSLIPSTSKDDKISILDGTIEDLKEPERRLEGSECLAARTRSKPQGTAERTSANYENDRIGIGKKPLINKRKACDIVEAELEINLVQLKDSSTDDVSIRIIDKDVFIEIRCPWRERLLLEIMDAISNFHLDSHSVQSSNIDGILSLSIKSKFKGSTVASTGMIIQALQRIICKC

SEQ ID NO: 21466 - protein, 112 aa, Vibrio parahaemolyticus
MKIINAIIKPFKLDDVREALADVGIEGMTVSEVKGFGRQKGHTELYRGAEYQVDFLPKVKIEIATHADNVDRVVEAITKAAQTGKIGDGKIFVYDLNQAVRIRTGEMDAEAL

SEQ ID NO: 21467 - protein, 366 aa, Brassica juncea
MALSAIGFEGYEKRLEVSFFEPSIFQDSKGLGLRALTRSQLDEILTPAACEIVSSLSNDHLDSYVLSESSFFVYPYKVIIKTCGTTKLLLSIPPLLKLAGELSLSVKSVKYTRGSFLCPGGQPFPHRSFSEEVSVLDGHFSKLGLNSVAYLMGNDDETRKWHVYAASAQAPSNCNNNVYTLEMCMTGLDREKASVFYKNETGENGSMTDNSGIRKILPKSQICDFEFEPCGYSMNSIEGDAISTIHVTPEDGFSYASFEAVGYDFNTLDLSQLVTRVLSCFEPKQFSVAVHSSVGANAYKPEISVDLEDYGCRERTFESLGEESGTVMYQTFEKLGKYCGSPRSTLKCEWSSNNSCSSEDEKDEGI

SEQ ID NO: 21468 - protein, 108 aa, Oryza sativa
  misc_feature (31)..(31): Xaa can be any naturally occurring amino acid
  misc_feature (60)..(60): Xaa can be any naturally occurring amino acid
FPPVFKGPVNMVGPPGPPYPKGVFGFKSCAXPRGPPVVFRPPIFSLLGKEFSPKLKGPLXFYNFEIPPAPFCFPSFPKKVFGSQGPLDQRSLSPRPPGLESLPQKIWL

SEQ ID NO: 21469 - protein, 72 aa, Xanthomonas axonopodis
MSKDDSIEFEGSVSETLPNTTFRVKLENGHEIIAHISGRMRKNYIRILTGDRVKVEMTPYDLTKGRITYRMK

SEQ ID NO: 21470 - protein, 645 aa, Cryptococcus neoformans
MDIDKMFKLPALPSGGNKRKMGDLPNPETLKKYKPSEPQAASEMMPPPPPGGLNGKGKGRAVTVEDDDVEAEYSRDVGEDVYDGEDDEEGRFFGGGLNREQEQILDIFDAAGEGEQGPALDLPALRRQIGKFQRIVLKNAEQRGKYSDDPSKFIDSESDLDTSLKAFLPLTQNPPLFYPELVKSGIIPIFANLLSHENTDIAMDVVEVIQELTDEDVGGEVDDLDHEEETGSETRMAMGQLIDELLNNSLLDLLVSNLSRLDESEDTDSQGVFHILGVFENLLSFMPPLADQIVEETALLQWLLQRIKKKEYDSNKQYASEIIAILLQDSRANVLKLGQLDGMDVMLQVLSQYLKTDPGDSEEVEFMENVFDSVCSSLAQPEMKKAFFDAEGVELMVLMMKEKRLAKTRAIKVLDYALQTESGSPACERFVQALGLKTFFSAFMSSASSKAGGKKSKSKLGAAAATSAIEDEEHMLGILASLFTNLASDSPERIRVIAKFVEGGYEKVERLLEVREAAEGRLGSVIKEIEYEREVMQANEEEITDVEETEWYLRKMDAGLASLQNADYVLAWVCMEDDGAMTHARLLLSRKNMNFKTIAAVLTEFKNNVGDNDEPNEEDGQREADDAVNTQKMILEHLIAFLEGL

SEQ ID NO: 21471 - protein, 286 aa, Triticum aestivum
MPTPHAKIPFPSSHPLTSTPAANSSNPRRPTPTLPGACASDASAPASATGGAVMVGFFRSGNLASRVFDRQFLSPRPGATVNTVRQFYENLVPSYTIYDIDCPDYSFRKFTDDGKYLVAFSRNHQDLIVYRPIWLTFSCHEECDSHDLPANAERFDSFFKQLYSISLASSNEYICEDFFLYMECHQYGLFATSTAQSNDSSATDGAIHGVPSIEKITFYLVRLEDGAILDEKAFCNDFINLAHSIGAYLYEDLVCIVSLRYQTIHVLQIRDSGSLVEVRRIGAFCR

SEQ ID NO: 21472 - protein, 125 aa, Methanosarcina barkeri
MKEIIAIIRPKKVVPTKEALEKLGVPSLTAIPVFGRGKQKGIATELDIEIRPEILDQSIKAGRRMEYIPKRLFSIVTRNEDVDTIIETIMKVNQTGDIGDGRIFICPVDDAIRVRTDEHGDNALL

SEQ ID NO: 21473 - protein, 257 aa, Glycine max
MATYWSHALKTIPSSFVKPVTVSAKTTSLYLTPSITKPFLPFTSSNHSLTENLKLNSTLPHFCLSSVPKKSFTCRSQAEPVDSEKVQELTVYEINERDRGSPVYLRLSYKSVNSLGDLVPFSNKLYTGDLQKRIEITSGICILIQNKAEKKGDRYEAIFSFYFGDYGHIAVQGPYLTYEDSYLAVTGGSGIFEGVKGQVKLHQIVYPFKILYTFYLKGIKDLPQELLVKTVEPIPSVEPSPAAKALEPNATIAGFTD

SEQ ID NO: 21474 - protein, 322 aa, Xanthomonas axonopodis
MSASSASPAKHSRLLILGSGPAGWTAAVYAARANLKPVVITGLQQGGQLMTTTEVDNWPGDPHGLMGPDLMSRMQAHAERFETEVIFDHIHTADLSQRPFRLIGDGAEYTCDALIIATGATAKYLGIPTEEAFKGRGVSACATCDGFFYKDQDVVVVGGGNTAVEEALYLSNIARKVYLVHRRDTLRAEKIMQDKLFAKVAAGKIETVWHHAIDEVLGNDAGVTGVRVKSTIDGSTRDIDAHGFFVAIGHHPNTQLFDGQLAMNNGYLEIRSGLNGAATETSVAGVFAAGDVADQHYRQAITSAGFGCMAALDAERFLDKSA

SEQ ID NO: 21475 - protein, 329 aa, Zea mays
  misc_feature (115)..(115): Xaa can be any naturally occurring amino acid
  misc_feature (134)..(136): Xaa can be any naturally occurring amino acid
  misc_feature (139)..(140): Xaa can be any naturally occurring amino acid
  misc_feature (149)..(149): Xaa can be any naturally occurring amino acid
  misc_feature (153)..(153): Xaa can be any naturally occurring amino acid
  misc_feature (155)..(155): Xaa can be any naturally occurring amino acid
  misc_feature (160)..(160): Xaa can be any naturally occurring amino acid
  misc_feature (179)..(180): Xaa can be any naturally occurring amino acid
  misc_feature (204)..(205): Xaa can be any naturally occurring amino acid
  misc_feature (254)..(254): Xaa can be any naturally occurring amino acid
  misc_feature (304)..(304): Xaa can be any naturally occurring amino acid
LNISLTGEVRTYVRAAVVESIGVSYGMSGDNLPPASTVIGMYKDNGIPLMRIYAPDQAALQAVGGTGIRVVVGAPNDVLSSLAASPAAVASWVRNNIQAYPKVSFRCVCVGNEVXGGAAQSLVPAMENVRAALXXXGLXXIKVTTSVLXAISXRXKPPSXAEFTDEAQGFMGPVLRFLXXTGAPLMASVYPYFTYATNPAAMDXXYALFTAPGTVLQDGAYEYQNLFDATVDSFYVAMANHGGSGVTLVVSESXWPSAGGVAASPENAAIYNQNLINHVGRGTPRHPGAIETILFSMFNENLKXSGVEQNWGLFYPNMQRVYPHQVQLK

SEQ ID NO: 21476 - protein, 301 aa, Arabidopsis thaliana
MADRVKGPWSQEEDEQLRRMVEKYGPRNWSAISKSIPGRSGKSCRLRWCNQLSPEVEHRPFSPEEDETIVTARAQFGNKWATIARLLNGRTDNAVKNHWNSTLKRKCSGGVAVTTVTETEEDQDRPKKRRSVSFDSAFAPVDTGLYMSPESPNGIDVSDSSTIPSPSSPVAQLFKPMPISGGFTVVPQPLPVEMSSSSEDPPTSLSLSLPGAENTSSSHNNNNNALMFPRFESQMKINVEERGEGRRGEFMTVVQEMIKAEVRSYMAEMQKTSGGFVVGGLYESGGNGGFRDCGVITPKVE

SEQ ID NO: 21477 - protein, 417 aa, Pseudomonas putida
MFSRDLTIAKYDAELFEAMQQEALRQEEHIELIASENYTSPAVMEAQGSVLTNKYAEGYPGKRYYGGCEYVDIVEQLAIDRAKELFGADYANVQPHAGSQANAAVYLALLSAGDTILGMSLAHGGHLTHGASVSSSGKLYNAIQYGIDGNGLIDYDEVERLAVEHKPKMIVAGFSAYSQVLDFARFRAIADKVGAYLFVDMAHVAGLVAAGVYPNPVPFADVVTTTTHKTLRGPRGGLILARANADIEKKLNSAVFPGAQGGPLEHVIAAKAICFKEALQPEFKAYQQQVVKNAQAMASVFIERGFDVVSGGTQNHLFLLSLIKQEISGKDADAALGKAFITVNKNSVPNDPRSPFVTSGLRFGTPAVTTRGFKEAECKELAGWICDILADLNNEAVIDAVREKVKAICKKLPVYGN

SEQ ID NO: 21478 - protein, 887 aa, Methanothermobacter thermautotrophicus
MKGTVKFRIDGREVEAARGMTVLEAALANGIYIPNLCFREGIEPFGGCRLCLVENNEGRLVTACETPAEDGSEFISESERINRIRRTTLSLIIADHSRDCLACPASGDCRLQELSSYLNVSDGDLERLRPELSGIDVDESNPFFLRNHDKCILCGICVRVCRGLGAEAVDFAYRGHDTRIATFMDRDILDSSCVSCGECVEACPVGALLPRTERPSTEVRTVCPYCGAGCEIYLGVRGNRVVSSRGVPDSPVNQGRLCVKGRFALKFVNSPERLKKPLIKVDGEFVEVEWDEAISVVAERLSEYTGEEFAAVASAKCTNEENYLLQKFTRAVMGSGNIDHCARLCHAPSLTGLRMSLGSGAMTNSISELGAAGCILAVGTNPTETHPVTSYRVIRALRSRARLVVVDPRKTRLSELADIHLQNRPGSDIPLLMAMCRFILEEGLHDSEFIDSRTEKFEDFRDAVMALDLDEVERITGVNVKDIRRAAIMYASNSPASIIYSMGITQHVNGTGNVLALSNLALLTGNIGIKSAGINPLRGQNNVQGACDMGALPDLLPGYQGIGEAAGKFSEKWGSPIPPAGLTLPEMFDAARDGKIRCMYIMGENPLLSEPDIERTREALEGLEFLVVQDICLTETAELADVVLPAASFAEKDGTFTNTERRVQLLRKALDAPGDALPDWQIISMIAGRMGREDFDYESASRIFDEIRELVPSYAGISHERLKSGGIQWPCTSEEDAGTGYLHSEEFPTPTGRASFLLPDYQFRGVPEEYPLVLVTGRNLYQYHTRSMTARVEELESFSDHEELLMNPADASSMGIREGDTVEVTSERGSLRVRAGVTDEVMEGVVFMTFHFADAPANVLTGGDRDPFSGMPGLKFTPVRVCRVQLR

SEQ ID NO: 21479 - protein, 219 aa, Caragana korshinskii
MANEVVLLDFWPSPFGMRLRIALAEKGIKYEYKEEDLRNKSPLLLQMNPVHKKIPVLIHNGKPVCESLIAVQYIDEVWSDRSPLLPSDPYQRAQARFWADYVDKKIYEVGRNVWTKKGEEQEAAKKEFIDALKLLEEQLGDKTYFGGEKLGYVDIALIPFYTWFKAYEVFGNLNIEKECPKFITWAKRCMQIENVSRSLPDQHKVYEFIVEIRKRFGIE

SEQ ID NO: 21480 - protein, 356 aa, Brassica napus
MSLLTDLVNLNLSETTDKIIAEYIWVGGSGMDMRSKARTLPGPVSDPSELPKWNYDGSSTGQAPGEDSEVILYPQAIFKDPFRRGNNILVMCDAYTPAGEPIPTNKRHAAAKVFSHPDVVAEVPWYGIEQEYTLLQKDVNWPLGWPIGGFPGPQGPYYCSVGADKSFGRDIVDAHYKACLYAGINISGINGEVMPGQWEFQVGPAVGISAGDEIWVARFILERITEIAGVVVSFDPKPIPGDWNGAGAHCNYSTKSMREDGGYEIIKKAIDKLGLRHKEHIAAYGEGNERRLTGHHETADINTFLWGVANRGASIRVGRDTEKEGKGYFEDRRPASNMDPYIVTSMIAETTILWKP

SEQ ID NO: 21481 - protein, 294 aa, Zea mays
  misc_feature (156)..(156): Xaa can be any naturally occurring amino acid
  misc_feature (213)..(213): Xaa can be any naturally occurring amino acid
  misc_feature (234)..(234): Xaa can be any naturally occurring amino acid
  misc_feature (257)..(257): Xaa can be any naturally occurring amino acid
MASSVAAAASTFLGTRLADPAPQNGRIVARFGFGGGKPKAAVPKKVAKTSISSDRPLWFPGAVAPDYLDGSLVGDYGFDPFGLGKPVEYLQFELDSLDQNLAKNEAGGIIGTRFESSDVKSTPLQPYSEVFGLQRFRECELIHGRWAMLATLGALXVEWLTGVTWQDAGKVELVDGSSYLGQPLPFTISTLIWIEVLVIGYIEFQRNAELDPXEKRLYPGGSYFDPLALAADPXEKKERLQLAEIKHARLAMVAFLXGFAVQAAATGKGPLNNWATHLSDPLHTTIFDTFGGSS

SEQ ID NO: 21482 - protein, 126 aa, Sinorhizobium meliloti
MADRKCLALIAHDQKKDDLAAFAKANEAVLSKWKIVATGTTGGRVLDVCPALDIVRLKSGPLGGDQQIGALIATGDVDCLIFFVDPLTAMPHDVDVKALMRLAIVYDIPMALNRATAEQLIDFRRN

SEQ ID NO: 21483 - protein, 427 aa, Methylobacillus flagellatus
MQQHELSSSRFVSTLTKNTVALILAGGKGSRLRDLTNWTAKPAVPFGGKFRIIDFPLSNCINSGVRRIGVVTQYKAHTLIQHIQRGWGFLRGEFNEFVELLPAQQRIQEEWYKGTADAVFQNLDILRQTNIEFVLILAGDHVYKMDYGQMLAAHVRNKADMTVACINVPLKEASAFGVMGVDENDRVVDFEEKPAHPSSLPDDPDHALASMGIYVFNAAFLYEQLIRDADDPKSSHDFGHDIIPYLIKKYRVFAHRFTDSCVGAADGNYYWRDVGTVDAYWEANMELTKVVPELNLYDRQWPIWTYQEQLPPAKFVFDNEERRGQATDSLISGGCIVSGANVRNSVLFSDVRVNSYSSIEQSVILPKVDIGRHVTLRRVVVDSGARIPDGMEIGVNLELDRKRFHITEQGVVLVTPDMLGQNLHHIR

SEQ ID NO: 21484 - protein, 311 aa, Oryza sativa
MAASSAAFAACLLACALLFQMCVASRKLTALVQDQPITMTYHKGALLSGRIAVNLIWYGNFSAPQRAVITDFVSSLSTPPSPQPQPEPSVASWFKTAQKYYANSKARFPALSLGQHVLDQSYSLGKRLGEKDLVRLAARGSPSRAINVVLTADDVAVDGFCMSRCGTHGASPRSRAGRFAYVWVGNPATQCPGQCAWPYHQPVYGPQAAPLTPPNGDVGVDGMVISLASMIVGTVTNPFGNGFFQGDADAPLEAATACAGVYGKGAYPGYAGSLLVDPASGASYNANGAHGRKYLVPALVDPDTSACSTVG

SEQ ID NO: 21485 - protein, 389 aa, Glycine max
FPKAIGELHGHSGIARLLLFYARSLFGLVDGSHGMGVANAGLVYFNNHLLAMSEDDLPYHLRITPNGDLTTVGRYNFNGQLKSTMIAHPKLDPVTNNLHALSYDVVQKPYLKYFRFSPDGVKSPDVEIPLKEPTMMHDFAITENFVVVPDQQVVFKLSEMITGGSPVVYDKNKVSRFGILDKNAKDANDMKWIDAPECFCFHLWNAWEEPENDEIVVIGSCMTPADSIFNECEESLKSILSEIRLNLKTGKSTRKPIISESEQVNLEAGMVNRNKLGRKTKFGYLALAEPWPKVSGFAKVDLFSGEVKKYMYGEERFGGEPLFLPNGVDGDEDDGHILAFVHDEKEWKSELQIVNAKTLKLEASVKLPSRVPYGFHGTFIHSKDLRKQA

SEQ ID NO: 21486 - protein, 238 aa, Picea glauca
MEHLNTAAAQASSSLYGAGMAEYGDAGVSSMMALITQHEPHDCESIMSTRMPSSFSSFHGHADCLLSAAMFQASQGDHKLKRQPGMDQLVSEQAGMSDSSMPSVKTEVCSGLRNQFEFHREQTGNCYTDQSSNTPVNPLVTSLASQARGEAQMIPSLDGNSPHFNVDNEEYAIKSKILAHPQYPSLLGAYIDCQKIGAPPEAVARLDALTREYQNQQRRTVSIGMDPELDQFMEAYCE

SEQ ID NO: 21487 - protein, 517 aa, Lolium rigidum
MDKAYIAILSCAFLFLVHYVLGKVSHGRRGKKGAVQLPPSPPAIPFIGHLHLVEKPIHATMCRLAARLGPVFSLRLGSRRAVVVSSSECARECFTEHDVTFANRPSSRRKLLASFNGTALVTSSYGPHWRNLRRVATVQLLSAHRVACMSGVIAAEVRAMARRLFHAAEASPDGATRVQLKRRLFELSLSVLMETIAQTKATRSEADADTDMSVEAQEFKEVVDKLIPHLGAANMWDYLPVMRWFDVFGVRNKILHAVSRRDAFLRRLIDAERRRLADGGSDGDKKSMIAVLLTLQKTEPKVYTDTMITALCANLFGAGTETTSTTTEWAMSLLLNHPAALKKAQAEIDASVGTSRLVSVDDVLSLAYLQCIVSETLRLYPAAPLLLPHESSADCKVGGYNVPADTMLIVNAYAIHRDPAAWEHPLEFRPERFEDGKAEGLFMIPFGMGRRRCPGETLALRTIGMVLATLVQCFDWEPVDGVKVDMTEGGGFTIPKAVPLEAVCRPRTVMRDVLQNL

SEQ ID NO: 21488 - protein, 517 aa, Lolium rigidum
MDKAYIAILSCAFLFLVHYVLGKVSDGRRGKKGAVQLPPSPPAIPFIGHLHLVEKPIHATMCRLAARLGPVFSLRLGSRRAVVVPSSECARECFTEHDVTFANRPKFPSQLLASFNGTALVTSSYGPHWRNLRRVATVQLLSAHRVACMSGVIAAEVRAMARRLFHAAEASPDGAARVQLKRRLFELSLSVLMETIAQTKATRSEADADTDMSVEAQEFKEVVDKLIPHLGAANMWDYLPVMRWFDVFGVRNKILHAVSRRDAFLRRLIDAERRRLADGGSDGDKKSMIAVLLTLQKTEPKVYTDTMITALCANLFGAGTETTSTTTEWAMSLLLNHPAALKKAQAEIDASVGTSRLVSVDDVPSLAYLQCIVNETLRLYPAAPLLLPHESSADCKVGGYNVPADTMLIVNAYAIHRDPAAWEHPLEFRPERFEDGKAEGLFMIPFGVGRRRCPGETLALRTISMVLATLVQCFDWEPVDGVKVDMTEGGGFTIPKAVPLEAVCRPRAVMRDVLQNL

SEQ ID NO: 21489 - protein, 224 aa, Oryza sativa
MGRRPARCYRQIKNKPYPKSRYCRGVPDPKIRIYDVGMKKKGVDEFPYCVHLVSWEKENVSSEALEAARIACNKYMTKNAGKDAFHLRVRVHPFHVLRINKMLSCAGADRLQTGMRGAFGKPQGTCARVDIGQVLLSVRCKESNAKHAEEALRRAKFKFPGRQKIIHSRKWGFTKFTREEYVKLKAEGRIMSDGVNAQLLGSHGLLAKRAPGKAFLAETIQASA

SEQ ID NO: 21490 - protein, 440 aa, Glycine max
  misc_feature (183)..(183): Xaa can be any naturally occurring amino acid
MAIAPFGNTSATQWGIHPQIFAGSTGLGKIASSRNNVTSRIRFMVAPCSSFFSCHSLHALFDKGSSQTLQHRRGSRLIVRADADYYSVLGVSRNSSKSEIKNAYRKLARSYHPDVNKEPDAEQKFKELSNAYEVLSDDEKRSIYDTYGEAGLKGSGMGMGDFSNPFDLFETLFEGMGGMGGSXGSWNGAVEGEDEYYSLVLNFKEAIFGVEKEIEIRRLESCGTCNGLGAKPGTKSSKCSTCGGQGRVVTSTRTPLGIFQQSMTCSSCSGTGETSTPCSTCSGEGRVRKTKRISLKVPAGVDSGSRLRVRNEGNAGRRGGSPGDLFVILEVIPDPVLKRDDTNILYTCKVSYIDAILGTTIKVPTVDGMVDLKIPAGTQPSSTLVMAKKGVPLLNKKNMRGDQLVRVQVEIPKKLSKEERKLIEELADLSKGKTAATSRR

SEQ ID NO: 21491 - protein, 330 aa, Pinus taeda
VAFNNITRLAFGKRFVNEEGKMDPQGVEFKEIVATGLKLGASLTMAEHIPYLRWMFPLEEGAFAKHGARRDNVTKAIMEEHTLARQTSGAKQHFVDALLTLQEKYDLSEDTIIGLLWDMITAGMDTTAITVEWAMAELVRNPRIQQKAQEEIDRVVGRDRVMNETDFPHLPYLQCITKEALRLHPPTPLMLPHKATQNVKIGGYDIPKGSNVHVNVWAIARDPAVWKDPVTFRPERFLEEDVDIKGHDYRLLPFGAGRRICPGAQLGINLVQSMLGHLLHHFVWAPPEGMQAEDIDLTENPGLVTFMAKPVQAIAIPRLPDHLYKRQPLN

SEQ ID NO: 21492 - protein, 577 aa, Nostoc punctiforme
MANEKGLADDPEIKSLLSPDLPVQPEECYSWLQAYLKNHSSDKDFQELYQVLNSLMYSDGELDSQEKELLAELVNAKVENVPSYQLTLKCRFMSMMLNSKFLASVVQMKQSSVVNQTALVTGYYTRVPYQVLSRFSVNENNKAINYELSKLYLTDNFAPIHQEIFAENLAVIGKLPEELQGTFLRNGPNLQFQPLGLYHWFDGDGMLHAVTINNGRASYRNRYIRTQGFELEQSLGRAVWPGLLNLPRFDAPYGLMMKNPANISCVWHNGQLLALWEAGAPHIIQLPDLETLGVQTFNNKLASTFTAHPKVDPVTGEMMFYGFAPIAPPYLEYSVVSADGELKQTVPIDLPVPVMIHDFAITENYMIFLDMPLLFKLMQSITGHLPIKFEPKRKSRIGILPRHGDNRTIRWFEVPSCMVIHTANAYEDGKEVVLIACRMDYFNLLIPSYSDSGEITNFDLETLKLFCWRINLVTGVVKQEVLDDVPSEFPQINNQFIGRKSRYIYTSRVAPYMKPKPVFDGLIKYDLGTNNSQRHEFGRGRFGGDTTFVSRPGATAEDDGWLLTMVWDTVWSSNLSY

SEQ ID NO: 21493 - protein, 587 aa, Coccidioides immitis
MDVDQGRLQLFFLPSLVFSPVTSSHICFIPSYSLILRIIRDLLLAISGVVRAMPMAATFPSQLLRSSRCCANQCTGISRQIQSRSFHCASKSCYERKSYIQSPRKRSNSHARSFHSSAPAQATVKDPYNVLGVNKNASASDIKRAYYGLAKKYHPDTNKDPSAKDKFAEAQSAYEMLSDPEKKKAYDQFGARAFDQNGGFNPHAAGGGPFGGASAGGFHGFGGFGGEVNFEDLFAHAFGGAGRRRTARGSPFQSTVLVGEDIEVQTNVSFMDAAKGTKKDIFITPLVKCNSCQGEGLKPGRKRSQCSACGGSGTTVHIMGGFQMASTCGACDGTGSSIPRGAECSSCHGNGVVRERRTVQVDIPGGVEDGMRLRIAGEGDVPPGEPGTRKQRGDLFVFIRVAPDQRFSRSGADVLYTASIPLTTALLGGEVTVPTLDGEVKVKVATGTGTGDQITLSGMGMRKLGGRRGGNGDLKVQFKVAMPKYLTANQRTILEVLADEMGDKTAKRVMNVKDDRSASSPDSKSEKSADPHKGEGFLKAAWHKLMNQHHKPTDSSTEGKSDASQKKGSNQDNSDNHDESKKASGSG

SEQ ID NO: 21494 - protein, 329 aa, Unknown
  Nocardioides sp. JS614
MSDVRNVIVIGSGPSGYTAALYTARANLTPLVFEGSVTAGGALMNTTEVENFPGFRDGIMGPALMDEMRAQAERFGAELVADDVVEVDLTGDLKIVRTATDTYTARAVILAMGSGYRRLGLPRETELSGRGVSWCATCDGFFFRDQHIAVVGGGDSAIEEATFLTRFGSKVSLIVRRDELRASKIMQERAFADPKLEILWNSVVEEINGEDRLESLTLRDTVTGETRNLPATGLFIAIGHDPRSELLGGQVDLDENGYVIASHPSTGTNLPGVFAAGDLVDHHYRQAITAAGTGCAAALDAERYLAELDHAASGPLEAQARADAEMAGA

SEQ ID NO: 21495 - protein, 108 aa, Unknown
  Nocardioides sp. JS614
MGNIAAVTDAEFEAQVLKSDKPVLVDFWAEWCGPCRQVAPILDEIATSHGDKITFLKMNVDENPVTPSSYRVTGIPTINVYQGGEVVKSIVGARPKAAILNELSEFIA

SEQ ID NO: 21496 - protein, 395 aa, Zea mays
MAGVTATGMAGVPATFSSATAQIGGFLSKKPYAPPLWATHLSPMPCHTFSLGHFPTPIHKWNLPNLPEGTEVWIKRDDLSGMQLSGNKVRKLEFLMADAVAQGADCVITVGGIQSNHCRATAVAAKYLNLDCYLILRTSKLLVDKDPGLVGNLLVERLVGAHVDLVSKEEYGKIGSVALADLLKKRLLEEGRKPYVIPVGGSNSLGTWGYIEAIREIEQQIQQSSDVQFDDIVVACGSGGTIAGLALGSRLSSLNTKVHAFSVCDDPEYFYDYVQGLIDGLNSGFDSHDIVSMENAKGLGYAMNTAEELKFVKDIAASTGIVLDPVYSGKAVYGLLKDMAGNPAKWKGRKVLFIHTGGLLGLYDKADQLSSLAGSWRRMDLEDSVPRKDGTGKMF

SEQ ID NO: 21497 - protein, 339 aa, Oceanicola granulosus
MEGTDMAETRHTKVLIIGSGPAGYTAGVYASRAMLEPLLVQGIEPGGQLTTTTDVENWPGDTEVQGPDLMVRMEAHARAMGTEIVSDIITALDLSKRPFTAQSDSGTVYTADAVILATGARAKWLGLPSEEKFKGFGVSACATCDGFFYRGQEIVVVGGGNTAVEEALFLTNFASKVTLIHRRDELRAEKILQDRLMKNPKIEPLWFHQLEEVVGDDSPLGVTGVRAKNVKTGEITEIAAKGVFIAIGHAPASELVKDQLETHMGGYVVTKPDSTETSIPGVFAAGDLTDHKYRQAVTSAGMGCMAALEAERFLAEHHEAEREVVTEPLGYGAEVGAAE

SEQ ID NO: 21498 - protein, 629 aa, Cornus capitata
  misc_feature (326)..(326): Xaa can be any naturally occurring amino acid
MASSGEQNQVELLQNLKNRLAIAVKSIQWSYAIFWSISSRQPGVLEWGDGYYNGDIKTRKTVQAVEFNADQLGLRRSEQLKELYESLSVAETNPQARRPSAALSPEDLTDTEWYYLVCMSFVFNIGQGLPGRTLANGQPIWLCNAHCADSKVFSRSLLAKSASIQTVVCFPFLGGVVELGVTELVLEDPTFIQHIKTTFLENPYPTVPKISNYASENKRTDKDLVLPKLNHNKIDSNLDPDVECGEVNLCAPNNNSSGFLPNQQTEESVMVEGLNGGVSQVQSWQFMDDEFSNCVQNSTNSSESISRTSENPEKDCCLTDLPECNXTKLTSLDLPNDDIHYHSVVSSLLKNSHQLVLGPYFQKCHKESSFTGWKKGPVGIRKHRSGTPQRVLKKVLFEVARMHGGRLIKSRKDNSREDGLWRPQVDEIGTTNLFSERRRRENINERYSVLGSLIPSTSKVDKVSILDGTIEYLKELERRVDDLECCREVTDLDAMTRKKPQDTAERTSDNYGNSTGIGKRPSINKRKACDIDEGEPEINLVQLKDSSTDNVTVKMTEKDVLIEIRCPWRECLLLEIMDAISNFHLDSHSVQSSNVDGILSLNIKSKFKGSTVASTGMIIQALQRVICKC

SEQ ID NO: 21499 - protein, 472 aa, Pseudomonas putida
MPVGNHSAHGQATEGGPLKRELGERHIRLMALGACIGVGLFLGSAKAIEMAGPAIMLSYIIGGLAILVIMRALGEMAVHNPVAGSFSRYAQDYLGPLAGFLTGWNYWFLWLVTCVAEITAVAIYMGIWFPDVPRWIWALAALGSMGAVNLVAVKAFGEFEFWFALIKIVTIIAMVLGGIGIIAFGFGNDGVAVGISNLWSNGGFMPNGVTGVLMSLQMVMFAYLGVEMIGLTAGEARNPQKTIPQAIGSVFWRILLFYVGALFVILSIYPWNEIGSQGSPFVMTFERLGIKTAAGIINFVVITAALSSCNGGIFSTGRMLYSLAQNGQAPAAFARTSKNGVPRNALLLSIGALLLGVLANYLVPEKVFVWVTSIATFGAIWTWVMILLAQLKFRAGLTTAERKALKYRMWLWPLSSYLALAFLVLVVGLMAYFEDTRVALYIGPAFLVLLTVLYYTFRLAPKDAQGVTSTAS

SEQ ID NO: 21500 - protein, 465 aa, Pseudomonas putida
MTMTSASGAGNQLAQGFKQRHVTMLSIAGVIGAGLFIGSGHAIAAAGPSAIVAYALAGALVVLVMRMLGEMAVASPDTGSFSTYADRAIGRWAGFTIGWLYWWFWVLVIPIEAIAAGVVLNNWFPHIDAWFFALSMTVLLTATNLFSVAKYGEFEFWFAMLKVIAIVAFIALGAAALAGVLPGREVSGLPRLLEQQGGFMPNGWTAIIGALLTTMFSYLGTEAVTIAASESKDPARNIAKATRSVIWRISVFYLLSIFVIISVVPWNDPLLPVQGSYQRALEIMSIPYAKQLVDIVVLVAVASCLNSSIYISSRMLYSLSKRGDAPGFIQRTSKVGVPRAAVIGSTLIGMLATIVNYFAPAEVFAFLLASSGSIALLVYLAIACSQLRMRAILQRQNVEIAFRMWLYPWLTYAVIGFIIFALGTMFVMPKHRMEVSLTLALALVILVLGVVTSKRHARREALATA

SEQ ID NO: 21501 - protein, 180 aa, Ralstonia eutropha
MMTAEQARELWANSEEIVSAQEVQASLDRMAKDITAKMGDAFPLVLSVMGGAVVFTGMLLPKLQFPLEFDYIHLSRYNNKTVGGEMQWRVAPRESVRDRVVLVLDDILDEGETMAAIRQRIMDMGAKEFHAAVLCEKTLTKLKPMHPDFCGFQVPDRYVFGCGMDAKGYWRNLGTIRALM

SEQ ID NO: 21502 - protein, 191 aa, Magnetospirillum magnetotacticum
MTYRVLRLILSLLAYVLLRPQVTGRNNIPRHGAVILASNHLSFIDSLLIPIVAPRHVTFLAKAEYFTGRGIKGRLSRWFFTTIGMIPVQRDDPRAGQRSLEDALEVLQRGGAFGIYPEGTRSRDGKLHPGRTGVAWLALAGHAPVVPVAVRGTDKVQPVGKRIPRLHRVEVHFGKPIDPQRQITAGTKPAQ

SEQ ID NO: 21503 - protein, 630 aa, Cornus chinensis
MASSGEQNQVELLENLKNRLAIAVRSIQWSYAIFWSISSRQPGVLEWGDGYYNGDIKTRKTVQAVEFDADQLGLQRSEQLKELYESLSVAETNPQARRPSAALSPGDLTGTEWYYLVCMSFVFNVGQGLPGRTLANGQPIWLCNAHSADSKVFCRSLLAKSASIQTVVCFPFLGGVVELGVTELVLEDPTLIPHIKTSLLENPYPIVPKTSNYASESARTDKDLVLAKLNHNKLDTNLDPAVECKGVNICAPNNNSTGFLPNQQTEESVMVEGLNGGVCQVQSWQFMDDEISNCVQNSTNSSDSISQILENPEKDSCLPDLQVCNHTKLTSLDLPNDDIHYHGVVSTLLKSSHQLILGPYFQKCNKESSFIGWKKGPVGIRKHKSGTPQRVLKKVLFEVAQMHGGCLIESRQENGRKDRLWRPEVDEIDTTNLFPERRRREKINERYLVLGSLISATSKVDKVSILDGTIEYLKDLETRVEDLECCREVTDLEARTGRIPQDTAERTSDNYENNRIGIGKKPLINKRKACDIDEAEPEINLVHLKDSSTDDVSVRIIDKDVFIEIRCPWRERLLLEIMDAISNFHLDSHSVQSSNIDGILSLSIKSKFKGSTVASTGMIIQALQRIIWKC

SEQ ID NO: 21504 - protein, 592 aa, Solanum tuberosum
KPPHTDVGCLPTVNAVTIHNPAVPFNSPESTLGRHLARRLVQVGVTDVFGVPGDFNLTLLDHLIDEPGLNFVGCCNELNAGYAADGYARARGVGACVVTFTVGGLSVLNAIAGAYSENLPLICIVGGPNSNDYGTNRILHHTIGLPDFTQELRCFQTVTCYQAVVNNLEDAHELIDTAISTSLKESKPVYISISCNLPGIPHPTFSREPVPFFISPRLSNKMGLEAAVEAAAEFLNKAVKPVIVGGPKMRVAKACDAFVELADASGYAVAVMPSAKGMVPEHHPHFIGTYWGAVSTAFCAEIVESADAYLFAGPIFNDYSSVGYSLLLKREKAIIIQPDRVTVGNGPTFGCILMKDFLAALGKRLKHNPTAYENYRRIYVPEGHPLKCEPKESLRVNVLFEHIQRMLSGDTAVIAETGDSWFNCQKLKLPKDCGYEFQMQYGSIGWSVGATLGYAQAAKEKRVIAFIGDGSFQVTAQDISTMLQCGQRTIIFLINNGGYTIEVEIHDGPYNVIKNWNYTGLVDAIHNGQGKCWTTKVRCEEELVEAIETATETKKDSLCFIEVIVHKDDTSKELLEWGSRVSAANSRPPNPQ

SEQ ID NO: 21505 - protein, 73 aa, Chlamydophila pneumoniae
MAKKEDTLVLEGKVEELLPGMHFRVILENGMPVTAHLCGKMRMSNIRLLVGDRVTVEMSAYDLTKARVVYRHR

SEQ ID NO: 21506 - protein, 695 aa, Methanosarcina barkeri
MELKYVPTTCPYCGTGCGFNIVVKDGRAAGIEPWHRAPVNAGKLCQKGRYAHEFIHSKDRLVKPLVRENGKLVETSWEEALALIAGKFMTFLPEEIACLSSARTSNEENYLMQKFARAVLKTSNVDHCARLCHSSTVAGLAAVFGSGAMTNSILDIEESKCIFIIGSNTLEQHPLIGRRVMLAKKKGAKIVCADPRCTPTAKQADLHLSMYSGTDVSLLNGLMHHIIENGWEDSVFISKRTKNYEEMRSVVIQEAYSLPNVSKITGVPENDLKTAAEWIAQSKPSALIYSMGITQHTVGVDNVRSTANLMLLTGNLGVAGGGVNPLRGQNNVQGACDMGCLPDVYPGYQKVADPENHRKMESIWGVSGLPKAPGLTVTELMEQLAEGTSTVKCMYVMGENFMLSDPDLNKVRKAMKQLDFLVVQDIFLSETANLADVVLPAACYAEKNGTQTNTERRVQRIRKAVDPPGDAKADWRIICELAGCMGYGPQFSYMNEAEIFEEIAKVTPQYGGMSYERLEKPDSLQWPCPDKTHLGTPILHTEKFSTSDGLAEFSGIEWKPPAEVPDVEYPFILTTGRNIWHWHTGTMTRRSKTLASEVRTGWVELHPEDAKKLGIRNRETVRVLSRRGKIEIPSMVTEDIKPGVVFIPFHFKECAANLLTNGALDPVAKIPEYKACAVKIEKIEPQEGKLLEEKL

SEQ ID NO: 21507 - protein, 635 aa, Cornus alternifolia
MASSGEQNQVELLENLKNRLAIAVRSIQWSYAIFWSISSRQPGVLEWGDGYYNGDIKTRKTVQAVEFNADQLGLQRSEQLKELYESLSVAETNPQARRPSAALSPEDLTDTEWYYLVCMSFVFNIGQGLPGRTLANGQPIWLCNAHYADSKVFSRSLLAKSASIQTVVCFPFLGGVVELGVTELVVEDPTLIQHIKTSFLENPYPTVPKISNYVSENARTDKDLVQAKLNHNKLDTNLDLAVECEEVNVCVPNNNSNGFLPNQQTDESVMVEGLNGGASQAKNCPLTDEEIISNCVHNSMNSSDCISQTIVSPDKIVSNGGSLPSLQECNQMRLTSLDFLNDNIHYQSVPSTLLKSSQQLILGPSIQSRNKESSFASWKKGLVAGQKRPCGTPQRVLKKVLFEVARMHGGWLVESREGHDRREGAQRPEVGEIDTSRVLSERLRSEKINEKLLVLGSLVPSASKVDKVSVLDNTIDYLKELERRVEELESCREQAELEAITRRKPQDTAERTSDNHGNNKIGNGKKPLITKRKACDIGESEPEISRVPVNHSSTDNVTVSVVEEDVLIEIKCPWEECSLIKIVDAISNLSLDSHSVQSSNIDGILSLSIRSKFKGSTVTSTGMIIQALQRVICKC

SEQ ID NO: 21508 - protein, 444 aa, Unknown
  Oceanospirillum sp. MED92
MSKIIKGPSTRELMAQMVQESEHLSINDRRDFLRKGVAAAAGMAATTIAGSSIASEVNKANLPPNEPAWGKQLGHGVVEHPYGSPSKFENHVVRRTVPWLTADSIASISMTPLQDLKGIITPNGLVFERYHGGVPQIPVEEHRLIIHGLVERPIIFTMEDLMRFPSVSEIKFIECPANGGMEWKGAQMEALQFTHGMLSCCEWTGVPLKVLLEEAGVKPEGKWILAEGADGSHMSRSIPIEKALEDTLVVYAQNGEMLRPEQGYPLRLLNPGWEGNTSIKWLRRLEVGDKPWYHREETSKYTDLMPDGRARKFTFVQETNSVITSPCPEKPMVKPGFVEIEGLAWSGRGKIKQVDISFDGGVTWVPAKLKGLVLDKALTRFSLVTKWDGQPWLLQSRSIDETGYVQPTLSQLRKVRGGNSIYHKNSIHTWKVAPTGEVTNVQIT

SEQ ID NO: 21509 - protein, 310 aa, Mycoplasma mycoides
MKNLTNEIYDVIIVGSGPAGLTSAIYTARAGLKTVIYEQSAPGGKLIKTDLIENYPGFETIQGPDLASKMYLQALSLNASVEFVGVDSIFKNADDIFEISLTNGEIKKAYSVILATGTQENKLGIKGEDELYGKGVSYCAVCDGAFYKNKPVAVVGGGYSAVQEAMYLSQLVDKVYLIVRRDVFRADANKVAKLKAQPNVEFLLKSQVKEIHGAEKVESLTITTPDGEKKLVVSAIFPYIGSTPLIDSVKHLCIENEKGYIPTNDKMQTEIKGLFVAGDVRDVPLRQIAIACGDGAIAGQMAVEYVQEVK

SEQ ID NO: 21510 - protein, 465 aa, Magnetospirillum magnetotacticum
MLPLDLAFPVFVGTVATARRHDSDSGARDPPPLPSAPSHTPPTDRPSPGARLRRWFGRETTGGDLLIGAALLALVWANSPWRESYLTLSSTVVGPSSPLHLDLTLSTWAADGLLAIFFFVVGVELKQEFVAGSLRNPRQAGVPVLAAMGGMAVPALIFVAVLLTTGDPGALHGWAIPTATDIAFALGVLAVFGRGLPVAIRTFLLTLAVVDDLLAIVVIAIFYTAELQWGYLGLALLAVALYAVLVRARRTRWWLLLPVAVVAWAFMHESGVHATIAGVLLGFTVPALAVHGEREPRTQRFEHTVRPLSQGVALPVFAFFAAGVSIVGGETPVGEVLTQPVVLAIVLGLVVGKLVGVLGVTALVTRFTPLRLAAGIGVRDLLPVGFLAGIGFTVSLLIAELSFPDAEHTDGAKIAILAASTIAAVLAALALRWDARRARSNDMNRDDLPDDVTDFIGDPKDRLEH

SEQ ID NO: 21511 - protein, 470 aa, Geobacillus kaustophilus
MQPVQELKRELKSRHLFMIALGGVIGTGLFLGSGYTIHEAGPGGAVVAYLFGGLVMYLTMLSLGELAVRIPDAGSYQTYATKFISPAVGYCIGWLSWLNWSVTVGIELLTVSILMKRWFPDVPTWVFCAVFALLLFLINALSVKGFGEVEFWFSSIKVLTVIAFIVLGLAAMFGVIHMKNGQPAPFFSNFTDHGGLFPNGFWAIFTTMILVNFSFQGTELVGVAAGESREPEKTVPVALRNTVWRILIFFILAIFVLAGLFPWEKAGVVESPFVEVFDNIGIPYAADIMNFVIITAVLSVANSGLYATSRVLWSMSRQGMVTPFFSKLSKRGVPINALIASIAIGCLSLLCSVYAEDTVYVWLTAIAGFGAVTVWASIALSSYFGRKAFLREGGDVRDLKYRTPLYPFVPLAAFALNMATIIGLAFIPDQRIALYCGIPFLLACYGYYHLVAKKRVQPLAAEEGELKAAK

SEQ ID NO: 21512 - protein, 618 aa, Coprinopsis cinerea
MLSAIWTGFVTLFLCSFVQGAPADNVLPSAASFYVPSIPGIIPNPDYRLQIYAGHLPAESNKTLLASNDVTAHLYFVMVKNRRVADKERVVFWFNGGPGCSSFDGLMMEVGPWRWDGQPEGKESFIVKEGGWEEYTTMVFVDQPPGTGFSFTSTDQYAKTMKDAQWHILEFLRNFYQVFPEVLTMDTYLAGESFAGQWIPYFADAILESSLQIPLRGIAIGNGWMDARRQYLSYLDYSLKMGLIKDNSEDWKEVKAAHDRCEAHLEKLEGDPIHIRECGSIIMKVINQKRPDNEKGEKMCLNMYDVRFTDTSPACGLNWPPEMHAITHFLGRKDVVRALHAERHPGSWVECRRPVHRAFKDGEEESSITVLPRVLSKIPVLIFAGDQDLICNYVGLENMIKSLTWNGETGLGTVETQSWSVNSTATGTWVESRNLTYVKIFNASHMAPFDLPHVTHDMMLRFMGVNFSSIVGGSAMIPSSLGDAAKPVFVGGHLPQPSTPALPAGKTPEQDKAMWEAYYNAGSAALVLVLIMLVIGLFIWYRRRKSRLQLPSNQSGELAEESIPLRSEMEDRGGNGVSNGGAWKGKARASEPVFEVGDSDEDEPSPYRKPDGGGDRNV

SEQ ID NO: 21513 - protein, 268 aa, Methanosarcina barkeri
MGNDNWPEVGEFVVCTVKNVTDFGAYVELEEFGGREGFIHISEIKAGWVKYVRDYVREGQKIVCKVLNVDPSRGHIDLSLKDVNEHQRRAKIQEWKNEQKAAKWLQFVAEETKTDEDNLQTLHEKLVEEFGSAYTAFEEAAIEGEKAFKGVKVNKKYLKSIIKIAGENIKLPFVDIAGYVDLTCDLPNGIEVIKQALSAANSINDVDEKDIRLEISYTGAPRYRIKVIAPDYKKAESVLKKSAQTAVDNITKLGGHGTFKRHIESAKA

SEQ ID NO: 21514 - protein, 435 aa, Geobacillus kaustophilus
MGVRTDCECLVPSINRVKEANETMEENMFLSTQRVIKEALAKLGYGEEMYELLKEPLRVLTVRIPVRMDDGTVKVFTGYRAQHSDAVGPTKGGIRFHPDVTEEEVKALSMWMTIKAGIVGLPYGGGKGGIVCDPRNMSMGELERLSRGYVRAISQIVGPSKDIPAPDVFTNSQIMAWMMDEYSRIREFDSPGFITGKPLVLGGSQGREKATALGVTICIEEAAKKAGIELQGARVIIQGFGNAGSFLAKFLHEAGARVIGISDAYGALYDPNGLDIPYLLDRRDSFGTVTTLFENVITNQELLEKECDILVPAAVANQITRDNAANIRAKIVVEAANGPTTLEATKILTERGVLLVPDVLASAGGVTVSYFEWVQNNQGYYWTEEEVVEKLKEKLTSAFHRVYELAESRRVDMRMAAYMIGLRQTAEAARYRGWV

SEQ ID NO: 21515 - protein, 556 aa, Oenococcus oeni
MSKKQWFKDTVVYQVYPMSFQDSDNDGIGDLPGITKRLDYIKKLGADVIWLNPIYESPNKDNGYDIANYRAINPEYGSMNDFDDLLNKAHQLNLKIMMDLVVNHTSDQHHWFQESKKTKDNPFSDFYIWRDPVDGHEPNNWLAAFGGSAWTYVPERKQYYLHLFATGQPDLNWENPDVRQAVFDIERFWLDKGVDGFRMDVINLISKPKGLPDVPEPATAGKTMDFVADGHRLNEFLSQMNSEVLSKYDTITVGEMPGSTTEDAIKYTGLNSHELNMVFQFEHVGLSPNPDVRLGKWNDQPVKLTELKASLNRWQTGLDGKGWNSLYWNNHDQPRAVSRFGNDDPKYRVLSAKMLATTLHLMQGTPYVYQGEELGMTNAHFTKLNQYEDIESINFYHELVEQEKIVDGPTMLKYLANISRDNARTPMQWNDKNNAGFSSAKPWFALNPNYKSINVEDSLADKNSVFYYYQKLIKLRHNNEIIKYGSFEEIDPDDDQVYAYRRHYEGKTLLLISNFTDKIVSRDYGQSNASSLLIDNYEDDKVNELRPYEAKAYLFK

SEQ ID NO: 21516 - protein, 861 aa, Oryza sativa
MPTMHGKTQLLAAFWQRADRDTRDVSGDTYQILSLILEILALRVFGLRNYTRNGTTQQTENGSEERLTEVKPTWPVAELAPTWRLCGSHAGRREEDDDAGRNGWRTAAASSGANHGDTGESEHTGRLHGTRGDEPMDWIRRKEPDGGGLRRRQPAARKEGNGDGATGVRFERARASTRLQESVSSVGLDGSSPRKAGDGRLLPSAGGDGGEPTASGGGGQGASWRSALAAKTTTEGMTPAVEEKREKGRKKRGLPLASLGKERGREGDEADGGGALPPFLGSMHAEWRGQVDDDGDDGGAVWKGAATGRQTRAQARQVLTASAIGRSATTAPRRNGRYGFPFLSFLHLPSRRAMQAAPPPPPPMDVLDHAPPSPLSSDILPHFPPSLADAGAGALDLSFTSTASASTSSFTTATTFSARSSLSLPSFSSSTSLSPRPHSSSSSPHWALLAAARAATPDGVLRLAHLHLIRELGHGHLARVFLCRLKSSPPASPLFALKVVDLRDDDPSRVTHVLAESRVLSSLDHPFVPTLYARLDAGRYACFLMDYCSGGDLHAVLRRRPGGRLPVAAARFYAAEVLLALEYLHALGFVYRDLKPENVLLRGDGHVVLSDFDLALPASVEPAVRRRQVRKLSRRKNRIVPSCFSANGGSGDDGDEVNAKEQFEFVAEPTTANSKDCVGTHEYLAPELVSGSGHGNGVDWWAFGVFLYELVYGRTPFKGHAKDATLKNILAKQVTYPQLDGEADAAQLRDLIGRLLERDPRRRMGSARGAAEIKRHPFFAGVDWALIRCVAPPVVPDKDSAAAGAGDKKAKLGSWNSMGGKKRSSFGRKSNYEERQGVFRKLMSWSQDSRSKKAKTNKVKL

SEQ ID NO: 21517 - protein, 471 aa, Oenococcus oeni
MNLSHASDSKISADIPLVNKKEKPLIKNTDKEEKHHLPKLRLSTIFAMTFGFFGINMAFSLQSSQLGRIFQTIGANPNNLGFFFILPPLAGMVIQPLIGKYSDRTWNRFGRRMPYLLIGAPAAAIVLILLPNAGSFGFGYASVAALCFGAVATLFMDLTSNICMQPFKMIIGDMVNEDQKDLAWSWQQSFSNLGGVLAAVIPFVLTLVGISNTAPKGEVPLTVKIAFYSAAIILLVTSLLTIIKVHEYDPKTYAQYHEIDLQAQKKSPSLVKLLKDAPRAFWETSVVEFFSWFAILYLWTYATGAISLNVWHTSNASSAGYQAAGNWYGVLTCIMSIAAVIWGIVVQARTKPTSRKFWYSFGLLAGAVGYFMIYFIHNKWLMIIPFCLIGISYLVINTQPFSLLTEALNGQHEGSYLGLFNCSICLPQICASVASFWLFPLMGQSMPAMFLVGGTSLVLGAISVRFVHSRF

SEQ ID NO: 21518 - protein, 487 aa, Salmonella typhimurium
MCDCGGKKSQGVKWLPFILILVIAAGLWQLTPPSGLSAPAWHSAIIFVATIASIVAKVLPIGAVGIIGITVFALAYAAGDKTASGAITTALSELNSSLIWLIVVAFMIARGFIKTGLGRRIALQMIRLLGKRTLGLAYGLAFADLILSPAMPSNTARCGGVIYPIADSLARSFDSHPEDESRSKIGTFLITCIGNVNDVTAALFMTGYTGNLLAVKLAANAGVTLSWGSWFIAALLPCLVSFLIVPLLVYWLTRPEIKHTPDAPDLARKELAQMGSMTRGEWLMLATVGVLLVLWIFGSSLGVDATTASFVGLSILLLSGVLTWEDVKSEKGAWDTLIWFAALLMMANQLKKLGFTSWFGNLIGDSIGSTMHGTSWIIILLLLNAAYFYTHYFFASGNAQIAALYAVFLGVGLHLNIPAAPMALMLAFTSSLYCSLTQYTHARGPILFGAGYVPTGVWWRTGFIISLFNQAVFLTVGLAWWKVLGLY

SEQ ID NO: 21519 - protein, 106 aa, Unknown
  Malus x domestica
TDVPAPDMGTNAQTMAWILDEYSKFHGHSPAVVTGKPIDLGGSLGREAATGRGVVFGTEALLAEYGKSCKGLTFVIQGFGNVGSWAAKLIHEKGGKVIAVSDITGA

SEQ ID NO: 21520 - protein, 279 aa, Mesembryanthemum crystallinum
MCESFKREYQLCEEIGRGRFGVVYRCYNPSSTEDSDTPLAVKSIDKRLFLDDETDRECLDKEPKILHLLSPHPNILQIHNLFDSDTHLLIVTDLCQEETLYERIISNGPFSEPDAAAIFCQLAEALAHCHRNYVAHRDIKPDNILFDSRNRLKLCDFGSAEWFGAGDREMRGVVGTPYYVAPEVLSGKDYNEKADVWSAGVILYIMLGGVPPFYGETVEETFEAVLRGNLRFPARIFRNVSTQARDLLRKMMCKDVSRRFSAEQVLRHPWVTSGGLANM

SEQ ID NO: 21521 - protein, 504 aa, Vibrio cholerae
MEKINLVWLKRDLRLTDHAPLQAALTSGRPTLLLYLFEPMLLGDAHYSERHWRFVWQSLQAINRDLAQSKGEVLIVTSDWQTCFARIAERYAIEAIYSHQEVGLACTFQRDLALAQWCQQHDIVWHEFPYAAVIRGAQTRKNWDEHWQQVMRSPCCDPDLTRANWLKLDAATLGLRSDIPATWQSKQAGMQTGGSDMAWATLEDFFARRGREYYRSISSPSLARHACSRMSPYLAWGNISLREMYQTLLKHWSVAGFRRSLIALSSRLHWHCHFIQKFESECEMEFRCVNRAYDSLLQQSSDAPAAQLAAWQTGHTGIPLVDACMRCLIQTGYLNFRMRAMLVSVLTHHMNVDWRAGVTYLAQLFLDFEPGIHYPQFQMQAGVTGTNTIRIYNPTKQAQEHDSEGQFIHKWVPELAQVPVPLLFEPWLMTPLEAQMYQVPLESPYLKPVMDLEASAKQARDRLWQWQKLPAVQAEAMRILARHVRQAKPRTSPRQPNKRQPEMD

SEQ ID NO: 21522 - protein, 457 aa, Ostreococcus tauri
MDASAAEAPMRSPNAIANTKTVAAVILGGGAGTRLYPLTKSRAKPAVPIGGAYRLIDVPMSNCLNSGISKVYILTQFNSASLNRHLARTYNFGNGIMYGGNGFVEVLAATQTPGQGGKEWFQGTADAVRQYSWLFNDVKNKDVEDIVILAGDHLYRMDYMKFVEAHRESNADISVGTLPIDEARASDFGLMKIDSTGRIVEFTEKPKGDALQAMKVDTTVLGLTADEAKEKPFIASMGIYVFKKSALVKFLEKDYPEDNDFGGEIIPRAAADGAKVQAYLFNDYWEDIGTMKSFFEANLNLAKDPPNFEFYNAEAPIYTSPRFLPPAKVERCHVKESIISHGASLADCQVEESIIGLRSVVNKGCRIKRAMIIGADFYESDEKKASLLASGEVPVGIGEGTIIENAIIDKNARVGKNCVITNAAGVEDLADEERGVFIRNGIITILRNCTIPDGTII

SEQ ID NO: 21523 - protein, 253 aa, Zea mays
  misc_feature (54)..(54): Xaa can be any naturally occurring amino acid
  misc_feature (198)..(198): Xaa can be any naturally occurring amino acid
  misc_feature (215)..(215): Xaa can be any naturally occurring amino acid
  misc_feature (246)..(246): Xaa can be any naturally occurring amino acid
MQLNKKSRLLQLPHFSSFTTTTTSSLISSSRPFSLSSIKMSNEEITHPTIVDGXFREISDMWPGHAMTLRVEKVLVHEKSKYQDVLIFKSTDFGNVLVLDNVIQCTERDEFSYQEMIAHLALNSHPNPKKVLVIGGGDGGVLREIVKHDCVEEATLCDIDEAVIRLSKEHLPSMACGFDHPKSKTHVGDGFKFLNDYXNEFDVIITDSSDPDGPXEALFQKSYFQLPHDALREGGVITTQAESPWXHLPLIAR

SEQ ID NO: 21524 - protein, 541 aa, Oryza sativa
MAPALLTAVDATAQTHLIIGSNPLAGARCTRSIEVGANPILIAPEDSTLHYGLAKRIEAGEVKWLKRSFQEDDLTTLGRAEVDGVVDAVFVTSGGKHTSATHISDLCRRLRIPINVADAPNLCSFTLLSSHSDGPLQIGVTTSGKGCKLSSRIRREIAASLPPHLGDAVERLGSLRRRIWEEDHAAELSHDLENEDEDSGQSATFNKLILEESKEAARGRRMRWLTQICEYWPLRRLASITDADIDTLFREFAASSPSKIGPTSTTPERKFGRIILAGSGPGNPDLLTRAAYKAIQSADLILADKLVPSPILDLVPRRATVHIARKFPGNADKAQEELLELGLEGLKAGKVVVRIKQGDPYIYGRGGEEYDFFRAHGFIPSVLPGITSALSAPLFAAIPATHRGVADQVLICTGTGRKGAPLDPPEFVASRTLVLLMSLHRLSGLVDDLTKKGYPKDLPVAVLERASCSDQRVIRTSLEHVCAAVEEEGSRPPGLLVVGNACRVLMKHEQRWVVEEGFHGLDGLGSEGELEVGRVRDAVVA

SEQ ID NO: 21525 - protein, 112 aa, Acidobacteria bacterium
MTKLEAIIQPRKLDEVKDALVAIGIDGMTVSEVRGHGRQKGHTETYRGREYDVSFLPKIKIEVVIDDERVDEAVETILQSAASGQIGDGKIFLYKVDEAIRIRNQERGVAAI

SEQ ID NO: 21526 - protein, 554 aa, Bacillus cereus
MSRKIVVVGGVAGGASVAARLRRLSEDDEIIMVERGEYISFANCGLPYYIGGVITERQKLLVQTVERMSKRFNLDIRVLSEVVKINKEEKTITIKNVTTNETYNEQYDILILSPGAKPIVPPIPCIEEAKALFTLRNVPDTDRIKAYIDEKKPRHATVIGGGFIGVEMVENLRERGIEVTLVEMANQVMPPIDYEMAAYVHEHMKNHDVELVFEDGVDALEENGTVVRLKSGSVIQTDMLILAIGVQPESSLAKDAGLALGVRGTIKVNEKFQTSDPHIYAIGDAIEVKDFVTETETMIPLAWPANRQGRMLADIIHGHTDSLYKGTLGTSVAKVFDLTVATNGVNEKILKRLNIPYEVVHVQANSHAGYYPNATPVLIKLIFNKDSGKIYGAQALGRDGVDKRMDVIATAIKANLTVLDLPDLELSYAPPYSSAKDPVNMVGYVASNIVDGFVDTVQWHEIDRIVENGGYLIDVREPNELKQGMIKGSINIPLDELRDRLEEVPVDKDIYITCQLGMRGYVAARMLMEKGYKVKNVDGGFKLYGTVLPERIVY

SEQ ID NO: 21527 - protein, 428 aa, Bacillus cereus
MFCYQCEQTPTGGCKVIGVCGKNETIASLQDTIVFGLKGIAAYRTHAAQLGYTDAFVDATTQEALYMTLTNSNFNEQEHIDMAMKVGKSALRVMELLDEAHTNHFGVPEPVQITQNHVEGKAIVVTGHNLFALEELLKQTEGKGINIYTHSEMLPAHGYPQLKKYKHLKGNIGKAWYDQRRLFEKFTGAILATTNCVMPIKGSYSDRFFSYDIAGLEGVEKIENDDFAPLIQKALELPEVHMESDEQLVTGFQHHTVLSLAPEIIEAVQEGKIKRFFVIAGCDAPGKGGEYYRELATSLPPETVILTTSCGKFRFNDVDYGVVPGTGIPRYIDLGQCNNSISTVKIATALADAFQCEVNELPVSIVLSWFEQKAVAILLGLFSLGIQDIRIGPKAPEFISSGVLDVLQETFGLKLITTAAEDMDMMLS

SEQ ID NO: 21528 - protein, 194 aa, Medicago sativa
MTLIAKPNVFNGLNFNINETQIPFSSFSVIRKRFGDSSHRNVVLRSNGNASVLPKIRAQNLPDYVPESKFYKVEAILRPWRIPQVSSGLLKMGIRGVTVSDVKGFGAQGGSKERQGGSEFSEDNFVAKVKMEIVVRKDQVEAVINKIMETARTGEIGDGKIFLIPVSDVIRIRTGERGEQAERMAGGLTDALYV

SEQ ID NO: 21529 - protein, 420 aa, Triticum aestivum
MGDMMCPAPATARSTTTPRIPLLPYVLLGLASTVMSLEPDAEEEWAAVERRGAHLVTRAAERPFIIHGFNTYWLMSFAADEATRPRVTAAIAEAAGAGLNVCRTWAFADGGYHALQTAPFCYDEVVFQALDFVVSEARRYKMRLILSLCNNWEDYGGKAQYVRWGKEAGVDLTSDDDFFSGPTLKGYYKAFVEAVLSRINTITNEAYKDDPTILAWELINEPRCPSDPSGDTLQAWIEEMASYVKSIDTMHLVEIGIEGYYGPSTPELLLVNPDDYSGHVGTDFIRNHQAMGIDLASVHIYSDTWLPDSTEESHVQFVNTWMQQHIDDAANLLGMPIVIGEFGLSLKDGKFENEFRETFMQTVYNNFLGSWESGMIGGGCLLWQLFPEGAEHMDDGYAVIFAKSPSTFNLLANHSRKLEC

SEQ ID NO: 21530 - protein, 452 aa, Candida glabrata
MSSDEEDFNDIYDTKDESKVDAKDDVKAEEKVPEAATSALDQLAALQASSANPDSNKDDAAKMPWETLQNTLNQLQTVTKEESPDKSKEEKSSNASVDSGTNVQSGNTGDRTVKADLSKDSCKMFIGGLNWETTEDGLRDYFSKYGKVEELKIMKDPATGRSRGFGFLTFESASSVDEVVKTQHILDGKVIDPKRAIPREEQDKTGKIFVGGIGPDVRPKEFEEFFAQWGTIIDAQLMLDKDTGRSRGFGFITYDTPDAVDKVCQNKFIDFKGRKIEIKRAAPRHLQKTGGARQPAQQSSNSQYGMGTGSNSSGQYPGYGFQDPMMFSNPMMSGYNPMFANNNPQMQEYFQKMQDYYKQVQQQGGMDYNQMYQQQMQQMAMMMPGFNPSTMGQQSQGSPDANSTKSQSNEASTPTPDDQDRGNKDSSRRSGGPGGFRGRPNDSRRGYHPYNR

SEQ ID NO: 21531 - protein, 630 aa, Cornus eydeana
MASSGEQNQVELLENLKNRLAIAVRSIQWSYAIFWSISSRQPGVLEWGDGYYNGDIKTRKTVQAVEFDADQLGLQRSEQLKELYGSLSVAETNPQARRPSAALSPEDLTDTEWYYLVCMSFVFNVAQGLPGRTLANGQPIWLCNAHSADSKVFSRSLLAKSASIQTVVCFPFLGGVVELGVTELVLEDPTLIPHIKTSLFEEPVPNCSKTSNYASESARTDKDLVLAKLNHNKLDTNLDPAVECKEVNICAPNSNSTGFLPNQQTEELVMVEGLNGGVCQVQSWQFMDDEISNCVQYSTNSSDSISQILENPEKDSCLPDLQECNHTKLTSLDLPNDDIHYHGVVSTLLKSSHQLILGPYFRKCNKESSFIGWKKGPVGIRKHKSGTPQRVLKKVLFEVAQMHGGCLIESRQDNGRKDRLWRPEVDEIDTTNLFPERRRREKINERYSVLGSLISATSKVDKVSILDGTIEYLKDLEMRVEDLECCREVTDLEARMGRIPQDTAERTSDNYENNRIGIGKKPLINKRKACDIDEAEPEINLVQLKDSSTDNVTVRMIEKVVLIEVRCPWRECLLLEIMDAISNFHLDSHSVQSSNNDGILSLSIRSKFKGSTVASTGMIIQALQRVICKC

SEQ ID NO: 21532 - protein, 295 aa, Arabidopsis thaliana
MARQINIESSVSQVTFISSAIPAVSSSSSITASASLSSSPTTSSSSSSSTNSNFIEEDNSKRKASRRSLSSLVSVEDDDDQNGGGGKRRKTNGGDKHPTYRGVRMRSWGKWVSEIREPRKKSRIWLGTYPTAEMAARAHDVAALAIKGTTAYLNFPKLAGELPRPVTNSPKDIQAAASLAAVNWQDSVNDVSNSEVAEIVEAEPSRAVVAQLFSSDTSTTTTTQSQEYSEASCASTSACTDKDSEEEKLFDLPDLFTDENEMMIRNDAFCYYSSTWQLCGADAGFRLEEPFFLSE

SEQ ID NO: 21533 - protein, 434 aa, Kineococcus radiotolerans
MTDVLPTTPTASGVTDRPLSEVDPEIAAVLDAELGRQRDTLEMIASENFAPRSVLEAQGSVLTNKYAEGYPGKRYYGGCEHVDVAEELARTRAKELFGAEHANVQPHSGASANAAAMHAFIRGGDGILGLELAHGGHLTHGMKINFSGRMYDVSSYGVDPQTFRVDMDVVRAVALESRPKLIIAGWSAYPRQLDFAAFRSIADEVGAHLMVDMAHFAGLVAAGLHPSPVPHAHVVTSTVHKTLAGPRSGLILTRQEFAKKIDSAVFPGQQGGPLMHVVAAKAVAFKVAGSEEFAERQRRTLEGAKIVAERLTAPDVAEAGVSVLTGGTDVHLVLVDLRDSKLDGQQAEDRLHEVGITVNRNAVPFDPRPPMVTSGLRIGTPALATRGFGAAEFTEVADVIALALKPEFDADALRARVAKLTAEFPLYPSAGSFA

SEQ ID NO: 21534 - protein, 309 aa, Picea glauca
MACDRSALYTSSVIMNTEDNSSAHAIAAMIASSCTPPATFQGTRSISVFETGNERKRPAGNSYSALELSDDIGDEDGSDDCIHLGEKKRRLTLEQVRALEKNFEMANKLEPEKKMQLAKALGLQPRQIAVWFQNRRARWKTKQLEKDFNVLKQDYDALKQDYDNLMEENNNLQAMIERMSSKSQSCNDQKFQANSSKLQKDDQDLQLLMMSATKVDCADKENNNEGPSSIGSEGSSVLDMDSPGTIDSQQNIDSIGFSNVKARDLRLECNFRPKVEENVSQADEPCNYLFYNNLETGPLLWDYNWSSGL

SEQ ID NO: 21535 - protein, 266 aa, Methanosarcina barkeri
MKAACIQMNISLCSKKENLERALSLAEEAVSKEAEVLAFPEVFSTGFCYDHIVELAETASGPTIGALCDFSKENECILAGSMIEHREGSEFSSEMNIPPQFNLGFCIESGKLVGIHRKTQLYGLEKEYFALGEDIHPIRLKKYDLSMGLMVCNEIRYPEVSRKLALEGADLLVSASDMPDFYIYPWRIMSLSRAIENQLPHIACNRAGNDRFSTYPGRSFIADGWGRILAEAGKEECVLIGEIDLEKIKEIRKTGSIIEDRRPEIY

SEQ ID NO: 21536 - protein, 374 aa, Hevea brasiliensis
MAISSSTSGTSSSLPSRTTVMLLLFFFTASVGITDAQVGVCYGMQGNNLPPVSEVIALYKKSNITRMRIYDPNQAVLEALRGSNIELILGVPNSDLQSLTNPSNAKSWVQKNVRGFWSSVRFRYIAVGNEISPVNRGTAWLAQFVLPAMRNIHDAIRSAGLQDQIKVSTAIDLTLVRNSYPPSAGAFRDDVRSYLNPIIRFLSSIRSPLLANIYPYFTYAGNPRDISLPYALFTSPSVVVWDGQRGYKNLFDATLDALYSALERASGGSLEVVVSESGWPSAGAFAATFDNGRTYLSNLIQHVKRGTPKRPKRAIETYLFAMFDENKKQPEVEKHFGLFFPNKWQKYNLNFSAEKNWDISTEHNATILFLKSDM

SEQ ID NO: 21537 - protein, 190 aa, Mycoplasma mycoides
MQKLHPLVKEVLFTRDQIQKRTKEIAKEVESYYKDKPLKDNSLLVVGLLKGCVPFYTDFCMVCDLTMEMDFMVVSSYHGSTSSNSAPKINLDLNTDVKDRDILIVEDIIDTGFTLKYVKEYLLNKGAKSVKILTMLDKPSGRKIDLTADWVCFTIDPCFVIGYGLDYQEKIRNLPYVAVCDTTKLDDWKW

SEQ ID NO: 21538 - protein, 435 aa, Arabidopsis thaliana
MTVEMHAGLASDGGSKLKMLISYVDNLPSGDEKGLFYALDLGGTNFRVMRVLLGGKQERVVKQEFEEVSIPPHLMTGGSDELFNFIAEALAKFVATECEDFHLPEGRQRELGFTFSFPVKQTSLSSGSLIKWTKGFSIEEAVGQDVVGALNKALERVGLDMRIAALVNDTVGTLAGGRYYNPDVVAAVILGTGTNAAYVERATAIPKWHGLLPKSGEMVINMEWGNFRSSHLPLTEFDHTLDFESLNPGEQILEKIISGMYLGEILRRVLLKMAEDAAFFGDTVPSKLRIPFIIRTPHMSAMHNDTSPDLKIVGSKIKDILEVPTTSLKMRKVVISLCNIIATRGARLSAAGIYGILKKLGRDTTKDEEVQKSVIAMDGGLFEHYTQFSECMESSLKELLGDEASGSVEVTHSNDGSGIGAALLAASHSLYLEDS

SEQ ID NO: 21539 - protein, 176 aa, Vibrio parahaemolyticus
MKHTIEVMISEQEVQERIRELGKQITERYQGSEDLVLVGLLRGSFVFMADLARAIELTHQVDFMTASSYGNTMESSRDVRILKDLDDDIKGKDVLLVEDIIDTGNTLNKIREILSLREPKSIAICTLLDKPSRREVNVPVDWIGFEIPDEFVVGVGIDYAQKYRHLPFIGKVVPQE

SEQ ID NO: 21540 - protein, 363 aa, Mycoplasma mycoides
MAICKIGSKYTFTIRGILFCYIIKFMLMCFLERGLYLMIKKIGILTSGGDAPGMNNAIAGVVKTAASKGIEVYGINDGYKGLVNGWFEKLNVEKTLDILSRGGTYLGSARLPEFKELEVRQKAVANLKKAGIEALVVIGGDGSYMGAQKLTEMGINCIGLPGTIDNDISSTDYTIGFHTALNTIVEAVDRIRDTMQSHNRADVVEIMGNGCGDLVTYTAVATGAEIFSPAEDLLTIEQMGQKAKQFRLLGKKSLIILVSEKSYGISAKEIAEKIQKISGYETKATVLGHIQRGGRPTAMDRYIAFTAGMFAVEKLAEGKGGLFIGLENNKLVARDIDSTLNMKKEDKKPFIKYLREINGYFSK

SEQ ID NO: 21541 - protein, 197 aa, Unknown
  Oceanospirillum sp. MED92
MNWINSSMLIMAFAAALLLSKPLHADATSPSSVSSSCPDTLNYSFRRLGEDKLENLCDTYKGKLILVVNTASKCAFTPQYDGLESLYRQYKAKGLVVLGFPSNDFAGQEPGTEKEILSFCRLTYSVEFPMFEKIHAAQGKADPFFVTLADSTGEYPGWNFHKYLIAPDGKVIRSFRSFVKPTDPELVRIIEENLPHG

SEQ ID NO: 21542 - protein, 256 aa, Unknown
  Mycobacterium sp. JLS
MSDRFSMEGRVAVITGGGTGIGRASALVLAEHGADVVLAGRREEPLKATAADVEALGRRAIAVPTDVTKADQCQALVDATLGEFGRLDVLLNNAGGGETKSLMKWTDEEWHEVLELNLSSAWYLSRAAAKPMIAQGKGAIVNISSGASLLAMPQAPVYAAAKAGLNNLTGSMAAAWTRKGVRVNCIACGAIRTPGLEADAKRQGFDIDMIGQTNGSGRIAEADEIGYGVLFFASDASSYCSGQTLYMHGGPGPAGV

SEQ ID NO: 21543 - protein, 154 aa, Arabidopsis thaliana
MANLMMRLPISLRSFSVSASSSNGSPPVIGGSSGGVGPMIVELPLEKIRRPLMRTRSNDQNKVKELMDSIRQIGLQVPIDVIEVDGTYYGFSGCHRYEAHQKLGLPTIRCKIRKGTKETLRYVCVSLKNENFGLETLDLLYIEGSLVSHRHHLR

SEQ ID NO: 21544 - protein, 379 aa, Sinorhizobium meliloti
MKRDLYETLGVQKNADEKELKSAFRKLAMKYHPDRNPGDQESEKSFKEINEAYETLKDPQKRAAYDRYGHAAFEQGGMGAGFGNGFAGGGAHGFSDIFEDIFGEMMGGRQRRSSGGRERGADLRYNMEISLEEAYSGKTAQIRVPTSITCDVCTGTGAKPGTSPKTCGTCQGTGRVRAAQGFFSIERTCPTCGGRGQTIADPCTKCHGQGRVVEERTLSVNIPAGIEDGTRIRLSGEGEAGLRGGPAGDLYIFLSVKPHEFYQRDGADLYCAVPISMTTAALGGKFDVTTLDGTKSRVTVPEGTQAGKQFRLKGKGMPVLRSSQTGDLYIQIQIETPQKLTKRQRELLQEFEQISSKENNPESTGFFSRMKDFFDTLSE

SEQ ID NO: 21545 - protein, 280 aa, Myxococcus xanthus
MDGKVCLITGATGGIGLEAAKALARMGATVVLVGRDAGRTEAAVAAVKEAAPSAQVDWLRADLASLKSVRELAQTFRSRYPRLDVLLNNAGLIIDRRQVTEDGLEATMATNHFAPFLLTNLLLDVMKATGPARIINVSSDAHAAGKLDFDDLQSERGFIGFRVYGTSKLANILFTRALAKRLEGTQVTTNALHPGVVRTGFGHNTQGFFRHLVKLGAAFMISAEKGARTSVYLASSPEVEAVSGQYFYKCRPKKPSSAARNDALAERLWQVSEQLTGVKG

SEQ ID NO: 21546 - protein, 311 aa, Helicobacter hepaticus
MIDLAIIGGGPAGLSAGLYATRGGIKNVVLFEKGMPGGQITGSSEIENYPGVKDIVSGMEFMEPWQEQCFRFGLTHKMSEVSQITKKNDIFYIHQTDGSIDEAKAVIFCAGGSPKRANLKGEDEFWGRGISTCATCDGFFYKDQEVIVLGGGDTALEEAVYLSRICSKVHLVHRRNEFRAAPSTIEHVKKNDKIHIVTPAVVEEIKGDKSGVTSVLIKHTDSNTNEEIPVMGIFIFVGYNVNTATLKQDDGSMLCECDEYGSIKVDLSMKTSVEGLFAAGDVRTLAPKQVVCAAGDGATAALQAIAYLEHK

SEQ ID NO: 21547 - protein, 588 aa, Myxococcus xanthus
MADDNAAQPGKDNADTPAARERRTDAVLLKMPNHNMDYPHLAVPTLTAALRKNFFKVKQQDVNVLLRDFLLTEEMLKDLAYRFLPELAKAHIDIPADFDRIRNALVYLHYIDNQIGFARVEQVKQKLQARKYEEVFCDEQESSLASLIFVLTGMLHIVIDLALTYDEAGGEIDNPVTNFLHQKVREVAALNPRVVGFSVIQIQRKATLWFARRLKPLIQGKIAVGGPDASTFKEEYLKNNDCIDYAFLKEAETTFLELLRGKPVEQLDGVVFRDAEGNIQVNEPRHDIQLSIFRPDFDGYDLDKFLLPTLPLSTSRGCAFAKCTFCNHYKTYSGYYSNDAVKTVDIIELLAKRYNTRFFHFVDDMLEVKEGTAIAEELIRRDLDVNILTYARFEPQFTDEKILELWHKAGIRVIEWGLESASQEVLKKMIKGVSIRQVQNILDISSQKGIVNKLMLFHNYPGETVDQLKMTVDFLRKNVLEKKVRPFFTVRGRLELRLFTPLEITSRDYSKSPFRKRYERSSSFDSLLGYADEDDYPRKVEYIESFINEMSQYLNENKIFSTNDENMSLDLLILDLKRRGLETAVAVQ

SEQ ID NO: 21548 - protein, 479 aa, Mycobacterium avium
MANRYLQGPFAPMHHEYTLTGLEVVGTIPDYLDGRYLRNGANPIGDVDPERYHWFLGDGMVHGIRIRDGKAEWYRNRWVRSPATSKALGQPAPPGHFGFFPIGANTNVIGHAGKTLALIEGGIANYELTEELDTVGVCDFAGTLTGGYAAHPHRDPETGELHAVSYNPYRGNRVQYSVIDVEGRARRTVNVTVGGSPMMHDFSLTERYVVFYDLPVTFDEAVGAAMTAPRGLRPIARLMLSALIGRVAIPDPIAARLPAATTDRRMPYSWNPNYPARVGVMPRDGEDADVRWFDVEPCYVFHPMNAYEEDGTIVLDVVRNPKMFDRDRTGPNEGPPTLDRWVIDLAAGKVRESRIDDRGQEFPRIDERLVGKRHRYGYTPTVLEGIEGGDCLLKHDLIGGSTQSRCLGPQKALGEFVFHPSSPAAAEDEGVLMGYVYDRATNRSELAILDAQTLEDVASIKLPHRVPAGFHGNWVPSTN

SEQ ID NO: 21549 - protein, 209 aa, Alkalilimnicola ehrlichei
MGRRKRRPGSRRWLDEHHSDHWVQQAQKAGYRSRAAFKLLEIQEKDRLIRPGMTVVDLGAAPGGWCQVAAELVGDRGAVFALDILPMEALPGVHVIQGDFTEEAPLQALLQALEGRPVDLVLSDMAPNLSGVRVVDQPRAMYLAELALDFAGQVLQPGGDFLTKVFHGEGLDDYRRDLQRQFSKVITRKPRASRARSRESYLLARGFGL

SEQ ID NO: 21550 - protein, 489 aa, Trichodesmium erythraeum
MTNLQIQQPKSYTSKDWQQGYKSQPQEYNYWIDDIEGEIPEDLNGTFFRNGPGLLDINGQLIAHPFDGDGMVCAISFKNRRAHFQNRFVRTEGYVAEKAAGKILYRGVFGTQKTGGWLANLFDFKLKNIANTGIIYWGDKLLALWEGGQPHRLNPQNLETIGLNDLDGLLQPGQAFSAHPRIDKGKDGKGDVLVNFSVKPGLSSTITIFEFNSQGKLLKRYSNSIPGFAFLHDMVITPNYCIFFQNPVAFNPFPLLLGLRTPGQCLEFLPNNSTQVILIPRDGSKAIKILKTKPCFVFHHANAWEKDGEIYVDSICYESVSQTDLGDNFLEVDFDSMTEGKLWRFKINLSENNVEHKLLESRCCEFPTLNPNNVGKAYRYLFIGAADKPSGNAPLQAILKIDLHTGKRQTFSVAPRGFAGEPLFVPFPNGVNEDDGWLLMLMYDAAEHRSDIVILDARDLNKKPVARLHLKHHIPYGLHGSFTPNYFQE

SEQ ID NO: 21551 - protein, 834 aa, Pseudomonas aeruginosa
MNLTRREFAKANAAAIAAAAAGLPILVRASNLVTEADVTSLVWNKAPCRFCGTGCSVMVATRDGQVVATHGDIKAEVNRGINCVKGYFLSKIMYGSDRLTRPLLRMKDGKFDKQGEFQPISWEQAFDIMAEKFKAALKAKGPESVGMFGSGQWTVWEGYAANKLFKAGLRSNNIDPNARHCMASAVMGFMRSFGMDEPMGCYDDIEATDSFVLWGSNMAEMHPVLWSRVTDRRLSAPQVKVAVLSTFEHRSFELADLPMVFKPQTDLIILNYIANHIIESGAVNRDFVERHVRFAHGAEDIGYGLRPDDPLEKKAKNADKANTWSDIDFKAFAEFVKPYTLERTARESGVPAERLKALAELYADPKRKVVSFWTMGFNQHTRGVWANNLIYNIHLLTGKISEPGNSPFSLTGQPSACGTAREVGTFSHRLPADLVVTNPKHRETAEKIWKVPAGTIQEKVGFHAVQQSRMLNDGVLNVYWTQVSNNMQAGPNVMQEVLPGWRNPDNFVIVSDVYPTVSAQAADLILPSAMWVEKEGAFGNAERRTQFWHQLVKAPGEAKSDLWQLVEFSKRFTTDEVWPAELLAKAPELKGKTLYDVLFRNGQVDRFPASDLAKGYANDEVDAFGFYIQKGLFEEYAAFGRGHGHDLAPFDAYHEARGLRWPVVDGKETRWRYREGYDPYVSKGSGVQFYGYPDKKAIVFALPYEPPAEAPDQDYPFWLATGRVLEHWHTGSMTARVPELYKAVPDALVYMHPEDARQLKLRRGSEVKVVSRRGEIRARVETRGRNKPPQGLVFVPFFDANKLINKVTLDATDPISKQTDYKKCAVRIELLNLA

SEQ ID NO: 21552 - protein, 164 aa, Zea mays
  misc_feature (44)..(44): Xaa can be any naturally occurring amino acid
  misc_feature (92)..(92): Xaa can be any naturally occurring amino acid
  misc_feature (104)..(104): Xaa can be any naturally occurring amino acid
  misc_feature (114)..(114): Xaa can be any naturally occurring amino acid
MAAAAIHQFAECITCHAWSPDQSMIAFCPNNHEVHIYKFFTDKXWEKLHVLSKHDQIVSGIDWSNSSNKIVTVSHDRNSYVWTQEGSDWIPXTLVILKFNRAAXLCVQWSPKEXNNFAVGSGAKSVCICYYEQENNWWISKVIRKRHESSVTSLAWHPNNVSLK

SEQ ID NO: 21553 - protein, 135 aa, Salmonella typhimurium
MRLLHTMLRVGDLQRSIAFYTNVLGMKLLRTSENPEYKYSLAFVGYGPETEEAVIELTYNWGVESYDMGNAYGHIGLSVDNAAEACERIRQNGGNVTREAGPVKGGSTIIAFVEDPDGYKIELIEAKDAGRGLGN

SEQ ID NO: 21554 - protein, 179 aa, Triticum aestivum
DLCQHVQTALHGRTFRVYASTDRFGVELGGALKNVYAIIAGMAVALNMGENTKSMLITRALAEMTRFAVSQGANPMTFLGLAGVGDLIVTCSSPKSRNYQVGFALGQGLSLDEAITRLGEVAEGVNTLKVLKAKAQELQVYMPLVAGLHAILFEGRTLEQVIELLMRAEPKTDVEKKKK

SEQ ID NO: 21555 - protein, 1039 aa, Desulfovibrio vulgaris
MVNLSLGRFSWRGQRREACRGLTFILRCHLLLLFLALSMAGAAWGASPRVLLLSSYGPAFPTFFQQVEGVRAVLASAGVVLDVEFMDSKRFTDESSVDHFESYLRYKLARLPAYDVVITSDDNALAFVMERHGGLLGKSPVVFCGVNNVGLARSLSGSETYTGVIEAVSMHETIKLVWSLKPSTQTLYVISDVMPAGKADLETFHDVVRGIASVRYQELSLENMGWEELGRRLQRVGANDAILLLSAYKDQRGVVRNFEEGLAFILQNTRSPVYHLWEHGMGKGLLGGKLISHYEQGRLAADMALKILAGASPASLPVIEGNDANAYLFDYEVLRRHGISTHRIPQGSRVINEPESIWRDYWRELLVAVAFVAVLCVLVVVLLKHVLRLREARTEIKRSETRYRLVFDQSPLGLVQYDGDGIIIDVNERFAELCGASRGQIIGFNYINQMHDARMLGAVLASLRGGIGGFEGVYTSPLGKKTAFIRCLFKGVKAPAGDVFIGIGIIEDVSDRKQAEEALRERELFLLETQRIAKIGGWKANIRTDYLFWSEEVNRILDLPEDYKPGLAEWLTSFMPEYLPRIRAMLEDVLHHGGTADIECEAMTRLGRRKWTHLRAVGRVDEGSGALVVGTFQDVDERKRTELELVEAKTKAVAANRAKDEFLANMSHEIRTPLNGIFGMLRMLADASLAPRQQELAEMAMRSCRRLADLLTDVLDISRIDAGKLEIVSIPFDLSRSIRQVRELFIPSAMQAGVSLHVHIDAAIPSRVVGDASRLQQVLTNLLGNAFKFTEKGSVTLRAEHLSPVLANSCRVLFSVEDTGCGIPDEKHGKLFTPFTQACEGFKRSHQGAGLGLSICRRIIRVMGGHLAFESEAGTGTTVYFTLNFGLPDGDEVQPEAAAASSAEPIPPLRVLVTEDDAVTRRYITYQLDRDGHTVAVAEDGRQALEQLSTGDFDMVLMDIQMPVMDGAEAILRIRKGEAGSRNTDIPVIALTAYALSGDRERLLQIGADDYVAKPAEVAQLHAAIARHVSRMQLRRADA

SEQ ID NO: 21556 - protein, 298 aa, Triticum aestivum
MGAEAKCDRIKGPWSPEEDEALRRLVERHGARNWTAIGRGIPGRSGKSCRLRWCNQLSPQVERRPFTAEEDAAILRAHARLGNRWAAIARLLPGRTDNAVKNHWNSSLKRKLATATGGGAAWEEASDSGDSPRPCKRASPGPESPTGSDRSELSHGSGQVFRPVPRPGGFDAISADVRPPPPRQDEDPITSLSLSLPGLEHGFHHDSARSHFQELSPSPRSPSPPPAPAPQPSSSYPFSGDLVAAMQEMIRAEVCKYMSGVGLPAGCGAGPVGEACIPQLVEGVMRAPAERVGVMTRQ

SEQ ID NO: 21557 - protein, 199 aa, Oceanicola granulosus
MDDRYKLLKPGHRIVDLGAAPGGWCQVAVDRTGSTAADVRVVGIDYLTVEPVAGATILLMDFLDDAAPDKLMETLGEAPDIVLSDLAAPTTGHRPTDHIRTMHLCDVAADFAIRTLKPGGHFLAKTFQGGTERELLTLLKRHFVSVHHVKPPASREGSVELYILAKSFKGKRAEVENLQDEVEDPRVHDQADEEAGPLG

SEQ ID NO: 21558 - protein, 210 aa, Kineococcus radiotolerans
MWQARPVARGTAPRAHPPDLLRTRENRVDAATAGTDLEHVLLSREQVAARIAELAAELDRDYADKDVLLVGVLKGAVMVMADLSRAMSIPLSMDFMAVSSYGSGTKSSGVVRILKDLDTDISGRHVLVVEDIIDSGLTLSWLLANLSSRGPASVKVCALLRKPDAAKVEVDVAYVGHDIPNEFVVGFGLDFADKYRNLDCVATLAPHVYS

SEQ ID NO: 21559 - protein, 347 aa, Bacillus cereus
MKDLIIIGAGQAGLTTGYYLKQEGYNFLLLEAGNRVGDSWRNRYDSLQLFTPKKYSSLPGMILKGERNEFPHKDEIATYLEEYARHFQLPIQLQTEVFKIKKEKDIFELHTPTEILQTKKVIIATGGFQQPFIPSVSANLSSHVFQIHSSQYKSPSQIPKGKVLVVGGGNSGMQIAVELAKTHEVTLSISHPLTYLPLHLFRKSIFNWLEKLGLLYAEVNTKRGKWFQKRKDPIFGFEGKELIRNGSIQLQEKVVSASENNIMFQNGETYSAERIIWSTGFIQNYNWIEIEKAVDENGLPNHVKGISPVRGLYYIGLPWQSQRGSALICGVGKDALYLLSEIKKIDQ

SEQ ID NO: 21560 - protein, 157 aa, Arabidopsis thaliana; identical to SEQ ID NO: 447

SEQ ID NO: 21561 - protein, 656 aa, Geobacter metallireducens
MSQGIFGIIDFRNAIADRDVLGNAMAAYLKMSGSGEFSVSTGLGHLIGMRRSAADSPSRQTRIEHDPDAGLAAVIHGEVNNYRELLSQHPPSGRPCCGDLDLVLRMYRRSGASFARSINGLFTIGILDEREKTFRLMNDRFGLAHQLYWTVADGRLIFATHLKTLLACPGVRRELDHEGLNLFLKYAYITSPWSILKGINKLPPGHMLTFRDGKAEVAPYWQFDAVTRPGMTMEEAIPAYRDLLRGAIARRMGSDGSTGVMLSGGLDSSANAALAASCSSTPVKTFAIGFEDPRFDERPFARIVAKHFGTDHHEYTITGREIDDLPSLVWHLEEPYFEFGLFLTYMGLKSASGHVQAVIGGEGADQMYGTGGFAGGRPAAVHYLFRKSGMIGPARTVSSLLRGPLFYDRDNLGFQLRLFWNRAADLNDWYFYGYDGHELSQLYRNGNLARVPRIFGEPAGSPESFAQVYLETQIEQDMRHYVNENVMVKSGRMADMLGLVLRESFLDADVADFLVSLPMPVKRGGGLVDHLRGRFKSKLLHRKAMEGILPPEIMSKPKQGGFVPVMIFLNDPALRKRIYEKLLRSEVMGEYFRTDYLRTLFEKYESFQQGAVGWPNFLNSKANRILFLLTFDIWHHCYLANDPLGVTPPSLNEYLG

SEQ ID NO: 21562 - protein, 485 aa, Mycobacterium tuberculosis
MSSSESPAGIAQIGVTGLAVMGSNIARNFARHGYTVAVHNRSVAKTDALLKEHSSDGKFVRSETIPEFLAALEKPRRVLIMVKAGEATDADAVINELADAMEPGDIIIDGGNALYTDTMRREKAMRERGLHFVGAGISGGEEGALNGPSIMPGGPAESYQSLGPLLEEISAHVDGVPCCTHIGPDGSGHFVKMVHNGIEYSDMQLIGEAYQLMRDGLGLTAPAIADVFTEWNNGDLDSYLVEITAEVLRQTDAKTGKPLVDVIVDRAEQKGTGRWTVKSALDLGVPVTGIAEAVFARALSGSVGQRSAASGLASGKLGEQPADPATFTEDVRQALYASKIVAYAQGFNQIQAGSAEFGWDITPGDLATIWRGGCIIRAKFLNHIKEAFDASPNLASLIVAPYFRGAVESAIDSWRRVVSTAAQLGIPTPGFSSALSYYDALRTARLPAALTQAQRDFFGAHTYGRIDEPGKFHTLWSSDRTEVPV

SEQ ID NO: 21563 - protein, 288 aa, Rubrobacter xylanophilus
MILNPTAGRGRAAALRPRISRFFEERGARAVWHVTRRPGHASQIVGELPPGLPAVAVGGDGTVHEVARACAGTGRPMGVLPAGSGNDYVKALGVGGDLRRAMEVVLAGEARAVDAGEVNGEFFDNGLGIGFDAEVAAGVVKAPAYLGGAGRYMWSVARLLWGFTCHPARLSFDDGTAVESETILVAVALGTTYGARFRLAPEARLDDGAFDVVWSDRVSRAEVIRLIPSALRGTLLRHPKVHMHRAREVEVELGRVVPAHVDGEILPPTRLFRARVLPGALRVLAPRG

SEQ ID NO: 21564 - protein, 454 aa, Mycoplasma mycoides
MKVIVLGTNHAGTTAVRTLKRLDPTCEVTTYDKNDAISFLGCGIALWVKGEVKDPNMLFYATPEILRSEGVNVFMNHEVLSVDDKAKTVTVKDLKTGEVKTDNYDKLIVATGTWPLIPPIPGIDLEGVQICKNYHHAKKILEHNLDKSYKKIAVVGAGYIGVELVEAFNEYGKDVTLIDVANRIMPVYYDQEFTDLMQEKMTKAGVKLSLGAKVIEFKGENGKVTQVVTDKGNIDVDYVIFSVGVRPQSAILEGICDLDDRKAIVTNDFMQTTNPDIYAIGDCAQVYNKAMNKNVPIQLATTAVRTGVIAAFNVIKGNGLKSPGFTGANGISVFGLHMASVGISVEAAKRMGYDVDFINFKDLDRPEFMSTANEVLFKVVWDKKTRKIIGAQVASEKNHTEVMYMLALGIQKDLTIDELPLVDIFFLPHFNKPFNFISLAGLEVLGLNYFKKEK

SEQ ID NO: 21565 - protein, 152 aa, Morus mongolica
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVIRLRGG

SEQ ID NO: 21566 - protein, 324 aa, Pseudomonas putida
MSRIFADNAHSIGNTPLVQINRIAPRGVTILAKIEGRNPGYSVKCRIGANMVWDAESSGKLKPGMTIVEPTSGNTGIGLAFVAAARGYKLMLTMPASMSLERRKVLKALGAELVLTDPAKGMKGAIEKANEIVASDPAQYFLPGQFENPANPAIHEKTTGPEIWNDTDGAVDVLVAGVGTGGTITGVSRYIKHTQGKAILSVAVEPVSSPLITQTLAGEELKPSPHKIQGIGAGFVPKNLDLSIVDQVATVTDEESKAMAIRLMQEEGILCGISCGAAMAAAVRLAEKPEMQGKTIVVILPDSGERYLSSMLFSDLFSEQENQQ

SEQ ID NO: 21567 - protein, 984 aa, Thermoplasma volcanium
MIVVEVGEVIEFYAGSKSLKGEKNQTILQALLLNGIDIPHICYHPSLGPINTCDTCLVDMNGKIVRSCSTYLEQGAKIDYNSNRVLELQREAVQRMLHNHDLYCTVCDNNNGDCPLHNAVHDLEIDNQKYPYEPKPYPVDDSNPFYVYDPNQCILCGRCVEACQDVQVNETLSIDWSRERPRVVWDNDVPINESSCVSCGHCVTVCPVNALMEKTMLGKAGFLTGLEKNTKQKMIDVVKSIEPEITMSPIMAISNIESKMRSSRIKKTKTVCTYCGVGCSFEMWTMGREILKVQPQPESPANGISTCIKGKFGWDFVNSKERLTSPLIRDGERFRRATWEEALDLVAKKLREIKDKYGGDAIEFIASSKGTNEEAYLMQKLARQVFGTNNVDNSSRFCQAPATTGLWRTVGYGGDSGSIQDIYMADLVIAIGTNTAESHPVLATRVKRAHKLNGQKLIVSDLRMHEMARRADLFLHPKPGTDIVWLSAVTKYILDKGWEDKSFIRERVSGFEDYVKSLEPFTMEFAEEATGISKETLMKVANMIHEAKNMVILWAMGVTQHQAGSDTSTAISNLLLITGNYGRHGTGAYPLRGHNNVQGASDFGAMNAYLPGYQPVSDPTVRKKFEDAWHCTIPEKPGLDNNTCLEGIMNGKIRAMYVVGEELVETGSDSNFIRDQLEKLDFLVVEDLFLSETAKYADVVLPASASLEKEGTFVNTERRIQRIYEVMAPLPGTRPDWQIIQDIANRLGARWNYGHPSEIMEEAASLSPIFAGVRYELLEGFKSLQWPVRSDGKDSPLLYEKEFNFPDGKARLYPLKYNPPLSSGLEFDLHLNNGRLLEHFHEGNETYKSPGIRSKVPGTFVEVSPDLAKERGLETGDLVRITSEYGSIKVSVLVSDRVSGKELYMPMNASGDSAVNLLTGRLMDPTAHTPAYKEVSVRLEKITGKRGPPPLPSTNPRNAIPHPQIGVQVEKKWARKDYVKLTTE

SEQ ID NO: 21568 - protein, 465 aa, Oceanobacillus iheyensis
MNSIGVFGLGVMGANLAMNMANKGEKVAVYNYTSDLTEKFKSNFTSDNAEAHYDLERFVNSLEKPRKVFLMVTAGPVIDSVIDSLVPLLDKDDIMMDGGNSNFNDSNRRYHRLKEAGIHFVSVGVSGGEEGALHGPALMPSGDEKVYQEVAPILEKIAAQVDGKACCGYLGKEGSGHYVKMVHNGIEYADMQLITEAYQFLRERLGLSVEEIATTFREWNEGELESYLMEITSDILTHVDEETNKPMVDVILDKSGQKGTGKWTSQNALDVGVPLSIITESVFARFLSGLKEERVRADQMLSGPTKLDQDLDKQAWLELVRKALFMGKICAYAQGFHQYKQASEAYGWDLKLEEIALIFRGGCIIRAGILNEISDAFKADKQLPNLLLSPFFQEKMNDYQASLRKVVIKGMESGLSLPSLGASLTYYDGYRSSQSGANMIQAQRDYFGAHTYERVDKKGTFHTAW

SEQ ID NO: 21569 - protein, 414 aa, Thermobifida fusca
MPTRPARSGLHSLAQLLRSDVVGGFLLIGGALTALIWANSPFGHVYEALRSFSFGPEALHLHLTVEAWVADGLLAIFFFVVGNELKQEFVHGELRNPRRAMLPIVAAVCGMAVPALIYAAFNAGDPARLPGWGIPMATDIAFAVAILAVVGRHLPSPLRTFLLTLAIVDDLGAIIVIAVFYTASLSFLPLIGAGMLLAVFGYLQRGRGVAARLNSAALPNWVVYLPLAGVIWALVHASGVHATIAGVAMGLLMRTVPLAGEKESPSHRLAHLLGPWSSGLVLPVFAVMSAGVVFAGGLGAVLDDTAALGIIAGLVVGKTVGIAGGSWVTTKLTAAELSPALRWIDITGMALLAGIGFTVSLLITDLSFPDYPEALVHAKAGVLLASLLATVLGAVVLAVRNAHYRKLRQAVSPQ

SEQ ID NO: 21570 - protein, 428 aa, Zea mays
  misc_feature (65)..(65): Xaa can be any naturally occurring amino acid
  misc_feature (128)..(128): Xaa can be any naturally occurring amino acid
  misc_feature (249)..(249): Xaa can be any naturally occurring amino acid
MNTVASLPLAPRLLIKPSLACFSRKDVGRYGGIKVYAVLREDGAEFARNNNLEALFQVDDPGPRXPVKKFLDVNEALEVVRFDIQYCDWRARQDLLTIMLLHSKVVEVLNPLAREFKSIGTLRKELAXELQQELEKAHNQVHLSEARVSSALDKLAHMETLVSAPSTAEPPTSSSLSATASSTARVRAKNKQPRRRLDVSGPVKPYNPSLKNFWYPVAFSSDLKAPDTMVPIDCFEEQWVIFRGKDGRXPGCVQNTCAHRACPLHLGSVNEGRIQCPYHGWEYSTDGKCEKMPSTNMLNVHIQSLPCFEQEGTVWIWPRDDPPKATIPSLLPRSGFTCSLLMQGVHGLGGGWRLGSSMAASSSCSTTRHSSSPRASAPLQVLHIIGREDRVQIDDARRLHRRAVTPAAMMPPYGTPPPYAAMYAQGTP

SEQ ID NO: 21571 - protein, 468 aa, Unknown
  Oceanospirillum sp. MED92
MKLVWFRNDLRTGDHHALYQACMDNTGEGVLGVAIITPVQWKIQDESKSRVQFWRANLESLSCDLQSLNIPLLILRVPSNREIPALLVELAKRYQVSGVYFNREYPLYEQQRDNAVISAMAEISVPCLSFDSDVVLPAGTVLNQQGLPFKVFTPFSKRWRQQYLTSNPQPLPVPPVQAKLDISTDSVPKEICYPITVGADWSSERWPAGTEAAHKLLQHYVLEKVADYKQSRDFPAEPGTSSLSPYLSVGVLSTRQCLAAMQAYFDQPEWFDSQWVTELIWREFYRHLLVLFPEMNRWEPFKPEVEEKLSWQYDESLFQAWCKGETGFAIVDAGMKELLETGWMHNRVRMITASFLTKLLRQDWRLGARFFMQHLIDGDFASNLGGWQWSASVGADAAPYFRIFNPMRQAERFDAKGRYVGQYVPSLQGLTSVQQHDPMFAASYSRPTPIIDYAYERQYSLDAYKAKS

SEQ ID NO: 21572 - protein, 560 aa, Enterococcus faecalis
MTEEIYDLIIIGGGSAALSAGIYAGRAMMDTLIIEKDKIGGQVTTTSEIVNYPAIRHTTGPELMEEMRIQAQDFGVAFTNDEIIDVDFSQTIKTVQSASQTYQAYAVLIATGASARKIGFPGESEFTGRGVAYCSTCDGEFFQGLDIFVIGGGYAAAEEAVYLTRYGKSVTMIIREPDFTCAKLTAEAAKNHPKIKIVYNIEVKEITGDDFVRKAVFVNNQTGEETVYEAPKDSTFGLFVFAGNKPSTEIFEGKIALDRGYVPTTENMETNIPGVYAAGDLRIKELRQIVTAVADGAIAATHAQRYVTEQKTQAGQSIVTKRMTERLANQSAPETSSQQPKEKQPAKVTGKHQWFPESMRQQLSGIFAKLTKKVTLLQFLDASDEKSLELQSFLTEFASLDQKITLETILKDTEPAKELLYGIEKMPSVVLLDAAGNYTGIKFSGIPSGHEVNSLVLAVYNVGSEGQPLEASLQKNILALPKRKIEIFVSLTCHFCPDVVAACQRIASINPHVEAEMVDISLFPELKKEKKIMSVPAMLIDGEQMIFGSKTMTEIIEALA

SEQ ID NO: 21573 - protein, 265 aa, Emericella nidulans
MSTPNIPHQGEFGCPGSFWLGLRTNLDDPEFFDFTEGFGEDFTDPTMLSPHLVPTGIMASKDSLGDVPAGTVSPSDLFMDASAPPSTSFTDLSTPSFDSPGYFSQDTSPVFGADLDLAPGHEEWAPLFPSNDGMSMPFDPTGLEIAAPVPAVKAEPTVSSPTVKPVSSPARSPTATSRSTTKHSTVAGVSARRTKPLPPIKYDESDPVAAKRARNTEAARKSRARKLERQGDMERRIAELSKELEETRQMVEFWKSQAQARARGA

SEQ ID NO: 21574 - protein, 248 aa, Aspergillus oryzae
MSTPNIAQDLPDFFDLQADRFGDDLVPTTEPTMLSPHQMTAGVMAGPDSLADLPSGTISPKDLFMDASAPPSASFTDLSTPSFESPGYFSQDTSPMFATDMELGPGVEEWGSLFPSQDDFSLGLDTTALDIAAALSQPKVKADVTPASPMIRTTSSRATSPSARSVTKPSHVAGVNARQRKPLPPIKFDSQDPVAMKRARNTEAARKSRARKLERQEEMQRRIDELEKSLEEAERREQYWKALAQNKA

SEQ ID NO: 21575 - protein, 416 aa, Helicobacter hepaticus
MVAFSLHFQTQHQKVCDTLFESICEERDSQKSGYYDLPFTEVAVDESSCFVNDNKAFLQTLSHLVIIGIGGSSLGLKAIDSMLEHLPHRNKLKLSFLEHTDPISITKSLQGIKRENTLFIVISKSGTTIETSSLLKFVLEEYNLLQNVQSKRHLLVITDRDSPLEHWAKVEKLTYFGIPPNVGGRFSVLSMVGILPLSILGFDTRAILRGAAGITQRFFERKEEHILHKALTYFTHKNHISMNVLFSYSSLFTHFNAWYVQLWGESLGKINAMGERVGLTPIALIGSIDQHSFLQLIVQGVRDKSVTFLSLNPTHSAQPSIPNLQIPFLESTNFVNTQSFATLLNNQRIATMQTIENEGILTDCIEVMSLCEESVGILIAYFEILTSCMGQLFEINTYDQPGVEFGKARLKKLFES

SEQ ID NO: 21576 - protein, 626 aa, Cryptococcus neoformans
MPADIPPDAKIKMANDLRKAIRELRDRGLMVAAKWASELLMSLPKEYRSTSNLVFSPPPQISSLPPRSPPGHARPSIGDFLPSPGPGAFAQAGPSRGRTMHGIEIEEEENVIEEDEFQLARGYFDLKEYDRVAWVLRDAQGSRAKFLRYYSMYLSADRKAQESLPHFLDTKEERLAFYPALSALLSELKKESDPYLIYLRGLCYMRLDRRPTAIKCFMDSVRLKPYNWSAWSQMAQLVSSADMFISLKEELPSTPMLTFFAINCMLDLHTATDLVMNMIKELLEIFPSSVHLKAQRALVYYHMRDFETAEEEFDAVQHLDPFRMEEVDIYSNMLYVMNKQAKLGKLAHEYAEIDRNRAEVCCLIGNYYSSRSDHTKAITYFKRSLMLNREYLPAWTLMGHEFVELKNSHAAIEAYRKAIDVNAKDYRAWYGLGQAYELLDMPMYAIEYYNQATSLRPYDCRMWTALATVYENLHRLPDAILAHTRALLGADRVQTMTILLKLASLHTTLDEIDKAVGYHRKVVALGEKSGLEVAEMAGSYLAVAEWEMRGVIQLQQREAREGKRLDRTNGDGDETMDGAEALKEADLALAAQYMERLAQTNAPQRDRAEELLRSLRVYEMRTVAAI

SEQ ID NO: 21577 - protein, 619 aa, Oryza sativa
MGAAFLSSWPWDNLGAYKYVLYAPLVGKAVAGRAWERASPDHWLLLLLVLFGVRALTYQLWSSFSNMLFATRRRRIVRDGVDFGQIDREWDWDNFLILQVHMAAAAFYAFPSLRHLPLWDARGLAVAALLHVAATEPLFYAAHRAFHRGHLFSCYHLQHHSAKVPQPFTAGFATPLEQLVLGALMAVPLAAACAAGHGSVALAFAYVLGFDNLRAMGHCNVEVFPGGLFQSLPVLKYLIYTPTYHTIHHTKEDANFCLFMPLFDLIGGTLDAQSWEMQKKTSAGVDEVPEFVFLAHVVDVMQSLHVPFVLRTFASTPFSVQPFLLPMWPFAFLVMLMMWAWSKTFVISCYRLRGRLHQMWAVPRYGFHYFLPFAKDGINNQIELAILRADKMGAKVVSLAALNKNEALNGGGTLFVNKHPGLRVRVVHGNTLTAAVILNEIPQGTTEVFMTGATSKLGRAIALYLCRKKVRVMMMTLSTERFQKIQREATPEHQQYLVQVTKYRSAQHCKTWIVGKWLSPREQRWAPPGTHFHQFVVPPIIGFRRDCTYGKLAAMRLPKDVQGLGACEYSLERGVVHACHAGGVVHFLEGYTHHEVGAIDVDRIDVVWEAALRHGLRPV

SEQ ID NO: 21578 - protein, 144 aa, Glycine max
  misc_feature (8)..(8): Xaa can be any naturally occurring amino acid
PFPPPCIXGFNESNLVPPLKWVENDPNVPIRRKDCFYGYLGPNQKKGSNVFVNWGKKNKIPPFLVVGGGPKICVLNFVCSPMSVKNRGFLGPLKNGGGFSRARPPLNVPLGGARNPQGALAPPPGFLPPVGLFLAKKRGAQIPN

SEQ ID NO: 21579 - protein, 570 aa, Myxococcus xanthus
MQQNVNQQVGMDGGDEDFAAMFEASLKERGGDGILKEGEIVKGTVVQVTKDFAIVDIGYKSEGQVPISEFTNPRGEVSVQAGDPVEVLLESRENDTGMVVLSKEKADKMRIWDEISAACERDEIVKGTIVGRVKGGLSVDIGVKAFLPGSQVDIRPVRNLDQYISKEFEFKVIKFNKKRGNIVLSRRVLLEKQREEMKKETLKNLKEGAVLKGVVKNLTDYGAFIDLGGIDGLLHITDMSWGRIGHPSEMFNVGDEVRVVVLKFDPTQERVSLGLKQIQEDPWHRADEKYPVGTRVRGKVVSITDYGAFIEIEQGVEGLVHVSEMSWTKRLKHPSKILEVGQEVEAVVLDIDPKAKRIALGMKQIEQNPWTLLEDKYPIGSVIKGQIRNVTDFGVFVGVEEGVDGLVHVSDISWTVRIKHPGEMFKKGDEVEAVVLNIDVENERFSLGIKQLQPDPWETLSERLPVGSRVKGKVTKVTDFGAFVEIEPGIEGLVHVSELKEERVENPRDVVQEAQDVEVKIIDINTPDRKVALSMKALIGEGEDYREYLRKQAEGSKARLGDVMASKLKK

SEQ ID NO: 21580 - protein, 375 aa, Oryza sativa
MESRRGGRDGGAAQRREGVAGEEEMERREDGGGAELLIDSSWRCRFERTNLGAVKEMRRVVRAVKRRRGGDAGAASPILGRCGVEWRGPWMTSAMTAAVSLSWSGGKAAARGVGGARADGGGVRPVGHLASERARDAGPEINQRMAGEGDDQLKLLGLWVSPYTHRVKLALSFKGLSYEYVEEDLSNKSELLLSTNPVHKKVPVLIHNGKPICESQVIVQYLDEEFPNSGVSLLPSDSYDRAIARFWAAYINDKLMPSWLQSSMGKTEEERAEALKQTLEAVANLETAFKECSKGKPFFGGDTVGYLDVSLGAMIGWMRAGEALHGRRTFDATRSPLLNAWMERFAALDAAKAAMPDNNKLVEFVRVRRAAAANN

SEQ ID NO: 21581 - protein, 414 aa, Lactobacillus acidophilus
MTELISIKDSSKHVDEEVKMHVWLTDKRSSGKIIFLQLRDGTAFFQGVVRKNDVTDEVFQAAKSLRQEASFYITGTVHEDARSHFGYEIQITNLKVVSNNEGYPIGNKEHGVDFLLDHRHLWLRSKKPFAIMQIRNTMFKATVDFFEKEGFIKFDAPIFMHSAPEGTTQLFHVEYFNNDAYLSQSGQLYGEAGAMAYGKIFTFGPTFRAEESKGRRHMTEFWMMEPEMAWMHQDESLDIQERYLAYMVKQVLDKNEYELKILGRDPEKLRPTTEGNFTRLSYDDAIKMLQDAGRDIKWGDDFGAPDEGYISEQYDRPVFIVNYPTSIKPFYMKKNPDNPKEYLCADVIAPEGYGEIFGGSEREGNYEVLNQQIEDAGLDLEDYQWYLDLRKFGGVPHSGFGMGFERTYCLGLSP

SEQ ID NO: 21582 - protein, 474 aa, Burkholderia vietnamiensis
MQPAEIGTPLRRTLGARHINLMALGATIGVGLFLGSATAIRLAGPSILLGYAFVGVFVFFVMRALGEMAVAHPVAGSFNRYAYEYIGPRAGFVTGWTYWFMWILCIMAEVTAVAIYMKFWFPGMPAWVWSLAALATMGLLNFVAVRAFGELEFWFAAIKIVTIVFMILSGIGIIGFGFGNGGVATGIGNLWRHGGFLPNGMWGLASAIPMVVFAYLGVEIIGLTAGETKNPEKSLARAVNSVFWRIAIFYIGALFIIMSLYPWNAIGTQGSPFVLTFERLGIRGAAGIINFVVLSAALSSCNSGIFGTARIVFNLAQQGQAPRIFAHTSKSGIPACAVVLTLVAALLGVLLNYVAPKGLFEWLTAIGTFAGLFSWAIILVAHYRFRRQRVAQDNRMLMPWWPYSSYCTLAFLAVLVAFMLKFDETRVAVIVGPLWLAFLWIVYGLSAKNGASRQGVPSPSASFAVEGVTRDIRD

SEQ ID NO: 21583 - protein, 343 aa, Unknown
  Populus tremula x Populus alba
MARSNIAGKSPSMVSIMLLFGLLLASLDATGAQIGVCYGMNGNLPPAQEVIELYSQRGIRRMRLYDPNQDALRALQGTNIELMLGVPNADLQRIASSQTNANAWVQRNVRSFGNVRFRYIAVGNEVRPFDSYAQFLVPAMKNIRNALYSAGLGNIKVSTAIDNGVIEDDSSPPSKGSFRGDHRPFLDPIIRFLLNNQAPLLVNLYPYLSYTGNSEDIRLDYALFTAPSSLVSDPPLNYQNLFDAILDTVYAALEKSGGGSLDIVVSESGWPTAGGTGTSVDNARIYNNNLVQHVKRGTPKKPGKPIETYIFSMFDETYKNPELEKHWGIFLPNKQPKYNINLR

SEQ ID NO: 21584 - protein, 652 aa, Saccharophagus degradans
MCGIAGLVSPSLPIDSLKATATAMAQAIEHRGPDAMGVWVEQEQKLAFSHRRLSIQDLSESGAQPMHSHSKRYTIAFNGEIYNFLEIKKPLIDAGFEFRGHSDTEVLLCAIEHWGLEQTIAKAKGMFAIALWDSQTKVLTLIRDRIGEKPLYYGVINGSFVFGSELKAIFAHTPAKALTLNKVAIASFLRHGYISAPNSVFVEVKKLSPGCRIDINLAKQSDWSIANLTPQPYWTVAQSANQPYLYTEQNQSEAISALDEKINKVINEQSIADVPLGAFLSGGIDSTVVSAVLQANTSTAIDTFTIGFEEKSFNEAEFAKEIAKHLGTKHHEHYVNQQDILELVNILPRVYDEPFADASQLPTILVNRFARSELTVCLSGDGGDELFAGYNRYVFTEAVLKKAAALPAVFKSILKALITSVAPGKWDKLYQALNSIAKRKGGAEFGNKLYKMVSLADAKSKAAAYEYLMSYWQQPEQVLKAFNGELAMQSPLSLEDDFINAAMAWDQQWYLPGDNLTKTDRASMAASLELRAPLLDIELIDFAWTVSPELKVRDGKSKWLLREVLYKYVPKELIERPKMGFSVPISQWIRTDLSAWVDELLDKEFIEKQGIFNYAPIQHALLEHRSGSYDHGKKLWTLLMFQAWFKTNIIDG

SEQ ID NO: 21585 - protein, 173 aa, Citrus sinensis
MAARMLEPLAVGGVIGDVIESFTPSIKMSVTYDNKQVCNGHELFPSTVVSKPRVEIQGGDMRSFFTLVMTDPDVPGPSDPYLREHLHWIVTDIPGTTDATFGRELVSYEIPRPNIGIHRFVFVLFKQTRRQTVNPPSSRDHFNTRAFAAENDLGLPVAAVYFNAQRETAARRR

SEQ ID NO: 21586 - protein, 127 aa, Oryza sativa
  misc_feature (23)..(23): Xaa can be any naturally occurring amino acid
  misc_feature (39)..(39): Xaa can be any naturally occurring amino acid
MPTVSPSASTSVVARSVLTGPLXLPQMRARRSERVRCTXSPAAAKQPARDRGKATAMATVSAAAATAAPAMALVDERMSTEGTGLSLGLSNNLLGWILLGVFGLIWSLYTIYTSDLEEDEESGGLSL

SEQ ID NO: 21587 - protein, 472 aa, Bacillus cereus
MNHLRGGSEVANKELKRGLEARHIQMIALGGTIGVGLFMGSASTIKWTGPSVMLAYAIAGIFIFFIMRAMGEMLYMEPSTGSFATFGHKYIHPLAGYMTAWSNWFQWVIVGMSEIIAVGAYMQYWFPDLPAWIPGVIAMVILGAANLISVKSFGEFEFWFAMIKIVTILLMIIAGFGLIFFGIGNGGEAIGISNLWSNGGFFTGGFSGFFFALSLVVGAYQGVELIGITAGEAKDPKKTLTRAIQSTIWRILIFYIGAIFVIVTVYPWDQLSTIGSPFVATFAKVGITAAAGLINFVVITAAMSGCNSGIYSAGRMLYTLGVNGQAPKYFTKLSGNGVPLFGTVGVIIGLAVGVVLSYIAPKNLFVYVYSASVLPGMVPWFVILISQINFRKEKGAEMKDHPFKMPFAPVTNYLTIAFLIMVLIGMWFNDDTRISLVVGIVFLAIVTISFYAFGIGKRPPLDVPNDQEISSK

SEQ ID NO: 21588 - protein, 349 aa, Ureaplasma parvum
MSQMENSTKKVESVANVEVVTTENAKVEQKPTSPADAIQLKVNANSTIKNLKTLVSIVKLTESGAHIGLNPKKWNPKMASYIHAKRSNNHVIDILKTILFLDRAYKFLQEVSQNGGTVMFVGTRGRVVKELIKAEAERTNSFYVTQRWLGGTLTNFTNISRSLKKFNSNLALLESEEINKYSKKEQIAINKETAKLEKFYGGIKNMKQRPDVLILVDPVNDVNAIKEARKLNIPVIALANTNADPQLIDYIIPVNNYSVKSITLILGVLADSIAELHGEPTKIVGRPDSEIVLPETKSNWKQNNYDPSKRGYNPKYVNHKSTFNKFNNKKPVDSTTNEIKTNVIKAETK

SEQ ID NO: 21589 - protein, 838 aa, Bradyrhizobium japonicum
MTSPKLDRRQMLKLEAAAIAAAAAGLPVPALAANLATEREVSELKWDKAACRFCGTGCSVMVATKENRVVATHGDIKAEVNRGLNCVKGYFLSKIMYGHDRLTQPMLRKANGKYDKNGDFTPVSWTEAFDIMEVKWKEAMKKRGPNGVAMFGSGQWTIWEGYAASKLFKAGFRTNNIDPNARHCMASAVAGMMRTFGIDEPPGCYDDIEATDAFVLWGSNMAEMHPILWTRLTDRRLSAPHVRVAVLSTFEHRSFDLADIGMVFKPQTDLYLLNAIANHIINTGRVNKDFVAAHTVFRRGQTDIGYRVRPEHPLQKKATGAAKANRNDPRQDYDEYVKFVSEYTLEKAAEMSGVPLNRLEALAELYADPKTKVVSFWTMGFNQHTRGVWCNNLVYNIHLLTGKISSPGNSPFSLTGQPSACGTAREVGTFSHRLPADMVVTNKEHRTKAEHIWQLPEGTIPDKPGAHAVLQSRMLKDGLINAYWVQVNNNLQAGPNANEETYPGFRNPDNFIVVSDAYPSVTALAADLILPTAMWVEKEGAYGNAERRTQFWHQLVPAPGESKSDLWQLMEFSKRFKIEEVWPEELIAKKPEVRGKTLFDVLYKNGQVDKFPVSDIEQGYLNDESKAFGFYVHKGLFEEYASFGRGHGHDLAPFDAYHKERGLRWPVVNGQETRWRFREGSDPYVKQGTDVQFYGYPDGKARIFALPYEPAAESPDGEYPFWLSTGRVLEHWHSGTMTRRVPELYKAFPEAVCFMHPDDAQEAKIRRGDEVKVVSRRGFIRVRVETRGRDRPPRGLVFVPWFDESKLINKVTLDATDPISLQTDFKKCAVRIERVNVS

SEQ ID NO: 21590 - protein, 414 aa, Colwellia psychrerythraea
MADNKTHLVQQSRRQFLRKASMLALGASPLLSLAATDNNEGVSLAGGMRPLVKYPGKRDLILVHSRPPHLETPFSVFNESLITPNDAFYVRYHLANFPTEIDLKKYKLNINGAVNKTLQLSLQELKSMAEPVDVVAVNQCSGNSRGYSSPRVFGAQLSNGAMGNARWTGIPLRTVLEKAGVSPEAMYVTFNGLDKPVLPTTPDFIKALNIEHALSPEPLLAWGMNGEDLPFLNGYPLKLIVPGYFGTYWVKHLSEITVLDTEFTGQDSYFMNTAYQLPDNDCLCVTPGSTAEKNRPISTLPVRSFITNISADDTLSSAKPIELEGIAFDDGSGIKNVDISIDGGLTWLTSTLGESLGRFSFLPWKLTVSFAQKGKATVMVRASNNNGEVQPLRASWNHGGYRRHAIESVAINVI

SEQ ID NO: 21591 - protein, 85 aa, Glycine max
VLAGTPELYRDLVNLNVVASMVGLLNHDNTDIAIGVVQVLQDLTGEDVFDDNDDYARVLGDALVNNSALGLLVQNLYWLNDYDPD

SEQ ID NO: 21592 - protein, 754 aa, Methanosarcina barkeri
MIEEINLRVAEAYHKDVGRGIARIDTRLMQQMGLVSGDIIEISGRAKTYAIVWPNVEREQENRIRIDGNLRSNAKVGIDDRVTIQKVQAKNAQRVTLAPSQPVRLVGGAHYILRIIEGRPLNKGQQIRVETVNNPLTFVVASTRPAGPVVVTKDTDIVIKEKSAEEIRVPEGISYEDIGGLRREIQLVREMIELPLRHPELFQKLGIEPPKGVLLHGPPGTGKTLIAKAVASETDANFITISGPEIVSKYYGESEQKLREIFEEAEKEAPSIIFIDEIDSIAPKRGEVTGELERRVVAQLLSLMDGLNSRGEVVVIAATNRPNSIDEALRRGGRFDREIEIGIPDRNGRKQILLIHTRGMPIQDVSLSEIADVTHGFVGADLSSLCKEAAMHALRRITPEIDIEEDEIPQEILDKLVVTKDDFKEALKNIEPSAMREVYVEVPHVGWEDIGGLENAKQELIEAVEWPLKYPELFSSINIKPPRGVLLFGPPGTGKTLLAKAVASESEANFISIKGPELLSKYVGESERAVRETFRKAKQAAPTVVFFDEIDSIAPQRSSVSDTHVSERVVSQILTELDGVEELKDVIIVAATNRPDMVDPALLRPGRFDRLIYIKPPDNISREKIFEIHTQGKPLAEDVNLSELADMTEGYVGADIEGICREAAMLALREIVTPGASRKDIEKRAGEVIISKKHFERAIRRVKPTTSRESLAAYERSAELFAKYATEFEEEAPEAEEQEKELEHENVPDFFQAQ

SEQ ID NO: 21593 - protein, 181 aa, Unknown
  Marinobacter sp. ELB17
MPKHFEQAPGLHHEPVPETEGFVFNQTMLRVKDPQKSLDFYSRVLGMRLVRKLDFPEMKFTLYFLGYLDERQASTVPTDDAHRTTYTFGREAMLELTHNWGTENDDDFAYHNGNDQPQGFGHIGIAVPDVYSACDRFEALHVDFVKKPDDGKMKGLAFIKDPDGYWIEILQPDMLEYQRKD

SEQ ID NO: 21594 - protein, 481 aa, Nostoc punctiforme
MSDLILFWHRRDLRISDNTGLAAAKRRSPKVVGVFCLDPHILERDDVAPVRVTYMIGCLQKLQERYAQVGSQLLILHADPVQAIPALAEAINAKAVFWNWDVEPYSQERDRTIINALKEKGIEFLNQNWDQILNSPDEIRTGGNSPYTVYTPFWKNWITKPKANPVETLQNVEGLTEAEQEIAKLSGSLTLPSAKDLGFIWDEQLIISPGEAAAQERLEEFTNKAITEYQEQRNFPAVDGTSQLSAALKFGVIGIRTVWQATIEALENSRSEETAVNIRTWQQELAWREFYQHAMYNFPELADGAFRDTFKNFPWETNEEHFQAWCEGRTGYPIVDAAMRQMNESGWMHNRCRMIVASFLTKDLLINPQLGEKYFMKHLIDGDLSANNGGWQWSASSGMDPKPVRIFNPASQTQKFDPEGEYIRQWVSELRSVDTEYLVTGKIPPLERHAVGYPDPIVDHKIQQNQFKLRYQQQKNTSGGE

SEQ ID NO: 21595 - protein, 423 aa, Erwinia carotovora
MYDTSLTLTEFDPELADAILHEEDRQETHVELIASENYASPLVMAIQNSVFTNKYAEGYLGKRYYSGCEYVDVAERLAIERAKVLFDCDYANVQPHAGAQANAAVFLALTNPGDTVMGMNLAQGGHLTHGNPSNFSGRHYKIVPYGLDSETGLIDYDEMERIALETRPKMLIGGFSAYSRHKDWARMRTIADKVGAIFWVDMAHVAGLVAAGEYPNPLPQAHVVTSTTHKTLRGPRGGIILAKGQSEDFYKKLNAAVFPGIQGGPLMHVIAAKAVAFKEALRPEFTVYQRQVVANARAMARIIQQRGYKIVSDGTDNHLLLIDLSAKPYTGKDADAALSDAYITTNKNSVPNDPRSPFVTSGLRIGTPAVTTRGFGVTECEQLAGWLCDVLDGLGAGNEELTVIRDRVREQVVALCHRYPVYQ

SEQ ID NO: 21596 - protein, 107 aa, Unknown
  Dehalococcoides sp. CBDB1
MVMEITDQSFAAEVLKSDKPVLVDFWAPWCGPCRMVAPIIDKLSTKYAGKFKFCKLNVDENKTTATQYRVMSIPTLLFFKGGQVADMVVGAVPESALSQKIDQLIQK

SEQ ID NO: 21597 - protein, 348 aa, Schizophyllum commune
TSNDLLQPFLALDQGDKVQAEYVWIDGDGGLRSKTTTVSKKVTDIGQLRIWDFDGSSTNQAPGNDSDVYLRPAAIFKDPFRGGDNILLLAECYNNDGTPNRTNHRHNAKKTMDLAKDEHPWFGIEQEYTLFGEDGRPYGWPKGGFPGPQGPYYCGAGAGKVFARDLIEAHYRCCLYAGINISGINAEVMPSQWEFQVGPCEGITMGDHLWMARYLLIRVAEQWGITVSFHPKPLAGDWNGAGGHTNYSTEGMRNPGGIQAISAAIEKLAKKHNEHIAVYGEDNDLRLTGRHETGHIGSFSSGVANRGASIRIPRNVAAQGFGYLEDRRPASNIDPYRVTDMIVQTTCL

SEQ ID NO: 21598 - protein, 128 aa, Medicago truncatula
MELGLDSRKLQLQPQNLKQEHFHVLAVDDSVIDRMLLERLLRDSSCKVTCVDSGDKALKYLGLNIDEISSTKSSILESSSPSLPQPLQLQEGNKVNLIMTDYCMPGMSGYDLLKRVKVKISSFPRHLP

SEQ ID NO: 21599 - protein, 158 aa, Thermobifida fusca
MARRIDYLNDPNAPKANSIVPSVNIAVRDDTGRLLLICRSDNGNWALPGGAVDVGERLTEAGVRETLEETGIRCAITGLVGIYTDPGHVIHYTSNNEVRQEFSIVLAARAVAGAPTPSSESTHVRWVAPDQIDHYRIHPSMRLRITHALEDRTTPYLG

SEQ ID NO: 21600 - protein, 603 aa, Nicotiana tabacum
MMMFEEMGFCGDLDFFPAPLKEVEVAAPHTEPEPELVVDDDYSDEEIDMDELERRMWRDKMKLKRLKEMTKSKEGVDPAKHRQSQEQARRKKMSRAQDGILKYMLKMMEVCKAQGFVYGIIPEKGKPVGGASDNLREWWKDKVRFDRNGPAAIAKYQADHAIPGMNEGSNPVGPTPHTLQELQDTTLGSLLSALMQHCDPPQRRFPLEKGVSPPWWPTGQEDWWPQLGLQKEQGPPPYKKPHDLKKAWKVGVLTAVIKHMFPDIAKIRKLVRQSKCLQDKMTAKESATWLAIISQEEALARELYPDRCPALSSAGASGTFILDDSSEYDVEGAQDEPNFDVHEQKPNHLSLLNIGVERFKETLPLQQQSHPNKDEFITNLDFTRKRKQANELTVMMDQKIYTCEFQQCPHSELRNGFQGKSARDNHQFACPFRNSSQFGVSNFNFNEVKPVVFPQQYVQPKSASLPVNQGPPTFDLSGVGVPEDGQRMITELMSFYDSNIQGNKSQNTGNVALTKEQPHQQPRVNQDNYLHSQGIMEGNIFKDANISTSHSMLPQASPFNAGPNDNFHFMFGSPFNLQSANYTGNLPGIGYDTTPKQNLPTWY

SEQ ID NO: 21601 - protein, 547 aa, Cryptococcus neoformans
MPPRITSRALSTLSTAQSSAGSSSTLPPSTFSLRQHKRSPSSHSFTFRHFGPLLAHPRNPSTASLGWRRSFHSSTVHPASAKDPYNVLGVNKDASSSDIKKAYYSLAKKWHPDSSKEKDAKEKFHEIQAAYDILSDDKKRQAYDRYGSASTQEGFDPNFAHGAGGFGGFQGFGPGFGDGASDLFESLFGGAFGGGSSAFGGRQRPVRGDDLEVGVNLSFLEACNGVTRKVTVTPVIDCKTCTGSGLKPGEKKSQCPACRGSGQRTFQVQGMVMASTCQTCGGTGSTIPKNARCGECDGVGKVKEKKVLDVEIPAGVEDGMMIRVPGAGDKPLSASGPAGDLLVRVLVKPSSVFRRQGVNLYHDAKVPLHIALLGGVIRIPTLEGDVDVKVKNGTQNGEEAVLKGRGVKSVYGGRRNDRGDLIVGWKVQIPRSLTPFQRKILQAYADDIEGRNPQVHFGPLPSDPPVTNPSSPPKEPTNGEGSYPSYRSQNQPQAEHAPHRPSRPPAEPYKPYNPLSSSEEPISLANKIASAIGGAIGWVERFMRGRR

SEQ ID NO: 21602 - protein, 868 aa, Aspergillus nidulans
MPSQEEVVKKFQRIGIVGSGNMGSMMAFAFSEIGLDVSIWDVKYDNVQQLLESAKNTNYKGKIEGFKDVSKFTQSLEGKAERKIFLFSITHGDPADSVLDMIKKDLKKGDIILDGGNENYRRTEARQKICEKIGVSWIGLGVSGGYQSARRGPSLSPGGDKEALDLVMPLLELYAGKDAKSGQPCVTRIGPKGSGHFVKMVHNGIEGGMLSTLAEAWSLLHYGRGMGYEEIADLFESWNKEGVLRNNYLLEIGAELLRVKKTPQGDGNGEGVGDGGFVLDDVLDKVVQDDDNTEGTPYWSVMESASRHISAPTLATAHFMRIASGNRIERLEVAKQLRIPSPSPIRGMKDIEAFKEHLHSAVYSSFLASFCQGLELIARASEDEGWDIDLGKCLQIWRSGCIIRSEGIADILQPAVSGNKGIKNMKYIDTVAQELHRTYPSLKEIVMAATDSDHYIPAISATLEYLKYEGGTNLPTKFMEAQMDFFGAHGYNLPGVPGEDPGPVIGGCSFAPSPLSPNPFEESSPRNNSHAEWLFSPTPTPVSPQTLHPVRIAVIGGTGLRELPGFTQVASLNIQTPWGTPSSPITILHHTHKDKTVAVAFLSRHGLHHQIAPHEVPARANIAALRSIGVRTIIAFSAVGSLQEEIKPRDFVVPDQVIDRTKGIRPFTFFEGGVVGHVPFGDPFDESVAKIVRACGHSLEGEGVKLHDRGTLICMEGPQFSTRAESKLYRSWGGSVINMSCLPEAKLAREAEIAYQMICMSTDYDCWHESTEDVTVEMVMGNMKANAVNAKHFVTAVLDELADDRNAELVQAKQYAGSVKFGLSTAQANWSPEARERMNWLFPGYFEIDLYIRYLLLIQRDIDLTSWN

SEQ ID NO: 21603 - protein, 338 aa, Listeria innocua
MTQKKVAILGAGSWGTGLALVLADNNHKPVIWGNLDKIVNEINESHTNSHYLPDIILPTEVKATLSLDEAIDGAEIVVIAIPTNAMRVVCKQLNEALKEPTILVHVSKGIEPETNLRMSEVIEEEVDATKRKALVVLSGPSHAEEVALRHPTTLCASCKDLKAAEIVQDRFINNNLRIYTNDDVIGAEIGGALKNIIALGAGISDGLGYGDNAKAALMTRGMAEITRLGVAVGSNPQTFYGLTGIGDLIVTCTSVHSRNWRAGNMLGKGENLDEVLEKMGMVVEGVRTAKAVHGWAKKLDIDMPITESIYAILFENKDAREAVDLLMGRKKKIEKESF

SEQ ID NO: 21604 - protein, 460 aa, Cryptococcus neoformans
MTAELTPSIEEQALTSPGPFEGPEKLLEVWFAPSIEELPSAEEVEGKVAGGLNARPAKENGEWQGLRKVPREVWEEMLDIVKCKVLSMVEGDDLDAYLLSESSLFVAPHVLILKTCGTTLNLLGLYRIIEIAREYCGFNNVWRCFYSRKSFFFPERQQGPHRDWRDEVQFLDSVFGTAGAAYTVGPMNRDHWLLYLTTPNSQPILPSDPKPCTLSLPAPSPSSSIPTFSSSSTVTYQDTTLEILMTHLSPSARAPFFHDSDSFSSPSTTPGHVLGEAISHKLGIDALFSKDETTLDSFGFDPCGYSANAVIGSGLPVSGKGGKEGGGYFTIHVTPEEGWSYASFECNVPLPFSSSSSPGALAKRPDLQTLIRNVVNIFQPSRLSITLFVSTPPSSSGPGSSEAEVKAWNSFGTDLLGNEFVRKDRIGYEFDGYDLVFACFEKKGWVESQLALGSETKKSL

SEQ ID NO: 21605 - protein, 503 aa, Cryptococcus neoformans
MPPRITSRALSTLSTAQSSAGSSSTLPPSTFSLRQHKRSPSSHSFTFRHFGPLLAHPRNPSTASLGWRRSFHSSTVHPASAKDPYNVLGVNKDASSSDIKKAYYSLAKKWHPDSSKEKDAKEKFHEIQAAYDILSDDKKRQAYDRYGSASTQEGFDPNFAHGAGGFGGFQGFGPGFGDGASDLFESLFGGAFGGGSSAFGGRQRPVRGDDLEVGVNLSFLEACNGVTRKVTVTPVIDCKTCTGSGLKPGEKKSQCPACRGSGQRTFQVQGMVMASTCQTCGGTGSTIPKNARCGECDGVGKVKEKKVLDVEIPAGVEDGMMIRVPGAGDKPLSASGPAGDLLVRVLVKPSSVFRRQGVNLYHDAKVPLHIALLGGVIRIPTLEGDVDVKVKNGTQNGEEAVLKGRGVKSVYGGRRNDRGDLIVGWKVQIPRSLTPFQRKILQAYADDIEGRNPQVHFGPLPSDPPVTNPSSPPKEPTNGETKKEIGEEGRQTKSEEDEVGGKI

SEQ ID NO: 21606 - protein, 608 aa, Nicotiana tabacum
MMMFEEMGFPGNFEFMSDPLGCGGDVAQEVEHKPTGVEENYSDEEMDVDELERRMWRYRMLWRRLKEKNKNKEVGGDGAKQRQSQEQARRKKMSRAQDGILKYMLKMMEVCNAQGFVYGIIPEKGKPVTGASDNLRAWWKEKVRFDRNGPAAIAKYQADNQIPGRIEDSSVIVSTPHTLQELQDTTLGSLLSALMQHCDPPQRRFPLEKGVAPPWWPSGKEEWWGQLGLPNDQVPPPYKKPHDLKKAWKVGVLTAVIKHISPDIAKIRKLVRQSKCLQDKMTAKESATWLAIINQEEALARKLYPDSCPQGSLAVGNGSYFISDTSDYDVEGVDDERNNEVECKPHDINLLTGIMVPKERILMPALAPVKGEIIDLTSDFIQKRKHPSFEESVDQKLYTCEYLHCPYSNYQAGFLDRTSRNNHQMDCPFRFNSAQRLGMPPKYQINNENNTVFPTQTATPKPATSSVTASSSMTVSGLGLPEDGQRMISDLFTFYDNNLQQNSSICSGNSKILANQNMQQNQTVELPMDDNFNLGHMEAEAQETSMTMNSAYTSTEFQYDQCKLPFDAPFTGNLNDITDYRFGSPFNMGGSDYSMDQLTKQDISTWYL

SEQ ID NO: 21607 - protein, 381 aa, Listeria innocua
MSEDLFDVEVRNFEEGDKVTGTVTSVEDKQVYVGIPDSKLDGVVPISELSNIHVETASDVVSVGDTLDLIVTKVEDDVLVLSKRKVDAEKASDDIKAKFESGEVFEAVVSDVVKGGLVVDLGVRAFVPASLVEDHFVEDFADYKGTTLTFKVVEFEPENNRVILSHRAVVENEKANQKQALLNEIKEGDVIEGTVQRLANFGAFVDIGGVDGLVHISQISYKHIATPQEALEEGQKVKVKVIGIDPENERISLSIKATLPGPWDGISEKAPVGSVLEGKVVRLVTFGAFVEIFPGVEGLVHISQISHEHIGTPQEVLSEGQTVEVKVLEVNEDDKRLSLSIKDLQDAPVEEADYELPEESTGFQMSDLIGDKLKGLQNDDK

SEQ ID NO: 21608 - protein, 376 aa, Shigella flexneri
MAKQDYYEILGVSKTAEEREIRKAYKRLAMKYHPDRNQGDKEAEAKFKEIKEAYEVLTDSQKRAAYDQYGHAAFEQGGMGGGGFGGGADFSDIFGDVFGDIFGGGRGRQRAARGADLRYNMELTLEEAVRGVTKEIRIPTLEECDVCHGSGAKPGTQPQTCPTCHGSGQVQMRQGFFAVQQTCPHCQGRGTLIKDPCNKCHGHGRVERSKTLSVKIPAGVDTGDRIRLAGEGEAGEHGAPAGDLYVQVQVKQHPIFEREGNNLYCEVPINFAMAALGGEIEVPTLDGRVKLKVPGETQTGKLFRMRGKGVKSVRGGAQGDLLCRVVVETQIGLDEKDKQLLHELHESYGGPTGEHNSPRSKSFFDGVKKFFDDLTR

SEQ ID NO: 21609 - protein, 639 aa, Arabidopsis thaliana
MDTPDKNRISAVSFCNFEDSPVFQYINDLSPIEPVKPGRPENILHSLVFTSPSSSSSLFCSPQLNSYRDSRFFIKRHRSLDLSSPVVLIGETLKNSPDALWEEKLKCRPEKLENVSEPKPFKEQISLAIELANSLKHGRDGCDIQMVSCDEVPMDADDEIGSGGGSRELSDELCRQSFDPLDFDADSDGVLHTDEMEAESGFGKEVIMFDVADIQNYEQQIPRTTDPRFYSLASEPQQFSIYCNNSNYVEEREGSCSVQVAAGAPDINLSCSSKVAAIDSTAEAEDKEDKDLQPSGKQRSVRRRCLTFDMGGSHKRIPLRDSTNDLPLDSTSINKAPSPQNCLDTSKQDTDEILPIPRTIGLHLNGFVNPSVSSGRKKKKIKDGQAFPSTTFHYNIEDEFSTPVSTKRDLVVFSDVKIMEPPERSVEGECFDQLMAMENRQLSQGLDELGSCKRCKCRKSQCLKLYCECFSAGLFCGEPCSCQNCFNKPIHEDLVMKSREVIKARNPLAFAPKVVSTSDTVIDLWVENSKTPASARHKRGCNCRKSGCSKKYCECFMMGVGCSSNCRCMGCKNTFGHTNEQCAGDSDVVTINDEAKHYGDHGDASRQNEEILTSERNRLLLPGSVAFRSLTSLSNLSEL

SEQ ID NO: 21610 - protein, 204 aa, Arabidopsis thaliana
MKVFSADFQADNVPEGRRASAFGILTGITSCAFVCANLSARFLSIGVTFQVAAAMGILSTLYMRLFLPDSIRDNSLGAPIVINEKLSSPLLEDCPGHRNRIFRAIRLVHEMASLMRSSVPLFQVAMVSFFSSLAEAGLHASSMYYLKAKFHFNKDQFADLMIIVGASGSISQLLFMPVLVPALKEERLLSIGLFFGCAHVRTVF

SEQ ID NO: 21611 - protein, 151 aa, Alteromonadales bacterium
MINNMIKRLFSKSKSKSKKVDQTPTPEKTPYEIIGGEKGARAISERFYDIMASDEYAKPLYDMHPQPLDRIRQVFFEFLSGWLGGPPLFEQNHGQPMLRKRHMPFLIDQSLRDQWMYCMNKTLDIEIDNPLLREGLKNSFAQLASHMINQH

SEQ ID NO: 21612 - protein, 124 aa, Legionella pneumophila
MTESLFERLGGQNAVNTAVDIFYRKMLMDDRVNYFFDDVDMEQQILKQKGFLTMVFGGPNQYTGKSMREGHQHLLARGLNDSHVDIVIEHLGETLKELGANEEDIQKVAAIANSVRDDVLGRSS

SEQ ID NO: 21613 - protein, 106 aa, Unknown
  Malus x domestica
TDVPAPDMGTNAQTMAWILDEYSKFHGHSPAVVTGKPIDLGGSLGREAATGRGVVFGTEALLAEYGRSCKGLTFVIQGFGNVGSWAAKLIHEKGGKVIAVSDITGA

SEQ ID NO: 21614 - protein, 336 aa, Glycine max
MGRQPCCDKVGLKKGPWTAEEDKKLINFILTNGQCCWRAVPKLAGLLRCGKSCRLRWTNYLRPDLKRGLLSEYEEKMVIDLHAQLGNRWSKIASHLPGRTDNEIKNHWNTHIKKKLKKMGIDPVTHKPLSNKTEQTQAQPDEQQTHQPLQEQQEEPIPVEKDTKFEPEKEQNKEPEKPESSIESLTITEEAKEEDQIMTPLFDSWELMNEFCTDEVPIIESNEILVPSAPSSTSPTTTTTTSSSTSTSASSNSNSSNFLEDLLLPDFEWSDDYNDTNFDNNNNSSMALWDDDFIRSWNLLINDDDGDGDRKQVFEAPINQYPRVIMDSDSWAYGLF

SEQ ID NO: 21615 - protein, 283 aa, Prochlorococcus marinus
MTNIQTWIDEYHKGSRFGLNGDVLIKQKSQYQEIIVIENEYYGRALMLDGCWMTSLKDEKYYHECLVHPALSSIDEKSNVLIIGGGDGGTVRECVKYAQISKIDLVEIDEEVIKISKKFLKEIGGEAWHDKRLEIHVDDGVKWVKKTRDNYYDVIFIDCSDPSEFSNLLFSDSFYKECKRILTPKGILATQSESPESFKNIHINILKTLKNIFKVSETMYSFVPIYPSGIWSWTFASSEDLNLSKQNYDEILKIEKGCEIWNLNFQNAAFKMMPNKIIKELDS

SEQ ID NO: 21616 - protein, 346 aa, Nicotiana tabacum
QFLFSLQMAHLIVTLLLLSVLTLATLDFTGAQAGVCYGRQGNGLPSPADVVSLCNRNNIRRMRIYDPDQPTLEALRGSNIELMLGVPNPDLENVAASQANADTWVQNNVRNYGNVKFRYIAVGNEVSPLNENSKYVPVLLNAMRNIQTAISGAGLGNQIKVSTAIETGLTTDTSPPSNGRFKDDVRQFIEPIINFLVTNRAPLLVNLYPYFAIANNADIKLEYALFTSSEVVVNDNGRGYRNLFDAILDATYSALEKASGSSLEIVVSESGWPSAGAGQLTSIDNARTYNNNLISHVKGGSPKRPSGPIETYVFALFDEDQKDPEIEKHFGLFSANMQPKYQISFN

SEQ ID NO: 21617 - protein, 258 aa, Bacillus cereus
MGKVYIVGAGPGDPDLITVKGLKCIEKADVILYDRLVNKELLSYAKPEADLIYCGKLPNYHTMKQETINTFLIKYAKKGKIVTRLKGGDPFVFGRGGEEAEALAKQGVAFEIVPGISAGIAAPAYAGIPVTHRDASASFAIVTGHRKEDVAEEVKWENLAKGVETLAVYMGVSNLPYICEQLMKHGKDKSTPAAIIERGTTSMQRTVVGTLGTIVDVARKEQIQNPSMIVIGEVVRFREKIHWFEKQTESTYQVSGVL

SEQ ID NO: 21618 - protein, 257 aa, Bartonella henselae
MALPDFTMHQLLEAGVHFGHQTHRWNPKMTPYIYGQRNNIHIIDLAQTVPLLHQALKLVSDTVARGGRILFVGTKRQASDIIADAANRSAQYYVNARWLGGMLTNWKTISNSIQRLRKLDKILAAEAQGFTKKERLNLERDREKLNRALGGIKDMGSVPDLIFIIDTNKENIAIQEAKRLGIPVIAIIDTNCDPDNVDHPIPGNDDASRAISLYCDLFARAALDGIARQQGAMGIDLGAQADAPVDPVLENTAPVSE

SEQ ID NO: 21619 - protein, 766 aa, Ostreococcus tauri
MTTVKDRAQIQRGDGKGCNCKNSRCLKLYCECFAAGALCASARCRCANCMNTVEHAGERTAAIETVLDRNPNAFRPKIAAVASPSRDVALRHNRGCHCKRSGCLKKYCECFQAAIYCAETCRCVSCENYEGSDAHEEVKRVYGSGARFHDHASAAASPSPSRRKLLAQRAARDSIDGAGAGLARARAPPLMHNLVQQGAVEELARILLVVADETKKALELIDKAKSTKRLDLSGLGLRALPVEALELTELLELQVSNNNLYDLPSEMFERCTKIERLGLAGNRLRRLPKSVGNLKSLRGVWAHGNCLRTIPREIGACESLRNLVLGGNYLAELPEEIEKLKNLEELSAPGNRLRAIPDLGSMPLLREIDLHGNFIERLPEDMSGLRALETLSLQGNRVREVPKSLTKLRRLRALNLAENAMTTLPDEIADMTMLTSVWLYSNALTSLPGTSVRKMPSIRQIWIEGNDGLSGESLDAFVAAVDGSKTLKTLGVDSRQAGKMRTRGAAIVATAEIPENNPRGYFKLVRWPKGDGSTRAPVLVVSFGSAPGVPNWGGLLKKLQKNVRDGDSYDVLYVCDVDRSWYASSDASGDQELEFERWSAPLREACEKYERVLYVGDSMGASAALMFAEHATKVLAFCPQVDLYDASIRPSRSNVWFKRFKGVMMSGLNQSTADIDVHTGSWDHDKDQAALLPRDKVKHIVHQVDSHRLALALDGEEKLLPIIKSAFESELTAARGGGSAEESSSSSSSSSASLNAFAPWQSLGLK

SEQ ID NO: 21620 - protein, 560 aa, Rhodopirellula baltica
MSSGEPSTDATAETPTSDAPAPEASAEATQASQESAPAESASPAPAEQAKPSSPKPTGPKKNKAPLPRIGGGPLAARGQGVAKPVSPAAVSTEQLEGGKVKHKPKRGGKQGEGKSGGKDAPLPRLAGEKPRDKGDKPYVPQQKKTAVPNVRDQLSEDLQAELEATLAEADLDTILGGNAGLPDRREPLGEGARVHAQVIKIHQDNVFVSLGGPDEGTVPFEQFTEEEPTPGQSIEVIVRGINSEDGLFSCSLPGKATEVSDWDDIDEGSVVEATITGHNNGGLECKVGSVRGFMPISQISEYRVEDCSEFVDQKMVCLVTEANARRGNLVLSRRAILEREREVKRQEQLEKIEPGDILEGVVRSVRDFGAFVDVGGLDGLIHVSKLSWERIKHPSEVIEEGQNVKVRVDKIDKQTGKMSLTYRDLLENPWDSAESMFAVGSVHKGEVTRTAEFGAFVRLTAGVEGLCHISELATHRVSRVSSVVNVGDEVDVKIMSFDRDSQKVGLSIKAAHAKPAAEGEKQVEEEVEPPRELAVKASHSGPLKGGNDRPSGGEKFGLRW

SEQ ID NO: 21621 - protein, 212 aa, Oryza sativa
MAATTTSSSSGGGNRIWTSSLAVLALAVALVSLLSLRAPPPAAPSMADDLPTSVHDISVKDIKGNDVKLSEYEGKVLLIVNVASKCGLTNSNYKELNVLYEKYKEKGLEILAFPCNQFAGQEPGSNEEIEQTVCTRFKAEFPIFDKIDVNGKEAAPLYKFLKSQKGGFLGDGIKWNFTKFLVGKDGKVVERYAPTTSPLKIENDIQKLLGTS

SEQ ID NO: 21622 - protein, 507 aa, Staphylococcus aureus
MLNADLKQQLKQLLELMEGNVEFVASLGSDDKSKELKELLTEISDMSPRLSLSEKSLKRTPSFSVNRPGEETGVTFAGIPLGHEFNSLVLAILQVSGRAPKEKQSIIDQIKNLEGSFHFETFISLTCQKCPDVVQALNLMSVINPNITHSMIDGAVFREESENIMAVPAVFLNGEEFGNGRMTIQDILSKLGSTADASEFENKEPYDVLIVGGGPASGSAAIYTARKGLRTGIVADRIGGQVNDTAGIENFITVKETTGSEFSSNLAAHIDQYDIDAMTGIRATDIEKTDEAIKVTLENGAVLESKTVIIATGAGWRKLNIPGEEQLINKGVAFCPHCDGPLFENKDVAVIGGGNSGVEAAIDLAGIVNHVTLFEFASELKADNVLQDRLRSLSNVDIKTNAKTTEVVGENHVTGIRYEDMSTGEEHLLNLDGIFVQIGLLPNTSWLKDAVELNERGEIVIDRNNNTNVPGIFAAGDVTDQKNKQIIISMGAGANAALNAFDYIIRN

SEQ ID NO: 21623 - protein, 180 aa, Phaseolus vulgaris
MASSMISSPAVTTVNRAGAGAGMVAPFTGLKSLGGFPSRKMNNDITSVANNGGRVQCIQVWPTVGKKKFETLSYLPPLTKQQLAKEVDYLLRKGWVPCLEFELEHGFVYREHNKSPGYYDGRYWTMWKLPMFGCTDSSQVLKELYEAQTAHPDGFIRIIGFDNVRQVQCISFIAYKPPGY

SEQ ID NO: 21624 - protein, 305 aa, Desulfovibrio desulfuricans
MKESRQVDIVILGGGPAGMTAAIYAARASLNVALLEESVTGGLVNSTYTVENFPSYPAIHGMELMQKMRDHVDSLGVTVEEVCEIESVSLAGQVKTVETDEAVFQARAVILATGRKPVPLDVPTGCEQVHHCAICDGAAYKGRRVLVVGGGNSAFDESLYMLGIGVEHITLVEKMDRFFAAQSTQDTLLETGRVDARTQTVVHDLIVENDSLKAAVLEHTGSGVRETVPVDGVFVFLGQSPNNDLFRDVVTLSAGGYVVVDEHMATSVSGVFSAGDINEKHYRQITTAMADGTVAALAAERYIRS

SEQ ID NO: 21625 - protein, 357 aa, Oryza sativa
MAARVVWVNGPIVVGAGPAGLSVAACLRERGVPSVLLERADCIASLWQRRTYDRLRLHLPKHFCELPGMPFPDGYPEYPDRRQFVDYLQAYTARARVEPRFNQSVTSARYDDAAGLLRVRAEDVSVDAAGDITEYIGRWLVVATGENAERVVPEIDGADDFEGPVSHVAEYKSGAAYRGKRVLVVGCGNSGMEVCLDLCHHNALPAMVVRDSKVHVLPREMLGVATFSVAVFLLRFLPLWVVDRILVVLAWLFLGDLAKIGITRPSRGPLELKNTRGRTPVLDIGALARIRSGDIEGSDFFTQEGYPRVPFPDGWKGESGLYSVGFTRRGLSGVSSDAVKVAQDIAMAWNHQTATTR

SEQ ID NO: 21626 - protein, 724 aa, Methylococcus capsulatus
MRKVDDTLPARRVFLGVLRIGPGRGPAAMTVPAKFDYSTGSPLPLGVHFQGTDANFALFSRHGSRVRLLLFADPSHTRPHQVIDLDPHHHRTGDIWHVAVHGAHRGLAYAFQVDGPHEPHLGHRFDPQAVLLDPYATALVTPEHWEFSGAAVGGPEGVVAKALVTADHFDWGHDRPLKHHWSELVIYEAHVRGLSIHPSSAVRHPGTYLGVIDKIPYFKRLGITALELMPLQAFNPYEVTRYNPVTGERLRNYWGYNTIAFQAPHAGYGTGAYPGCQVEEFKRMVKALHEADIEVLLDVVFNHTAEGDETGPILNFRGLDNSIYYLLEEDRRHYRNYSGCGNTVNCNHPVVRSYILDCLRYWVVEMHVDGFRFDLASILGRDRNGHLVPNPPLLELIAEDPILRDVKLIAEAWDAGGAYLVGRFPGERWCEWNGVYRDDVRRYWRGDPGMAGAFASRLCGSADIYEHSGKAPVNSINFVTCHDGFTLNDLVSYACKHNSANGEDNRDGSDHNFSANYGCEGPTGDHGINAVRRRQMKNLMASLLLSRGVPMILGGDEFCRTQRGNNNAYCQDNEISWFDWRLLDENRSFFEFVRKMIAFRARHPVLSREQFYRPEDILWFSPAGGQPDWQADAALGCCIRAVGGEEQPLCLLFNPTAEGLCFRLPDTLRGGVWIKAVDTAVESPCDICELEGGSPLPDQRRLFLPDRSLVVLVEGAATAAAARA

SEQ ID NO: 21627 - protein, 176 aa, Desulfovibrio vulgaris
MIIKDLKVVYSEEQIAARVRELAQEINRLYKGEPLVVVCVLKGAFMFFTDLVRHLDMHPELDFVRLASYGDATHRGSTISFLKDVEVKLEGKHVLIVEDIVDTGHTMDFLFRQLAARGAKSMRLAVLVDKTERREVPVRADFVGFALPRGFIVGYGLDYAQKYRELGAIYEAIVDA

SEQ ID NO: 21628 - protein, 72 aa, Bartonella henselae
MSKEEVLEFSGIVTELLPNAMFRVKLENDHEIIAHTAGRMRKNRIRVLAGDKIMVEMTPYDLTKGRIIYRYK

SEQ ID NO: 21629 - protein, 268 aa, Lactobacillus plantarum
MAVVKVIRKLKAKRVVIKVGTSTLVYPDGSINLRAIDQLAFVISAMRHRGREVVLVSSGAIGVGLNYMGLKQRPKAIPEQQAIAAIGQTELISIYKERFAIYEQKIGQLLLTRDIFVYPKSHHNVLNTFEALLKQNVVPIVNENDTVAVDELDHETKFGDNDQLSAIVATNIGADLLIMLSDIDGFYDGNPNADARAQLLGHIEKVDQHTYKLAGGSGSRFGTGGMVTKLKAAERMIDANGQMILANGADPTIIFQILAGEPVGTLFG

SEQ ID NO: 21630 - protein, 313 aa, Unknown
  Silicibacter sp. TM1040
MSDTRHTKVLIIGSGPAGYTAAVYASRAMLEPILVQGIEPGGQLTTTTEVENWPGHTEIQGPDLMVNMESHARAMGTEIIGDIITSLDTSSRPFVAKGDSGTTYTADAVILATGARAKWLGLPSEEKFKGFGVSACATCDGFFYRGQEIVVIGGGNTAVEEALFLTNFASKVTLIHRRDELRAEKILIDRLMKNEKIEPLWFHELDEVVGTDAPLGVEAVRVKHTKTGEITEIPAKGVFVAIGHAPATELVKDVLETHNGGYVKVKPGTTETSIPGIFAAGDLTDHKYRQAVTSAGMGCMAALDAERFLAEQE

SEQ ID NO: 21631 - protein, 338 aa, Pseudomonas fluorescens
MNLNRFKRYPLTFGPSPITPLKRLSEHLGGKVELYAKREDCNSGLAFGGNKTRKLEYLIPEALEQGCDTLVSIGGIQSNQTRQVAAVAAHLGMKCVLVQENWVNYSDAVYDRVGNIEMSRIMGADVRLDAAGFDIGIRPSWEKAMNDVVERGGKPFPIPAGCSEHPYGGLGFVGFAEEVREQEKQLGFKFDYIVVCSVTGSTQAGMVVGFAADGRSKNVIGIDASAKPEKTKAQILRIARHTAELVELGREITEDDVVLDTPFAYPEYGLPNEGTLEAIRLCGSLEGVLTDPVYEGKSMHGMIEMVRRGEFPEGSKVLYAHLGGAPALNAYSFLFRNG

SEQ ID NO: 21632 - protein, 412 aa, Lactobacillus plantarum [sequence omitted]

SEQ ID NO: 21633 - protein, 305 aa, Botryotinia fuckeliana
MQIFVKTLTGKTITLEVESSDTIDNVKAKIQDKEGIPPDQQRLIFAGKQLEDGRTLSDYNIQKESTLHLVLRLRGGMQIFVKTLTGKTITLEVESSDTIDNVKAKIQDKEGIPPDQQRLIFAGKQLEDGRTLSDYNIQKESTLHLVLRLRGGMQIFVKTLTGKTITLEVESSDTIDNVKAKIQDKEGIPPDQQRLIFAGKQLEDGRTLSDYNIQKESTLHLVLRLRGGMQIFVKTLTGKTITLEVESSDTIDNVKAKIQDKEGIPPDQQRLIFAGKQLEDGRTLSDYNIQKESTLHLVLRLRGGQ

SEQ ID NO: 21634 - protein, 972 aa, Unknown
  Azoarcus sp. EbN1
MPNASPASPLNAPLAELEQRDAFIGRHVGPNATEIATMLAAVGAPDLDTLIDQTVPPAIRLAAPLPLEGPKPEHEALADLRAIAAKNVIRKSLIGMGYYGTHTPAVILRNVMENPGWYTAYTPYQAEIAQGRLEALLNYQQMVIDLTGLELANASLLDEATAAAEAMTMARRVAKSKSNVFYVDEACFPQTIDVLRTRAGLFGFELKFGPAHDAANADAFGALLQYPNERGEIIDLSGTVAALKAKGAVVAIASDLMALVLLKSPGTMGADIALGSAQRFGVPMGFGGPHAAFFATREANVRAMPGRIIGVSKDARGKTALRMTLQTREQHIRREKANSNICTSQVLLANMSGFYAVYHGPQGLRTIAARIHRLAAILAQGLRDAGFNVPAGAFFDTLQVDTGARTAELLAACDAAGFNLRPVSDTVLGLSVDETTTGDDVATLLRLFGASGELAALDAKVGAAGGAIPAALLRDDAILTHPVFNTHHTEHEMLRYLKKLQNRDLALDHSMISLGSCTMKLNATSEMIPITWAEFANLHPFAPREQVRGYLEMIDGLAGYLKAVTGFAAISMQPNSGAQGEYAGLVAIRRYHDSRGDTHRRVCLIPKSAHGTNPASAQMCGMDVVVVACDERGNVDLADLEAKVAQHADRLAALMITYPSTHGVFEESIREICASVHRHGGQVYMDGANLNAQVGLTSPATIGADVSHMNLHKTFCIPHGGGGPGMGPIGLAAHLAPFMADHVVAATGDETRPNKGQGAVSAAPFGSASILPISWMYIAMMGDTGLKLATEVAILNANYVANRLAEHYPVLYTGSQGRVAHECILDIRPIKANTGISEVDIAKRLMDYGFHAPTMSFPVAGTIMIEPTESEDLGELDRFIAAMITIRNEIREVENGAWPTDDNPLKNAPHTQADFIAADGAQWSRPYSREQAVFPLPWVAENKFWPSVNRIDDVYGDRNLFCACVPIEDYAS

SEQ ID NO: 21635 - protein, 483 aa, Bacillus subtilis
MIMKNGIVYFVGAGPGDPGLLTIKGKQALKEADVILYDRLANPKLLEFASPDCQFIYCGKLPNRHFMKQKEINALLVEKALNGLTVVRLKGGDPSVFGRVGEEADALHEHGIRYEMVPGITSGIAAPLYAGIPVTHRDFASSFAMITAHDKSLKGTPNLDWEGLARSVQTLVFYMGVKNLSYICQQLISYGKSPSVPVIVIQWGTWGRQRSVKGTLENIQQKVQEHQITNPAIIVIGDIVNFQTHSWFESKPLIGRHLMVVTHGEDEDPLADKLRDSGADLIEWPKWRTENMPVNEEILRKIGTFEDVFFTSRRAVCEFFRALASQKIDIRQLTAKLSAASEQAKTELEKRGFLVTAIQPDSEKRLVVGSRHAVENMQKHESCSFYITHENVIDDRFTHMIQRTISESPLHMVICPNKLSVQQLINGGEQIGILPEPSASRPPIVCIGDDSAAGIYGFTAVQEQDELLAFIHNQHAEKKLLHT

SEQ ID NO: 21636 - protein, 1134 aa, Methylobacillus flagellatus
MNKRQLQGKLKAEKDLRFNDDPLWYKDAVIYQVHVKSFFDANNDGIGDFAGLIRKLDYIVELGVNTIWLLPFYPSPRRDDGYDIAEYKGVHPDYGTLFDVKRFIVEAHKRKLRVITELIINHTSDQHPWFQRARRAKPGSAARNFYVWSDTDTAYSQTRIIFTDTEKSNWTWDPVAGAYYWHRFFSHQPDLNFDNPRVFKAIISIMRFWLDLGVDGLRLDAVPYLIEREGTSNENLPETHEILKRIRSEIDQNYPDRMLLAEANMWPEDVQEYFGDGSNECHMAFHFPLMPRMYLALAQEDRFPISDILRQTPEIPPTCQWAIFLRNHDELTLEMVTDKERAYMLNFYATESRARLNVGIRRRLAPLLQRDRRRLELLNSLLLSMPGTPVIYYGDEIGMGDNIHLGDRDGVRTPMQWSPDRNGGFSHADPARLVLPPIMDTQYGYHAINVEAQSSDPHSLLNWMRRLLAIRKQYHAFGRGSMRLLYPNNRKILSYLRTHIPGGESADEEQIILCVANISSTAQAVELDLAEFSGYDPMEMMGGSVFPRIGQQPYVLTLGAYDFYWFRLTKNRQPLNGAGEQDGSLPEYLTLVLNQQLTSLFAPQLRRTMEQDILPAYLPCQRWYAGKQKDTLAAIQLTLLGVLDAIDPAEPPFLLAQVETSTATGADQYFLPMGVVSDEQEMPALVRRLALANVRRGPRVGALTDAFALDGFVRAVLHHLRSDSTLDSEQGSIHFNSTASLHQVDFKTELEIRRTDQEQSNSSLIINDLAVMKLLRRVQPGINPELEVARHLAKVGYANTPPLLGDVTFIDADGMPHTQVIMQAFVHNQGNAWQWTLDRLNRLLHDNLSADLMKQALAVDDASPLKELTNFAAMLGQRLAELHIALTKDTDNPSFSPEIFSAAQVETWRDKLHEQADDVLALLDRGPWSGDADAQHASAICSRREQLFQAIDELVQHVVGQPRIRIHSDFHLGQVLMISGDVMIIDFEGEPARSLEQRRQKDHPFRDVAGLLRSFSYAAAHVEKSDMGKPAGEHAERRQGLLRDYEGCSKRAFMQAYFAHSHLPPTSQAPDSAPVLAEELPAGDQAILNLCLLEKVIYEIAYEAANRPAWIGIPMRGLLGLLDEMRADGNPEQP

SEQ ID NO: 21637 - protein, 382 aa, Nocardia farcinica
MNPVPQDTEIRTIEAAAAPTRFARGWHCLGLARDFSDGKPHAIEAFGTKLVVFRGENGTLNVLDAYCRHMGGDLSQGTVKGDAVACPFHDWRWSGNGRCTEIPYARRVPPLARTRTWHALEQDGMLFVWHDPEGSKPTPEVAIPRIEGAGDDRWTDWHWYTTVVNTNCREIIDNVVDMAHFFYIHGSLPTYFKNVFEGHIATQYFKSGARDDFPAPEGQPTMLGTSSVASYYGPSFMIDDLTYHFEYGDQRTVLLNCHYPIDANSFVLQYGIIVEKAPGLPEEAAMQTAVALGDWVKIGFEQDVEIWKNKARIDNPLLCEEDGPVYQLRRWYEQFYVDVADVTPEMVDRFEFELDTTKPLEAWQAQIRANMAAQSGTAEAPA

SEQ ID NO: 21638 - protein, 805 aa, Bacillus subtilis
MGKKQLVLVGNGMAGVRAIEEILSVAKDEFQITIFGAEPHPNYNRILLSKVLQGDTDIKDITLNDWDWYEENNIQLYTNETVIKVDTENKTVITDADRIQPYDELILATGSVPFILPIPGADKKGVTAFRDIKDTDTMLAASKQYKKAAVIGGGLLGLEAARGLLNLGMDVSVIHLAPFLMERQLDATAGRLLQNELEKQGMTFLLEKQTEEIVGDDRVEGLRFKDGTSIEADLVVMAVGIRPNTTLGAESGIPVNRGIIVNDYMQTEIPHIYAVGECAEHRGIAYGLVAPLYEQAKVLAKHMCGIETKPYEGSVLSTQLKVSGVEVFSAGDFNESEEKKAIKVFDEQDGIYKKIVLRGNQIVGAVLFGDSSEGNRLFSMIQKEADISETSKISILQPLSQEAGTSITAAMSDDEIICGCNGVSKGAIIQAIQEKGCSSTDEIKACTGASRSCGGCKPLVEEILQHTLGSDFDASAQKEAICGCTTLSRDEVVEEIKAKGLSHTREVMNVLGWKTPEGCSKCRPALNYYLGMINPTKYEDDRTSRFVNERMHANIQKDGTYSVVPRMYGGVTNSTDLRKIADVVDKYEIPLVKMTGGQRIDLIGVKKEDLPKVWEDLDMPSGYAYGKTLRTVKTCVGEQFCRFGTQDSMALGIALEKKFEGLNTPHKVKMAVSACPRNCAESGIKDLGVVGIDGGWELYVGGNGGTHLRAGDLLMKVKTNEEVLEYAGAYLQYYRETANYLERTSAWLERVGLSHVQSVLNDPEKRQELNGRMNETLSVHKDPWKDFLEDKQTSKELFENVVTTS

SEQ ID NO: 21639 - protein, 530 aa, Nicotiana tabacum
MGDIEGEPGSSMHGVTGREPVLAFSVASPMVPTDTTAKFSVPVDTEHKAKIFKFYSFSKPHGLTFQLSWISFFTCFVSTFAAAPLVPIIRDNLNLTKMDVGNAGVASVSGSILSRLVMGAVCDMLGPRYGCAFLIMLSAPTVFCMSFVSSAGGYVAVRFMIGFSLATFVSCQYWMSTMFNSQIIGLVNGTAAGWGNMGGGATQLIMPIVYDIIRRAGATPFTAWRIAFFIPGWLHIVMGILVLTLGQDLPDGNRGDLQKKGDVSKDKFSNILWYAATNYRTWIFVLLYGYSMGVELSTDNVIAEYFFDRFDLKLHTAGIIAATFGMANLLARPFGGFSSDYAAKRFGMRGRLWVLWILQTLGGVFCVLLGRSNPLPIAVTFMILFSIGAQAACGATFGIIPFISRRSLGIISGMTGAGGNFGSGLTQLLFFTSSKYSTATGLTYMGLMIIGCTLPVTFCHFPQWGSMFFPPTKDPVKGSEEHYYAAEYTEAERQKGMHQNSLKFAENCRSERGKRVGSAPTPPNLTPNRV

SEQ ID NO: 21640 - protein, 217 aa, Sinorhizobium meliloti
MFLIDMFNKKTILPDAATALPGREEEIPTATTHFVSGRPLQGPYPEGMKKVLFGMGCFWGAERLLWEIPGVYVTAAGYSGGLTPNPTYQETTTGLTGHTEVVLVVYDPAKVSLQRLLKTFFEEHDPTQGMRQGNDVGTTYRSAIYVYDEEQLAEANAARNAFQKALRVYNHDREITTEIAKAGPFYFAEDYHQQYLAKNPDGYCGLRGTGVSCPIGA

SEQ ID NO: 21641 - protein, 103 aa, Magnaporthe grisea
MTGRGKGGKGLGKAGPKRHRKILRDNIQGITKPAIRRLARRGGVKRISAMIYEETRGVLKSFLEGVIRDAVTYTEHAKRKTVTSLDVVYALKRQGRTLYGFGG

SEQ ID NO: 21642 - protein, 257 aa, Unknown
  Rhizobium sp. NGR234
MTSSALPRTPSFRLDGKTALVVGASSGIGQAAAVALAEAGANVTLAARSIDKLERTVEALQHMELSATALALDVEDVEATELTIESGAAFDILVNSAGLACHGPALETTIADFDTVMGINVRGAYFVTRAVARKLVATGRTGSLINISSQMAHVGGIDRAVYSATKHAVEGFTKSMAIEWGMHGIRVNTICPTFIRTPLAERTFANPERVRWIEEKIKLGRIGELEDIMGPVTFLASEAAAMITGSALMVDGGWTAD

SEQ ID NO: 21643 - protein, 530 aa, Nicotiana tabacum
MVDIEGSPGSSMHGVTGREPVLAFSVASPMVQTDTTAHFKVPVDSEHKAKVFKFYSFSKPHGLTFQLSWISFFTCFVSTFAAAPLVPIIRDNLNLTKMDVGNAGVASVSGSILSRLAMGAICDMLGPRYGCAFLIMLSAPTVFCMSFVSSAGGYVAVRFMIGFSLATFVSCQYWMSTMFNSQIIGLVNGTAAGWGNMGGGATQLIMPILYDIIRRAGATPFTAWRIAFFIPGWLHVIMGILVLTLGQDLPDGNLASLQKKGDVSKDKFSKILWYAATNYRTWIFVLLYGYSMGVELTTDNVIAEYFFDRFDLKLHTAGIIAATFGMANLLARPFGGWSSDIAAKHFGMRGRLWNLWILQTLGGVFCFLLGKANTLPMAIAWMIIFSLGAQAACGATFGIIPFISRRSLGIISGMTGAGGNFGSGLTQLLFFTTTKWSTETGLSYMGIMIIACTLPVSLVHFPQWGSMFLPPTKDPVKSTEEHYFTSEYTEAEKQKGMHQNSIKFAENCRSERGKRVGSALTPPNVTPNRV

SEQ ID NO: 21644 - protein, 415 aa, Clostridium perfringens
MNNELIIKGKKAKEASYTLSFASTNEKNNGLLKISESLIKRCDEILEENKKDLEKAIEKGTSNAMLDRLKLDEERVKSIANAVADVVKLDDPIGEVTSMFKRPNGLRIGVQRVPLGVVGIIYEARPNVTADAAALCLKTGNAVILRGGSEAINSNLKIVEIISDALKEASLPEGSVQILEDTSRETATDFMRLNDYLDVLIPRGGAGLIKAVVNNATVPVIETGVGNCHIYIDDEADINMGVDIIVNAKTSRPAVCNAAEKLLVNEKIAEEFLPVAIKALKEKGVEIRGCEKTKAIVNDINLATEEDWGKEYLDYILGVKVVKDLDEAISHINKYGTKHSESIVTKNYFNSEKFLQRVDAAAVYVNASTRFTDGGEFGFGAEIGISTQKLHARGPMGLKELTTNKYIIYGNGQIR

SEQ ID NO: 21645 - protein, 321 aa, Magnaporthe grisea
MAYGAKTTGSAIVGDYASQIANKTILTTGVSPTTLGAAFVTTIATASPALLILAGRNLAKAEETAEAIRAVAPQVPIRTLELDLADKQSVRKAAATVLAWDDVAGIDVLVNNAAIITDEYGTIEGIERVFAVNHLGPFLFTNLVLPKVLAVKGRVVNVASEGHRFSNVRFMDLNFEDGKIYNKWRAYGQSKTANMLFSLSLARKLGSRGLVANSPHPGTIITPLSEGMDLALEYELTRPYDQFVGYYPKERGVIKTLDEGISTHIYAAFEPSLKDHNGTFLLDCHVADPNVDFVMSWAASEVEAEKLWKLSEELVGEKFEW

SEQ ID NO: 21646 - protein, 98 aa, Novosphingobium aromaticivorans
MFRAFGLVNKQRQPNPPMAKEELLEMRGTVVELLPNAMFRVRLENDHEILGHTAGKMRKNRIRVLVGDEVLVELTPYDLTKGRITYRFMPGRGGPGGF

SEQ ID NO: 21647 - protein, 254 aa, Unknown
  Populus alba x Populus grandidentata
TNYRTWIFVLLYGYSMGVELSTDNVIAEYFYDRFDLKLHTAGVIAATFGMANLVARPFGGYSSDVAARYFGMRGRLWVLWILQTLGGVFCIWLGRANSLPLAVTAMILFSIGAQAACGATFGIIPFISRRSLGIISGLTGAGGNFGSGLTQLVFFSSTSLSTAAGLSWMGVMICGCTLPVALVYFPQWGGMFFPPSKDVVKSTEESYYASEWDEDERQKGMHQQSLKFAENSRSERGNRIASAPTPPSTTPNRV

SEQ ID NO: 21648 - protein, 267 aa, Prochlorococcus marinus
MPGIVYLVGAGPGDPELLTLKALRLIKNCDALVHDALIPDEITKEAGKNTAIFHVGKRAGKCSVPQAETNALILKLAKEGKNVVRLKGGDPFVFSRGGEEVSILEKNGISVEIVPGITSGIAAPTYFGIPLTHRDAASSVTFVTGHERVDKERKSVNWRDLAKSSDSLVIFMGIKNIEFIVEELILGGLDRNTKCAVIQEATLKNQKCLIENLDNLPDKIKDKEFLSPSIIIIGKIVEFKVNNDITKVSDVDLPDINKVQLYNKSQK

SEQ ID NO: 21649 - protein, 301 aa, Shewanella oneidensis
MNKLTDFERYVIEEKGTERPFSGQYYQHDAKGVYLCKKCHTPLYRSEDKFNAHCGWPAFDDEIPGAVSRHIDADGRRTEIVCSQCGGHLGHVFEGEFLTPKNIRHCVNSVSMLFKAQDEAEDIAPKHAFATFGAGCFWCVEAIFKSLKGVLNVRSGYSGGEASDADYKSVCSGQTGHAEVVHIEFDPEQIAFTTLLQVLFESHDPTTLNRQGNDKGPQYRSVVFAHDATQVDEANAMIAKLTEARVFDAPIVTQVVAFESFYPAEAYHNDYFALHGEQPYCQIVVRPKVEKIRALFAELQV

SEQ ID NO: 21650 - protein, 370 aa, Nicotiana tabacum
MSTSHKHNTPQMAAITLLGLLLVASSIDIAGAQSIGVCYGMLGNNLPNHWEVIQLYKSRNIGRLRLYDPNHGALQALKGSNIEVMLGLPNSDVKHIASGMEHARWWVQKNVKDFWPDVKIKYIAVGNEISPVTGTSYLTSFLTPAMVNIYKAIGEAGLGNNIKVSTSVDMTLIGNSYPPSQGSFRNDARWFVDPIVGFLRDTRAPLLVNIYPYFSYSGNPGQISLPYSLFTAPNVVVQDGSRQYRNLFDAMLDSVYAALERSGGASVGIVVSESGWPSAGAFGATYDNAATYLRNLIQHAKEGSPRKPGPIETYIFAMFDENNKNPELEKHFGLFSPNKQPKYNINFGVSGGVWDSSVETNATASLVSEM

SEQ ID NO: 21651 - protein, 544 aa, Populus tomentosa
MDLNVSSIGSRLQMLTTSDHASVVSMNLFVALLCVCIVIGHLLEENRWMNESITALIIGLCTGVVILLISGGKSSHLLAFSEDLFFIYLLPPIIFNAGFQVKKKQFFRNFMTIMLFGAVGTLISCFIISVGAMQFFKKLDIGPLDIGDYLAIGAIFAATDSVCTLQVLNQDETPLLYSLVFGEGVVNDATSVVLFNAIQSFDLTNINAAIAWDFARNFFYLFLASTLPGVVTGLISAYIIRRLYFGRHSTDREVALMMLMAYLSYMLAELFYLSGILTVFFCGIVTSHYTWHNVTESSRVTTKHAFATLSFVAETFIFLYVGMDALDIEKWRFVSHSPGTSVAVSSILLGLVMVGRAAFVFPLSFLSNLAKKSPNEKISFKQQFIIWWAGLMRGAVSMALAYNKFTSAGHTHLRGNAIMITSTITVVLFSTVLFGLMTKPFIKILLPHPKRQSRSMAISSDPTTPKSFTIPLLGEGQDSLDDLGGHDIDHPSSIRALLTTPTHNVHHYWRQFDDAFMRPMFGGRGFVPFVPGSPTEHNPPNQWH

SEQ ID NO: 21652 - protein, 158 aa, Brassica napus
  misc_feature (12)..(12): Xaa can be any naturally occurring amino acid
  misc_feature (14)..(16): Xaa can be any naturally occurring amino acid
  misc_feature (19)..(19): Xaa can be any naturally occurring amino acid
  misc_feature (21)..(22): Xaa can be any naturally occurring amino acid
  misc_feature (26)..(26): Xaa can be any naturally occurring amino acid
  misc_feature (32)..(32): Xaa can be any naturally occurring amino acid
  misc_feature (35)..(35): Xaa can be any naturally occurring amino acid
  misc_feature (50)..(50): Xaa can be any naturally occurring amino acid
  misc_feature (54)..(55): Xaa can be any naturally occurring amino acid
  misc_feature (57)..(57): Xaa can be any naturally occurring amino acid
  misc_feature (60)..(62): Xaa can be any naturally occurring amino acid
  misc_feature (65)..(65): Xaa can be any naturally occurring amino acid
  misc_feature (92)..(92): Xaa can be any naturally occurring amino acid
  misc_feature (94)..(94): Xaa can be any naturally occurring amino acid
  misc_feature (100)..(100): Xaa can be any naturally occurring amino acid
  misc_feature (105)..(105): Xaa can be any naturally occurring amino acid
  misc_feature (114)..(115): Xaa can be any naturally occurring amino acid
  misc_feature (118)..(118): Xaa can be any naturally occurring amino acid
  misc_feature (121)..(121): Xaa can be any naturally occurring amino acid
  misc_feature (126)..(126): Xaa can be any naturally occurring amino acid
  misc_feature (137)..(140): Xaa can be any naturally occurring amino acid
  misc_feature (144)..(144): Xaa can be any naturally occurring amino acid
  misc_feature (149)..(149): Xaa can be any naturally occurring amino acid
MVSSMLSSAAVXTXXXQDXMXXPFTXLKSSAXFPXTRKANNDITSIASPXGRVXXMXVGXXXGKXKFETLSYLPDLTEVELYKEVDYLLRNXWXPCDEFXLQNGXVYREHGSTXXYYXGRXYWTMXKLPLVACADSXXXXNESXECKTXYPNAFIKII

SEQ ID NO: 21653 - protein, 330 aa, Pinus taeda
VAFNNITRLAFGKRFVNEEGKMDPQGVEFKEIVATGLKLGASLTMAEHIPYLRWMFPLEEGAFAKHGARRDNVTKAIMEEHTLARQTSGAKQHFVDALLTLQEKYDLSEDTIIGLLWDMITAGMDTTAITVEWAMAELVRNPRIQQKAQEEIDRVVGRDRVMNETDFPHLPYLQCITKEALRLHPPTPLMLPHKATQNVKIGGYDIPKGSNVHVNVWAIARDPAVWKDPLTFRPERFLEEDVDIKGHDYRLLPFGAGRRICPGAQLGINLVQSMLGHLLHHFVWAPPEGMQAEDIDLTENPGLVTFMAKPVQAIAIPRLPDHLYKRQPLN

SEQ ID NO: 21654 - protein, 302 aa, Zea mays
MGSEADCDRIRGPWSPEEDDALRRLVERHGARNWTAIGREIPGRSGKSCRLRWCNQLSPQVERRPFTAEEDAAIVRAHARLGNRWAAIARLLPGRTDNAVKNHWNCSLKRKLAAASAPAGSSDVDARPTKRVSLSPDSPSGSGSGSGSGSGSDRSDLSHGAGQVYRPVARSGGFEPADCAMSRPLEEEEEEKEDPLTSLSLSLPGTDQRFHHDRAHSQFQELPASPPSPSPPPPPAGPTSAYPFSPVFMEAMQELIRTEVQRYMASVGVRAGCGAAGGADLCMPQLVDGVMRAAAERVGRMQ

SEQ ID NO: 21655 - protein, 489 aa, Mycobacterium tuberculosis
MSAASQRVGAFGEEAGYHKGLKPRQLQMIGIGGAIGTGLFLGAGGRLAKAGPGLFLVYGVCGVFVFLILRALGELVLHRPSSGSFVSYAREFFGEKAAYAVGWMYFLHWAMTSIVDTTAIATYLQRWTIFTVVPQWILALIALTVVLSMNLISVEWFGELEFWAALIKVLALMAFLVVGTVFLAGRYPVDGHSTGLSLWNNHGGLFPTSWLPLLIVTSGVVFAYSAVELVGTAAGETAEPEKIMPRAINSVVARIAIFYVGSVALLALLLPYTAYKAGESPFVTFFSKIGFHGAGDLMNIVVLTAALSSLNAGLYSTGRVMHSIAMSGSAPRFTARMSKSGVPYGGIVLTAVITLFGVALNAFKPGEAFEIVLNMSALGIIAGWATIVLCQLRLHKLANAGIMQRPRFRMPFSPYSGYLTLLFLLVVLVTMASDKPIGTWTVATLIIVIPALTAGWYLVRKRVMAVARERLGHTGPFPAVANPPVRSRD

SEQ ID NO: 21656 - protein, 444 aa, Brassica napus
MANATSIKDLPSLTGLHQRRNPLEENPFFHPSHGFYITPSDVVLSQVVYDLSDASQPHVAYHRAGPRREILYEPSSVKAAIVTCGGLCPGMNTVIRELVVGLWELYGVREIYGIPAGYRGFYSMEAVELNPKLVHNWHKRGGTVLATSRGGFDLCKIVDAIQQNGYNQVYIIGGDGTMRGAVKIFDEVSRRKLEVGITGIPKTVDNDVGIIDRSFGFQTAVEMAQEAISAAHVEAESAVNGIGLVKLMGRSTGHIALHATLSSRDVDCCLIPEMGFYLEGKGGLFEFLEQRLKDHGHAVLVVAEGAGQEIIPRNEAQKQERDESGNLVFLDVGVWLKSALKEWWEREHPKELFTVKYIDPTYMIRAVPANATDNLYCTLLAHSSIHGVMAGYTGFVSGPINGNYAYIPLEEVAQTKNEVNTSDPKWAWVRSVTNQPDFETNFKG

SEQ ID NO: 21657 - protein, 194 aa, Bacillus cereus
MREFSQIRETTETKIKLSLQLDEGKNVSVQTGVGFFDHMLTLFARHGRFGLQVEAEGDVFVDAHHTVEDVGIVLGNCLKEALQNKEGINRYGSAYVPMDESLGFVAIDISGRSYIVFQGELTNPKLGDFDTELTEEFFRAVAHAANITLHARILYGSNTHHKIEALFKAFGRALREAVERNAHITGVNSTKGML

SEQ ID NO: 21658 - protein, 379 aa, Lactobacillus plantarum
MQDEMLGIILAGGQGTRLGKLTKDTAKPAVPFGGRYRIIDFTLSNCANSGVNTVGVITQYQPLELNAHIGSGASWGFDSLNGGVTVLQPYSSSEGEKFFQGTAHAIYQNIEYIDQQDPKYLLVLSGDHIYKMDYDAMLKYHQEKKASLTVGVIHVTNEEAKRFGMMNTDATDRIIEFEEKPEHPKSDKASMGIYIFNWPTLRDYLVKSYATDKSLEDFGKNVIPSYLANNESVYAYAFKGYWRDVGTIKSLWQANMEFLSPHNRLNIGDRYWRIYSKAEVLPPMFLTETSQVNNAMVVDSCYVAGEIDHSILSQRVSVGMGSRVVDSMIMPGATIGKNVVIDHALIGEDAVIGDDAQIIGTTDKIAVVGYHETMGVEQP

SEQ ID NO: 21659 - protein, 390 aa, Lactobacillus plantarum
MRREQVSAIINLLEPSDALQPLTAVRPVGMLPFGGRYRLVDFQLSSVINAGIQNVMVTVPRSGRSVADHLRSGRDWSLNTIRGGLFLSPYNDLKLVAPEKKAALLHHYYDNSIQFLKCSQSEYSVVMSTRNVGNIDLKALLRYHEERNSPVTAVYKRVDPASLIPENTILQLTAKGEATAVVPMSKAKISPKTKQVAKSMAIYLMSTVDLIELLQSANQRGDMISLEELMRQAVIQHNANAFEYTGFQANIHDINSYFAANMAVLDEANFRALFYSSRRIYTKVKNEIPTFFATGSQCRDSLCGTGGYIEGQLDHSVIFRDVLINRDSQVKNAIIMQGARIGAGCKLENVIIDKDAVIGPNLVLKGTSTTPLVISKGQHVFQQAEVAVHD

SEQ ID NO: 21660 - protein, 491 aa, Gibberella zeae
MSPTNAEYALSESHKEMLEKSLLDSDPEVASIMKDEIQRQRESIVLIASENITSRAVFDALGSPMSNKYSEGYPGARYYGGNQHIDQIELLCQRRALEAFHLDSEKWGVNVQCLSGSPANLQVYQAIMPPHGRLMGLDLPHGGHLSHGYQTPARNMLTIDNRISAVSTYFETMPYRVDLDTGIIDYDTLQKNAILYRPKVLVAGTSAYCRLIDYERMRKIADSVGAYLVVDMAHISGLIAAEVIPTPFKYADIVTTTTHKSLRGPRGAMIFFRKGVRSVDAKTGKETLYDLENPINFSVFPGHQGGPHNHTITALAVALKQAASPDFKAYQEKVVSNAKTLENTFKALGHKLVSDGTDSHMVLIDLRQHNLDGARVEAVLEQINIACNKNSIPGDKSALTPCGIRIGTPAMTSRGFGEKEFERVGKFIDEAIKICKEEQAALPKEANKLKDFKARVASGEVQKINDFRKEIASWCSAFPLPVEGWRLDASI

SEQ ID NO: 21661 - protein, 271 aa, Brassica napus
  misc_feature (241)..(241): Xaa can be any naturally occurring amino acid
  misc_feature (250)..(250): Xaa can be any naturally occurring amino acid
RPRVRETLAEFLCKATGTAVDWVQMIGMKPGPDSIGIVAVSRNCSGIAARACGLVSLEPMKVAEILKDRPSWFRDCRSVETLSVIPTGNGGTIELINTQIYAPTTLAAARDFWTLRYSTSLEDGSYVVCEKSLTAATGGPNGPLSSSFVRAKMLSSGFLIRPCDGGGSIIHIVDHVDLDVSSVPEVLRPLYESSKILAQKMTVAALRHVRQIAQETSGEVQFSGGRQPAVLRTFSQRLCRXGFNDAVNGXADDGWSPMSSDGGEDITIMIN

SEQ ID NO: 21662 - protein, 466 aa, Vibrio parahaemolyticus
MTYAPVSDVLSGKLAVDSEVTVRGWIRSRRDSKAGISFLAIYDGSCFDPIQAVVPNNLNNYDNEVLKLTTGCSVEVTGKIVESPAQGQDFELAATDVKVVGWVEDAETYPMAKTRHSIEYLREVAHLRPRTNVIGAVARVRNCLSQAIHRFYHEQGYFWVSAPLITASDAEGAGEMFRVSTLDMENLPRTDAGKVDYNEDFFGKETFLTVSGQLNAEAYACALSKVYTFGPTFRAENSNTSRHLAEFWMVEPEVAFAELDDVAKLAEDMLKYVFKAVLEERRDDLEFFAQRIDKQAITRLEQFVSSDFAQVDYTDAIQILLDSGREFEFPVEWGIDMSSEHERFLAEEHFKAPVIVKNYPKDIKAFYMRMNDDGKTVAAMDVLAPGIGEIIGGSQREERLDVLDARMREMGIDPEHMSWYRDLRRYGTVPHAGFGLGFERLVSYVTGMGNVRDVIPFPRTPRSANF

SEQ ID NO: 21663 - protein, 64 aa, Triticum aestivum
  misc_feature (5)..(5): Xaa can be any naturally occurring amino acid
  misc_feature (10)..(12): Xaa can be any naturally occurring amino acid
RTLRXPPLEXXXIIRAAWAAAGIPFRAAARAGGALAHPQDLMHHMGLYMAKSRGAKIVDGILEE

SEQ ID NO: 21664 - protein, 294 aa, Helicobacter pylori
MKTKNPAKRILKTAVIQMQSKPYALNENLQLALNLAKEAHNKGANLIVLPELFDSGYCVNDKDADFGLDFKAIEHGEETLKNETLRALSDFAKSSDTHIVACSIEKNNKKLYDSAYIIPPKGKIVGKHRKIYLWGDEKSRFKRGKKYEVFTLDFGDFSAKVGLQICYETGFGVGANLLVLQGAEVLIYPSAFGKARAYNWDLLSKARALENGCFVCACNHSGEETNAKLKQTLEFAGDSRIIAPNGKIIAQATKLNEVIIAEMDLNEVALQRQKIPYLQDFDTKLTKKGFGKLT

SEQ ID NO: 21665 - protein, 496 aa, Manihot esculenta
MAIPQAESHRARARPPVVRRVPLRQLLRVTSIAGGIQFGWALQLSLLTPYVQELGIPHAWASVIWLCGPLSGLVVQPLVGPMSDRCASRFGRRRPFILAGAILIVVAVLIIGHSADIGWLLGDRGNTRPRAIVVFVFGFWVLDVANNTTQGPCRALLADLTGKDHRRTRVANAYFSLFMAIGNILGFATGAFSNWFKVFPFTVTTACNVDCANLKSAFYLDIVFMVITSYLSITAAQESPLGLSNRSTPLAEDVSVESSQEAFLWELFGTFRYFPWPVWTILLVTALNWIGWFPFLLFDTDWMGREIYGGKPNEGQNYNVGVRAGSFALMLNSVFLGITSVLMEKLCRKWGAGFIWGLSNILMALCFLAMLITSYVANHIGYLGHDLPPSGIVISAVVIFAVLGVPLAITYSVPYALISSRIEPLGLGQGLSMGVLNLAIVIPQVIVSLGSGPWDQLFGGGNSPAFAVGGLAALAGGLIAILGIPRSGTQKPRALP

SEQ ID NO: 21666 - protein, 355 aa, Manihot esculenta
VANNMTQGPCRALLADLTGKDHRRTRVANAYFSLFMAVGNILGFATGAFSNWFKVFPFTATSACNIDCATLKSAFYLDIVFMVITAYLSIKAAQESPLHLSDRFTSTTEDVSGQSSHAQEAFLWELFGTFRYFPWPVWTILLVTALNWIGWFPFLLFDTDWMGREIYGGKPNEGQNYNIGVRTGAFALMLNSVFLGITSVLMEKLCSKWGAGFIWGISNILMALCFLAMLITSYVAKHVGYLGLDLPPHGIVIAAIVIFAVLGVPLAITYSVPYALISSRIEPLGLGQGLSMGVLNLAIVIPQGIVSLGSGPWDQLLGGGNSPPFAVGGLAAFAGGLIAILGIPRSGAPKPRALP

SEQ ID NO: 21667 - protein, 416 aa, Zea mays
LLSSDQKISETTSRGCLPSGSETMAVLQAAAPPPVSVIGFEGFEKRLEISFSEAPVLADPSGRGLRALSRAQIDSVLDLARCTIVSELSNDDFDSYVLSESSLFVYPYKIVIKTCGTTKLLLAIPRILELAEELLLPLAAVKYSRGTFIFPEAQPSPHKNFADEVAFLNRFFGGLKSGGNAYVIGDSAKPGQKWHVYYAAEHPEEPVVTLEMCMTGLDKKKASVFFKTTADGYSLCAKEMTKLSGISDIIPEMEICDFDFEPCGYSMNAVHGPALSTIHVTPEDGFSYASYEVMGFNPGSFSYGDLVKRVLRCFGPTEFSVTVTIFGDRDNAKTWGTKLDAEAYACSNMVEQVLPFGGLLIYQSFTVTAETTHGSPRSVLHDFAGDIVKNRSESDAPWEADAVDESEERDVKKMKC

SEQ ID NO: 21668 - protein, 275 aa, Glycine max
  misc_feature (57)..(57): Xaa can be any naturally occurring amino acid
  misc_feature (69)..(69): Xaa can be any naturally occurring amino acid
  misc_feature (132)..(133): Xaa can be any naturally occurring amino acid
  misc_feature (214)..(214): Xaa can be any naturally occurring amino acid
IVQTSRHGKVAIPDGYIQLTENDEFAYQEMLIHLALCSIPNPKKGFCSFFLFLACTXLSYLMKKETFVXTLQVLLVGGGDGGILREISRHSSGEHIDICEIDKMVIHVYKKFFPDIAVGYEDPRMHVHIRDXXAFINSVPEGTYDVVILDAFPAMGHSADVLADKCFLESIAKALRPRGVLLWHTNSEVADTIANCKIFKGSVNYAWATVPAYXAIGFMLCSTEGPPVNFKHPINKLNPEKNGVAKGPPKFYNSEIHATAFFCGQGWLIQQDIHK

SEQ ID NO: 21669 - protein, 319 aa, Paracoccidioides brasiliensis
MATDPSKYKFNHTMIRVKDPKRSVEFYNFLGLSQINRLDFPENKFSLYFLAYDGPQALSGSRHWTDRNGIIELTHNYGTENDPSYTVSTGNVEPHRGFGHLAISVDNVELACKRLEDANYSFQKKFAEGRMRNIAFVKDPDGYWVEIIRKHQTDAAVAQTNPSTYRMNHTMVRVKDPEASLKFYQEVFGMTLLRTLELAGADCNLYFLAYPSSNPSLKEGDANPVAEWEGLLELTWNHGTEKQEGKVYHDGNSEPQGFGHICVSVDDLDAACARFEAQNVTWKERLTDGRMKNVAVILDPDGYWIEIIQNESFKNRSHW

SEQ ID NO: 21670 - protein, 108 aa, Acetobacter aceti
MSEHTLAVSDSSFDQDVLKASGLVLVDFWAEWCGPCKMIGPALGEIGKEFAGKVTVAKVNIDDNPETPNAYQVRSIPTLMLVRDGKVIDKKVGALPKSQLKAWVESAQ

SEQ ID NO: 21671 - protein, 425 aa, Novosphingobium aromaticivorans
MPSISHPPSALRDFLRSEAAGGVILMAVAVLAMIVANSPLADSYFHLLHVQTGPVLSEKLGPMTPHLWINDALMAVFFLLVGLEIKREFVDGRLVTWQQRRLPFIAALGGMAAPALVFLAVTAQSSGLTQGWAIPAATDIAFAIGVMALLGSRVPTALKLFLTTVAIVDDMGAVVIIALAYTASIKGIALLAAAVILGAMMAMNRAGVRHLAPYLLGFVLLWFAVLVSGVHATIAGVLAAFTVPVVATPGAPDSPDSPLHRLEHALHPWSAFLIVPLFGFANAGISLEGFSLGSLLEPLPLGIAAGLFIGKQLGIFSLIWAAVKLGIAQRPRGSTWLQVYGLSVLCGIGFTMSLFIGMLAFASSPDLIEEAKLGVITGSLLSGVLGYLVLRFAPPAADAAQAETEIDREIEQDGDVEAIEGKLRQ

SEQ ID NO: 21672 - protein, 650 aa, Nocardia farcinica
MTDTVVADVSAVSEAALHRAIAEGEPAALLMTLVHVTGDTGLLDEFGARLTIEEPGNHYRTGIRPTVPPGTYPEDVAADIRARARELLSPDSVAALGVPDDELFRRMATICTAQRVDAEFVPILLEQAGFTKDRRHVPVTKTPPADFEVVVIGAGIVGINAAIKLGEAGFSYTVFEERDDIGGTWHRNTYPGAAVDTPSHYYSYSFELKPDWTRYYPTGPEYQRYLLGVVEKYRLREHIRFGTRVRSATWLEHEKRWDVVTEDRAGVVTRHRARAVVTALGMLNAPNYPDVAGMDTFAGTVVHTADWDTGLDLRGKRVVVLGTGCTAVQVVASIVDEVASLDVVVRSPHWLVPEKTVGGDVPEGEKWAMANLPFYAQWFRLRTYWFASDNLYPLPRIDKDWAATHLSASRANDMVLQTALEYLRASFPDRPDLVEKLTPDFRPYAKRIVKDPGFFQALNRDHVTLHRASFREITPDGVHTTDGEFVPADVIILATGFKLQFTTTIDIVGRDGRTLAEVWKGGEDPRAYLGVQVAGFPNLFVTAGPNSAPNHGAGHNITGEEQVHYLIECLQYLLENDQAAMDVKPEALEDYNRRVDEALDETVWVHPGAETNGYYRNSAGRAVVPCPWRLVDYWTMLREPHVEDLTFIPN

SEQ ID NO: 21673 - protein, 297 aa, Alkalilimnicola ehrlichei
MSYPTVEAFVGNTPLVRLQRMVPPERNNRILAKLEGNNPAGSVKDRPAVHMIRRAEERGRIRPGDTLIEATSGNTGIALAMAAAIKGYRMVLIMPENMSTERRASMAAYGAELVLVSQEEGMEGARDLAARMAEEGRGLVLDQFANPDNSAAHYESTGPEIWRDTEGTITHFVSSMGTTGTIMGCSRFFKEQSEAVQIVGVQPEDGSSIPGIRRWPEAYLPKIYEPARVDRILDVSSDDAITTTRRLAAEEGIMAGMSSGGCLHAALRLEREVENATIVVIICDRGDRYLSTGLFEG

SEQ ID NO: 21674 - protein, 840 aa, Zea mays
MAAAVAMRGGSSDSGGFDKVPGMDSGKYVRYTPEQVEVLERLYIDCPKPSSSRRQQLLRECPILSNIEPKQIKVWFQNRRCRDKQRKESSRLQAVNRKLTAMNKLLMEENERLQKQVSQLVHENAHMRQQLQNTSLANDTSCESNVTAPPNAIRDASNPSGLLAIAEETFTEFLSKATGTAIDWVQMPGMKPGPDSVGIVAISHGCRGVAARACGLVNLEPTKVIEILKDRPSWFRDCRSLEVFTMFPAGNGGTIELIYMQMYAPTTLVPARDFWTLRYTTTMEDGSLVVCERSLTGSGGGPNAASAQQFVRAEMLPSGYLVRPCEGGGSIVHIVDHLDLEAWSVPEVLRPLYESSRVVAQKMTTVALRHLRQIAQETSGEVVYALGRQPAVLRTFSQRLSRGFNDAISGFNDDGWSVMGGDGIEDVVVACNSTKKIRNNSNAGITFGAPGGIICAKASMLLQSVPPAVLVRFLREHRSEWADYNIDVYLASSLKTSACSLPGLRPMRFSGGQMIMPLAHTVENEEILEVVRLEGQPLTHDEALLSRDIHLLQLCTGIDEKSVGSSFQLVFAPIDEHFPDDAPLISSGFRVIPLDMKTDGVSSGRTLDLASSLDVGSAAPQASGDAPPDDCNLRSVLTIAFQFPYEMHLQDSVATMARQYVRSVVSAVQRVSMAISPSQSGLNAGQRMLSGFPEAATLARWVCQSYHYHLGVELLNQSDEAGEALLKMLWHHPDAILCCSFKEKPMFTFANKAGLDMLETSLIALQDLTLDKIFDESGRKAIFSDISKLMEQGYAYLPSGVCMSGMGRHVSFDQAVAWKVLGEDSSVHCLAFCFVNWSFV

SEQ ID NO: 21675 - protein, 484 aa, Xanthomonas oryzae
MLRSLIVRCRVRMSYAIVWFRRDLRLQDNPALRAALDAGHHPIPLYIDAPHEEGEWTPGAASRTWRHRSLAALEDALRALGSGLVIRAGDSAQVLDAVIAQTGAVAVYWNRKYEPATQPRDAQIKRALRERGIEAQSCNCALLFEPWQLSTQQGGPYKVFTPFWRNALTQLQLPATAPAPRSLPPLPAMLKTDALDTLQLVPSLNWDQGFWEHWHAGEAGAHEMLEFFIDGGLSGYRKNRDRPDRVGTSQLSPHLHFGEIAPWRIASALEAQRTARNGAEIDGYIRQLGWRDFAYHLLHHFPDTTNQNLNPRFEGFDWAKVDPVALQAWQRGRTGIPIVDAGMRQLWHTGWMHNRVRMIVASFLCKHLRIHWIEGARWFWDTLVDADLANNTLGWQWVAGTGADAAPYFRVFNPVTQAEKFDPHATYITRWVPELGKLPVKERFAPWLHPLSLARFAPEYPRTPIIGLAEGRDAALAAYSKSRA

SEQ ID NO: 21676 - protein, 311 aa, Unknown
  Nostoc sp. PCC 7120
MKNEKWNAENIPPQKGRLAIVTGSSSGIGYETARVLANKQASVIIAVRNLDKGNKALAKILQQNKDADVKLMELDLANLASVKNFAENFRKNYLRLDLLINNAGVMIPPYSKTTDGFELQFGTNHLGHFALTGQLLEFLISTEGSRIVNVSSGAHNMGKIDFDDLNWEQRSYAKWKAYGDSKLANLYFTYELDRKLKDNGIDTLVTASHPGWTATELQRTAGGIVKYLNGIVAQDITMGALPTLRAAIEAGLKGAEYFGPNGFMEMRGYPIKVESNELSKDQALAKKLWVVSEKLTDVKFEFNKKAQSAGK

SEQ ID NO: 21677 - protein, 82 aa, Arabidopsis thaliana
MASFNASASTVVAARPALLLKPSVTISAPVLGLPPMGKNNGRVICSMDTKHGNVAVIEAGVSSVATSALTVVMNNPTMALVE

SEQ ID NO: 21678 - protein, 309 aa, Streptococcus pyogenes
MIYLAEGCFWGVEEYFSQVDGVLDAVSGYANGRGDTTNYQLIHQTGHAETVEVTYDANRISLKELLLHFFRIIDPTSLNKQGNDRGSQYRTGIYYTDKADLAIIDEVFKEKAKDYKKKIVVEKAPLKHFIKAEEYHQDYLKKNPNGYCHIDINQATYPVIDESKYPKPSATEIKAKLSADEYRVTQKNETEKAFSNRYWDSFDAGIYVDVVTGEPLFSSKDKFESGCGWPSFSRPISPDVVRYKEDKSFNMTRTEVRSRSGNSHLGHVFTDGPKDQGGLRYCINSLSITFIPKADMEAKGYGYLLSSVE

SEQ ID NO: 21679 - protein, 358 aa, Candida albicans
MSYITPTKRIFTPEDLSKWVGSPTYNTVLDFIVELQSSVTGKSNDSSYETSSIIDKLSKLLSKVDNLITLHPAHDSVSRFGKIEFRDFYSDLSSKAEEYISEITATAIQETSAYFIESWGNSTRIDYGSGHELNFICFLLCLKELGQITSADYEGLVLKVFTQYMSIMRKLQKEYWLEPAGSHGVWGLDDYHFLPFLFGAAQLSTHPHMKPKSIHNDELVEMYSTKYMYFECINFINKIKTIPNHQGKLSLRWHSPMLDDISAAKNWDKIREGMVKMYKVEVLGKLPIMQHFMFGSLLKCPEGIPEHTDENGHGENPEDHCGHAHVNTWGDCCGIKIPSGIAASESLKHERKGNIPFD

SEQ ID NO: 21680 - protein, 572 aa, Vibrio cholerae
MKMDSEYTEKVNELTLELQRSIERGKQLAEENRVILAAISAFSVATNKNHIFEELKTLLNRYIQFDDFIVISKDKNGHQFRTAIASNASFNDVVWPNGVKFQRVLNGECILLFEPCKLDEFACLMGSIDKPVYSALITGIQAQISDSVLILLGQNKGQFSLEAKETLSRFRPLLERAISDIEHKEELQKLVEIRTRELRLAQKLAEQANQSKSNFLAMMSHELRTPLNAVLGLIDILRGESTSYQVELLEQMENSAELLLIIINDILDLSRIESGHFSLHCHWLDLEKKLDQSLVYHRQIAQDKGVHFYVQSNKNPTLEYYTDSARLTQILFNIVGNAIKFTKQGQVDVVLDYTKDGVVFRVKDTGIGIEKNRVEQLFTPFIQADNSITRNYGGTGLGLAITKHLVELMGGTIQVESEFGIGTTFTLYIPLQSRLKNIKPSTSSSQQIVNVKNHHILVVEDTKTNQMVIQLLLNKLGYDVTIAENGLQAVELLEKNHVFDLVLMDISMPIMDGIAATKILRDKHIEIPIIALTAHTAGSDKQNCIDAGMNDIVLKPIRSKDIMEVVKRFLNP

SEQ ID NO: 21681 - protein, 178 aa, Bacteroides thetaiotaomicron
METIVRRIGLVAHDAMKKDMIEWVLWNSERLIGHKFYCTGTTGTLIKKALEEKHPEIKWDITILKSGPLGGDQQIGSRIVEGEIDYLFFFTDPMTLQPHDTDVKALTRLAGVENIVFCCNRSTADHIITSPLFTDPTYERIHPDYTNYTQRFENKGIISEAVEQVKKRRNKSENNISK

SEQ ID NO: 21682 - protein, 686 aa, Zea mays
RGVAGQSVEQLTNAVQVLKENPSGGKQIKIVDANRRSHQKAHAGAPVSNTGTATENGSSPTTPAEETSVPESVSSSKKGARDAVTPLAHMTYIDQLEHKKQSMAQILKKLTRNARKACPPTIPHPDWVFKSKEIGGLPCKFEGILESPVVNGYRNKCEFSVGYSLEGKKTVGFMLGNFREGVTAVEEPENCPNVSEISCKYAKMFQDFLQSSSFPLWSKIDNSGFWRQLTVREGRCPAEAVVSQNAESQISEVMLIVQVCSTSVDEALMKEEFDKLSAALVQGAATCSPPLPLTTIVVQDHKGISNAAPTDCPLSPLLVPKGDKLDGTSEDKTRIHDHISNLKFSISPTAFFQVNTLAAERLYTLAGDWANLNSDTLLFDVCCGTGTIGLTLAQRVGMVVGIEMNESAVSDAHRNALINGIKNCRFVCGKAEDVMGPLLTEYLGSPQQQAAASKSNSEIDDTSKTEDMIGCASYDGENIDSSKQRHDNAEGQQPMDTSVDHPTCASEVDGMDVVDCNHDENNVASGEQNCGEASLINGKPIETSSDNSLEQGKACKDGSSSPNNNVLAANACQFKNVVAIVDPPRVGLHPTVIKALRTHPRIRRLVYISCNPDSLVANGIELCTPTPEKQEKNKGNRGWRSMSSAGLARQRTKSMPNSEPFIPKRAMAVDLFPHTPHCEMVMLFER

SEQ ID NO: 21683 - protein, 179 aa, Unknown
  Fragaria x ananassa
KMLISYVDNLPTGNEKGLFYALDLGGTNFRVLRVQLGGKEERVIATEFDQVSIPKDLMFGTSEELFDFIASGLAKFAENEGNKFHLPAGTKREIGFTFSFPVKQTSVDSGILIKWTKGFLVSGTAGRDVVACLNEAMERLGLDMRVSALVNDTVGTLAGARYWDDDVMVAVILGTGTNA

SEQ ID NO: 21684 - protein, 179 aa, Unknown
  Fragaria x ananassa
KMLISYVDNLPTGDEKGLFYALDLGGTNFCVLRVQLGGKEKRVIKQEFDEVSIPPHLMTGTSEGLFDFIAEALAKFVATEGEGFHPAPGRLRELGFTFSFPVWQTSIASGTLIKWTKGFSIEDAVEQDVVAELTKSVEKIGLDMRVTALVNDTIGTLAGGRYHNPDVIAAVILGTGTNA

SEQ ID NO: 21685 - protein, 462 aa, Bradyrhizobium japonicum
MILSSVISGTEFGSQSADPDFSSVPRINAILGFGCRDSISGGSLLPNTSKVAPVRRGAVAFIFVTILLDMLALGVIMPILPKLIESFVDNDTAHAARIFGLFGTAWALMQFVFSPVLGALSDRFGRRPVVLLSNFGLAADYVLMALAPSLVWLFIGRVISGITSASISTAFAYIADITPPERRAAIFGRIGAAFGAGFILGPALGGLLGDVDPRLPFWASAALSFANALYGLLVLPESLAPDKRAPFRWTSANPVGALRLLRSNAMLAALSVVNFIAQVAHVVLPSTFVLYATYRYGWDSKTVGLTLAMVGICAMVVQGLAIGPIVRALGERNTLLLGLCCGAIGFVIFGAAPTGPLFWIGIPVMSLWGISGAAMQSLMTRLVAPDQQGQLQGATASVQSVSQLVGPFLFTLTFSYFIGTSAPWQLPGAPFLLAGALMVVCVAIAMRTLATVASARQTGARE

SEQ ID NO: 21686 - protein, 222 aa, Saccharomyces cerevisiae
MSNEDYGYDYDYLFKIVLIGDSGVGKSNLLSRFTTDEFNIESKSTIGVEFATRTIEVENKKIKAQIWDTAGQERYRAITSAYYRGAVGALIVYDISKSSSYENCNHWLTELRENADDNVAVGLIGNKSDLAHLRAVPTDEAKNFAMENQMLFTETSALNSDNVDKAFRELIVAIFQMVSKHQVDLSGSGTNNMGSNGAPKGPTISLTPAPKEDKKKKSSNCC

SEQ ID NO: 21687 - protein, 436 aa, Manihot esculenta
ASRFGRRRPFIAAGAAFVAVAVFLIGFAADIGQLSGDPVAKSPKPRAIAVFVVGFWILDVANNMLQGPCRALLADLSGANQKKTRTANALFSFFMAVGNVLGYAAGSYTHLYKIFPFTKTKACDVYCANLKSCFFISIVLLLTLTVLALTYVREKQWSAEQGNTTAGDDEDEDGKSESSPMPFFGEIFAALKNLQRPMWILLLVTCLNWIAWFPFLLFDTDWMGREVYGGDSSGTAYQLKLYDRGVRAGALGLMLNSVVLGFTSLGVEALARGVGGVKRLWGIVNFVLAFCLCMTILITKLAESHRRFATVAGGATIPLPPPGGIKAGALALFAVMGVPQAITYSIPFAMASIFCNTAGAGQGLSLGVLNLSIVIPQMVVSVASGPWDALFGGGNLPAFVVGAVAAAASGIFALTLLPFPQGDIPSAKGLMPAAFH

SEQ ID NO: 21688 - protein, 154 aa, Unknown
  Fragaria x ananassa
KMLITYVDNLPTGNEKGLFYALDLGGTNFRVLRVQLGGKGRGLVNQEFTEVSIPEGLMVGTTEALFDFIAAELAKFVGKEGPEYQLPPGRQRELGFTFSFPVQQTSINSGTLIKWTKGFSIDDTVNDTVGTLARGIYNNNDVVAAVILGTGTNA

SEQ ID NO: 21689 - protein, 370 aa, Anthurium andraeanum
MVPAATPFLPTTAEEATLRPSFIRDEDERPKVPHNQFSDAIPVLSLAGIDDSDGSPRRAELCREIVEACEGWGIFQVVDHGVDPGLVADMTRLATEFFALPPEDKLRYDMSGGKKGGFIVSSHLQGEAVQDWREIVTYFSYPVRARDYTRWPDKPEGWRAVVEAYSEGLMGLACKLLGVLSEAMGLDKEALAKACVDMDQKVVVNFYPRCPQPDLTLGVKRHTDPGTITLLLQDQVGGLQATRDGGKTWITVQPVEGAFVVNLGDHGHLLSNGRFKNADHQAVVNSERSRLSIATFQNPAPEGVVYPLAVREGEKPVLDEPISFSEMYRRKMSRDLELARLKKQAKLQQQEVLAKAEDANKHKALDEILA

SEQ ID NO: 21690 - protein, 112 aa, Gluconacetobacter diazotrophicus
MKKIEAIIKPFKLDEVKDALHEIGLMGITVTEAKGFGRQKGHTELYRGAEYIVDFLPKVKLEIVCADNLVDRAVETIMAAARTGRIGDGKIFILPVEDVIRIRTGEHGEEAI

SEQ ID NO: 21691 - protein, 296 aa, Lactobacillus sakei
MDRYAVIYNPHSGQDHGESVGKKIEQALVKNQQTVELMPTKGPKDATRLAKKAAQAQFDIVVAVGGDGTINEVVSGLATLEQPPYLGIVPAGTVNNLARVLQIPLDIDQAIENLQQGHLQPLDVGQINDDYLISTMTLGILADAALNVTQSEKQKWGPLAFLNEGIRVLAKHQHYPLTIETPHRHWQKDTQFLLVTLTNSVGGFTKFNPEAQPDDGYFHVFVAPKMSLMRSAMFLPYFLTGNFKKIPGMTYFKADKITITTDNQESVQTRIDGDPSTKSPLNMRLLQHKLQVITPH

SEQ ID NO: 21692 - protein, 557 aa, Acetobacter pasteurianus
MTYTVGMYLAERLVQIGLKHHFAVGGDYNLVLLDQLLLNKDMKQIYCCNELNCGFSAEGYARSNGAAAAVVTFSVGAISAMNALGGAYAENLPVILISGAPNSNDQGTGHILHHTIGKTDYSYQLEMARQVTCAAESITDAHSAPAKIDHVIRTALRERKPAYLDIACNIASEPCVRPGPVSSLLSEPEIDHTSLKAAVDATVALLKNRPAPVMLLGSKLRAANALAATETLADKLQCAVTIMAAAKGFFPEDHAGFRGLYWGEVSNPGVQELVETSDALLCIAPVFNDYSTVGWSGMPKGPNVILAEPDRVTVDGRAYDGFTLRAFLQALAEKAPARPASAQKSSVPTCSLTATSDEAGLTNDEIVRHINALLTSNTTLVAETGDSWFNAMRMTLAGARVELEMQWGHIGWSVPSAFGNAMGSQDRQHVVMVGDGSFQLTAQEVAQMVRYELPVIIFLINNRGYVIEIAIHDGPYNYIKNWDYAGLMEVFNAGEGHGLGLKATTPKELTEAIARAKANTRGPTLIECQIDRTDCTDMLVQWGRKVASTNARKTTLA

SEQ ID NO: 21693 - protein, 856 aa, Erwinia carotovora
MNKVRLAVIGNGMVGHRFIEELLDKAPTSTYDITVFCEEPRVAYDRVHLSSYFAHHTVEELSLVREGYYEKNGVKILLGERAITINRSEKAIHSNSGRTVYYDKLIMATGSYPWIPSIKGSNGQDCFVYRTIEDLNAIENCARRSKRGAVIGGGLLGLEAAGALKHLGVETHVIEFAPVLMAEQLDAQGGALLQRKIENMGVRVHTGKNTQAIQHSGLENRKTMVFADGSTLEVDFIVFSTGIRAQDKLARQCALEIGPRGGIAINDWCQTSDPDVYAIGECAAWQGRPFGLVAPGYKMAQVTVDHLLGHENRFQGADMSAKLKLMGVDVGGIGDAHGHTPGARSYMWLDENKETYKRLIVSADNKTLLGAVLVGDTRDYGNLLQFMLNKIPLPDSPEALILPATAGSAKPTLGVDALPESAQICSCFDVSKGDIIKAINGGCHTVAALKETTKAGTGCGGCIPLLTQVLNAELSKQGIEVNNHLCEHFAYSRQELYHLIQIEKIKTFDQLLEKHGSGYGCEVCKPTVASLLASCWNEYVLKPQHTPLQDSNDNFLGNIQKDGTYSVIPRSAGGEITPDGLIAIGRIAKQYNLYTKMTGSQRMALFGVQKDDLPDVWAQLIEAGFETGHAYAKALRMAKTCVGSTWCRFGVGDSVGFGVELENRYKGIRTPHKMKFGVSGCTRECAEAQGKDVGIIATEKGWNLYVCGNGGMKPRHADLLEADLDRETLVRYLDRFMMFYIRTADKLQRTSVWLDNLEGGIDYLRNVIVKDKLGINDQLEADIARLREGYVCEWQATLESPEAQKRFTHFINSPERDPNVQMVDERQQHRPARPAERIPVKLIDQIKNSELEGENA

SEQ ID NO: 21694 - protein, 377 aa, Unknown
  Oceanospirillum sp. MED92
MKKIIAASVIAVAGIGITTWTSGTEPANANNATAPLSSNIAVATFAGGCFWCTEADFEKLDGVLQAVSGYTGGQKANPSYKEVASGQTTHTEAVQVFYNPDVISYEGLLEYLWRGMNPTDGDGQFVDRGKQYRPAVFYHNAAQKAAVEKSLAELSESNIFGKPMATEISPFKVFYDAEDYHQDYHVKNPLRYSYYRNGSGRDQLLNKVWGDQREHDYTQYKNQASIADVASDKFVKPSEYYLKKKLTPLQYKVTQEDGTERPFDNPYWDEKREGIYVDIISGEPLFSSTDKYKSGTGWPSFTQPIQGVSIIEKEDNSLFMKRVEVRSPVADSHLGHVFTDGPAPTGLRYCINSASLRFIPKEELTDKGYGQYLALFK

SEQ ID NO: 21695 - protein, 391 aa, Nocardia farcinica
MTSTPATGDQVRVIDSGLPPERYARGWHCLGLVRDFADGRPHQVSAFGTELVVFAGEDGKVNVLNAFCPHMGGNLAHGEVKGNTIACPFHDWRWRGDGKCADIPYARRVPPLARTKAWPTMEISGQLFIWHDPQGRKPPAELTIPEIPTYGDPGWTDWVWHSILVEDSHCREIVDNVVDMAHFFYVHYGMPTYFRNVFEGHTATQLMRSRPRADAVGVSTNTVDPSIESRSDATYYGPSYMIDKLWSAQYAEREEPNIYLINCHYPITPTSFRLQYGVIVEKPVGMDDEAANAMAAAVGRGIAIGFEQDVQIWKNKARIDNPLLCEEDGPVYQLRRWYEQFYVDVEDITPEMTNRFEFEIDTERALQNWQAEVDANLAAGRSAIAPNLVNR

SEQ ID NO: 21696 - protein, 420 aa, Aspergillus nidulans
MGKSSKDKRDAYYRLAKEQNWRARSAFKLIQIDEQFDLFEHENPEKVTRVVDLCAAPGSWSQVLSRVLIKGESFGRRSWVEKRRKEQAALENLDGDAPAANQGADITDSTALKPRKNVKIVSIDLQPMAPLQGITTLQADITHPSTIPLLLQALDPEAYDSTSSTPHAVRQPHPVDLVISDGAPDVTGLHDLDIYIQSQLLYSALNLALGVLRPGGKFVAKIFRDRDVDLLYSQLRTVFERVSVAKPRSSRASSLEAFIVCEGFIPPAIHDTLLGMDTLKNPLFGGAAIPQPVSADGNIAVKVPEEKPSIKKSAITSSDSATRDAQTRLLHNDSGDSTTPEPLFNNPQKFAAENRWIPSFIACGDLSAWDSDASYTLPPDYVNLDPVQPPMAPPYRRALELRKEKGEIEDTRVFETNLNK

SEQ ID NO: 21697 - protein, 348 aa, Sorghum bicolor
FGVGASSHSHGHGHGQHHHHHHPWASSLSAVVAPPPQQPPTAGLPLTLNTVAATGNSGASGNPVLQLANGGSLLDACVNVKAKGEPSSSSPYAGDLEAIKAKIISHPHYYSLLAAYLECKKVGAPPDVSARLTAMAQELEARQRTALSGLGAATEPELDQFMEAYHEMLVKFKEELTRPLQEAMEFMRRVESQLNSLSISGRSLRNILSSGSSEEDQEGSGGETELPEVDVHGVDQELKHHLLKKYSGYLSSLKQELSKKMKKGKLPREARQQHLSWWDLHYKWPYPSETQKVALAESTGLDLKQINNWFINQRKRHWKPSEEMHHLMMDGYYTNTFFMDGHFINDGG

SEQ ID NO: 21698 - protein, 322 aa, Exiguobacterium sibiricum
MRPRARVIYNPTSGKEMVKRNLPYILDRLEAAGYETSVYSTKAVGDATYEAARACEAEFDLVVAAGGDGTLNEVISGMASYPVRPKLGVLPVGTTNDFGRAMRIPLTIEGAMDVICTGYTMPVDIGKIEGTTGTHYFINIAGGGIMTELSYEVPSKLKTALGQLAYYVKGMEKLPQIRPTYVELEHERGIFKGEVMLFLTSNTNSVGGFEKLSPNASLNDGRFDLFILKKCNLVELIRVMRLALKGDHFSDPCIEHVTTSFVRMRNTSEMSLNIDGEFGGICEGEMTNLQSHFDVMTPKFRIDEMETINLQLQAQEQETNLA

SEQ ID NO: 21699 - protein, 509 aa, Arabidopsis thaliana
MRSGEKNMDSVLTNKNPIIYPKRTRRYRTDQSSTDEFSSTNRIRDIKDPEHPELSLEDLNVLTEESVEVDDHKSYVRITFTPTLPHCHLPTHIGLCILVKLVQSLPARFKVDVRVAPGSHDKETTVNKQLGDKERVTAALENPELVALLNKMMQIIMVANPGRGDRRRGVGTMDDFETTKGVDPIESFEDMGLKEDVLRGLYEYGYEKPSAIQQRAIMPILQGRDVIAQAQSDKTHACIGGKSLGEDIRKLEHGVHVVSGTPGRVYDMIKRRSLGTRAINLLILDESDEMLSRGFKEQIYDVYRYLPPDIQVCLVSATLPHEILEMTSKFMTDPVKILVKRDELTLEGIKNFFISVEKEEWKFETICDLYDTLIITKAVIFCNTKRKVDYISEKMRSSNFTVSSMHGDMPQKERDEIMNQFRTGESRVLITTDMFARGIDVDQVSLVINYDLPNNRELYIHRIGRSGRFGRKGVAINFVKIDEIKILRDIEQYYSTQIDELPKNIADLI

SEQ ID NO: 21700 - protein, 592 aa, Bacillus anthracis
MAETLAKRGPDDNKVWIKGNVAFGHKRLIVVDPEGGKQPMTCLKDEANYAICYNGELYNTEDIRKELLRRGYTFKGHSDTEVLLASYIEWKEECVDHLNGIYAFAVWDEQKEQVFIARDRLGVKPLFYKYDSGRLLFGSELKAILAHPDVKAEVTLEGLSEIFGLGPSRTPGHGIYTGIKELRPGHAMTFSKNGLCIWRYWNVESKKHEDSFEETVEKTRFLLQDAITRQLVSDVPLCTFLSGGVDSSAITAIAAKEYEKSGKGQLHTYSVDYEDNDKYFKANAFQPNSDAPFIHLMTETFQTIHHRCVISNEQLAQYLTEAVLVRDLPGMADIDSSLLWFCREIKQDFVVGLSGECADEIFGGYPWFYREDDLQSSAFPWMRSTEAREQLLKKEWRNKLNLQQYVQQRYEESIQEVPILDGESPLEAKRRQLFYLNMVWFMTTLLDRKDRMSMGASLEVRVPFADHRLVEYAWNIPWEMKMYKNREKGLLRKALEGLLPNDILYRKKSPYPKTHNPHYTKAVTVWIQDLLTDKGSILHELFDKEQLSGLIESGGSAFQTPWYGQLMTGPQLLAHLAQIHVWFKEYGVNIKE

SEQ ID NO: 21701 - protein, 334 aa, Panicum miliaceum
YGLGASGHGHGQHHHYHHHPWGSSLSAVVAPPPQPPPSAVLPLTLNTAATLNSGANGGAGGNPVLQLAHGGSLLDACIKAKEPSSSSPYAGDVGAIKAKIISHPHYHSLLAAYLECQKVGAPPEVSARLTAMAQELEARQRTALGGLGAATEPELDQFMEAYHEMLVKFREELTRPLQEAMEFMRRVESQLSSLSISGRSLRNILSSGSSEEDQEGSGGETELPEVDAHGVDQELKHHLLKMYSGYLSSLKQELSKKKKKGKLPKEARQQLLGWWDLHYKWPYPSETQKVALAESTGLDLKQINNWFINQRKRHWKPSEEMHHLMMDGYHTTGA

SEQ ID NO: 21702 - protein, 321 aa, Pennisetum glaucum
YGVGASGGSGHGHGQQQQQHHHHHHHLWGSSLSAVVAPPPQPPPSAGLPLTLNTAAAGNSCGAGGNPVLQLANGGGLLDACVKAKEPSSSSPYAGDVEAIKAKIIFHPHYYSLLAAYLECQKVGAPPEVSARLTAMAQELEARQRTALGGLGAATEPELDQFMEAYHEMLVKFREEPTRPLQEAMEFMRRVESQLNSLSISGRSLRNILSSGSSEEDQEGSGGETEIPEIDAHGVDQELKHHLLRKYSGYLSSLKQELSKKKKKGKLPKEARQQLLGWWEAHYKWPYPSETQKVALAESTGLDLKQINNWFINQRKRHWKP

SEQ ID NO: 21703 - protein, 321 aa, Streptococcus pyogenes
MRKSVPEVLDILEGFGYETSAFQTTAQKNSALNEARRAAKAGFDLLIAAGGDGTINEVVNGIAPLKKRPKMAIIPTGTTNDFARALKVPRGNPSQAAKLIGKNQTIQMDIGRAKKDTYFINIAAAGSLTELTYSVPSQLKTMFGYLAYLAKGVELLPRVSNVPVKITHDKGVFEGQVSMIFAAITNSVGGFEMIAPDAKLDDGMFTLILIKTANLFEIVHLLRLILDGGKHITDRRVEYIKTSKIVIEPQCGKRMMINLDGEYGGDAPITLENLKNHITFFADTDLISDDALVLDQDELEIEEIVKKFAHEVEDLEQELEE

SEQ ID NO: 21704 - protein, 300 aa, Unknown
  Rhodococcus sp. RHA1
MTESNDLAGRTMVVTGATSGLGLETCRQLARRGATVVLVGRDQDKIDAVIAELSENTDRDRLNSALADLSSLDRARRLSEELLHRFPRIDVLVNNAGIDVGHRQLTVDGVEEMFAVNYLAPFVLATSLAPAMAQASTADAAGYRHPARIVDVSSSGHRGGHLDFDDLDGTKDTFHGQRAYNNSKLALTLFTRELARRSDPARLVVNCADPGFVRGTSLGRGLFGYQVVGTLLTPFASDVAKAADTVVWTATATESGKFTGEYVKGCKVVQPSKDARDAELAARLWDATEALLADRGAARR

SEQ ID NO: 21705 - protein, 344 aa, Setaria italica
FGVGASGGHGHVQDHLHHHHPWGSSLSAVVAPPPQTPPSAGLPLTLNTAATGNSGGAGGNPVLQLANGGGLLDACVKAKEPSSSSPYAGDVDAIRAKIISHPHYYSLLAAYLECQKVGAPPEVSARLTAMAQELEARQRTALGGLGAATEPELDQFMEAYHEMLVKFREELTRPLQEAMEFMRRVESQLNSLSISGRSLRNILSSGSSEEDQEGSGGETEIPEVDAHGEDQELKHHLLKKYSGYLSSLKQELSKKKKKGKLPKEARQHLLSWRDLHYKWPYPSETQKVALAESTGLDLKQIINWFINQRKRHWKPSEEMHHLMMDGYHTTGAFYMDGHFINDSG

SEQ ID NO: 21706 - protein, 180 aa, Arabidopsis thaliana
  misc_feature (34)..(34): Xaa can be any naturally occurring amino acid
  misc_feature (87)..(87): Xaa can be any naturally occurring amino acid
  misc_feature (96)..(96): Xaa can be any naturally occurring amino acid
  misc_feature (101)..(101): Xaa can be any naturally occurring amino acid
  misc_feature (144)..(144): Xaa can be any naturally occurring amino acid
MASSMLSSATMTASPDQATMNTPFDGLKSSDAFXGTRKANNDITSITSNDERVNCMQVWPPIGKKKFETLSYLPDLTDSELPKECDXLIRNKWIPXDEFEXEHGFVYRGHAKSPGYYEGRYWTMRKLHLFGSTDSARVLEEVQXCNNEYHNACIMIIGLDNTRQVQCIMIIAYKPPSFTG

SEQ ID NO: 21707 - protein, 515 aa, Halothermothrix orenii
MKLKRLSFFMFVTLLVFISVFPVYANDFEKHGTYYEIFVRSFYDSDGDGIGDLKGIIEKLDYLNDGDPETIADLGVNGIWLMPIFKSPSYHGYDVTDYYKINPDYGTLEDFHKLVEAAHQRGIKVIIDLPINHTSERHPWFLKASRDKNSEYRDYYVWAGPDTDTKETKLDGGRVWHYSPTGMYYGYFWSGMPDLNYNNPEVQEKVIGIAKYWLKQGVDGFRLDGAMHIFPPAQYDKNFTWWEKFRQEIEEVKPVYLVGEVWDISETVAPYFKYGFDSTFNFKLAEAVIATAKAGFPFGFNKKAKHIYGVYDREVGFGNYIDAPFLTNHDQNRILDQLGQDRNKARVAASIYLTLPGNPFIYYGEEIGMRGQGPHEVIREPFQWYNGSGEGETYWEPAMYNDGFTSVEQEEKNLDSLLNHYRRLIHFRNENPVFYTGKIEIINGGLNVVAFRRYNDKRDLYVYHNLVNRPVKIKVASGNWTLLFNSGDKEITPVEDNNKLMYTIPAYTTIVLEKE

SEQ ID NO: 21708 - protein, 84 aa, Triticum aestivum
  misc_feature (5)..(5): Xaa can be any naturally occurring amino acid
  misc_feature (32)..(32): Xaa can be any naturally occurring amino acid
  misc_feature (40)..(40): Xaa can be any naturally occurring amino acid
  misc_feature (69)..(69): Xaa can be any naturally occurring amino acid
  misc_feature (72)..(72): Xaa can be any naturally occurring amino acid
  misc_feature (81)..(81): Xaa can be any naturally occurring amino acid
FTFIXEGICTGGNVLVHCFAGRSRSVTVVLAXLMKKHQMXLQSAMSLVRSKRPQIAPNAGFISQLVNFXKSXQVEQGQRTXQSN

SEQ ID NO: 21709 - protein, 327 aa, Bacteroides thetaiotaomicron
MDNKYIGILTSGGDASGMNAAIRAVTRAAIFNGFKVKGIYRGYEGLIAGEVKELTTEDVSSIIQRGGTILKTARSETFTTPEGRKKAYKVIQKENINALIIIGGDGSLTGARIFAEEYDVTCIGLPGTIDNDLYGTDFTIGYDTALNTIVECVDKIRDTATSHDRIFFVEVMGRDAGFLAQNSAIASGAEAAIIPEDRTDVDQLETFIGRGFRKTKNSSIVIVTESPENKNGGAIYYADRVKKEYPGYDVRVSILGHLQRGGAPSANDRILASRLGEAAIQALMEGQRNVMIGIRNNEIVYVPFVQAIKKDKPIDKSLIRVLNELSI

SEQ ID NO: 21710 - protein, 185 aa, Triticum aestivum
MAARRSGAVVAALMALLVGLAGADFAADRAECADKLMGLATCLTYVQLAATARSPTPDCCSGFRQVLGVSKKCLCVLVKDRDEPTLGIKFNVTRAMNLPSACNIPATFSDCPKILNMSPDSKEAEIFKQYGIEHEGKNATAGGSAAVTGTSGGKSADAAAGAGRHTAVVFAVVVSALLASVLVLA

SEQ ID NO: 21711 - protein, 334 aa, Chasmanthium latifolium
FGVGASGHSQQQQQHHHPWVSALSAVVAPAPSAGLPLTLNTAATGSSGGNPVLQLANGGSLLDACVKAKELSSSSPYAGDVDAIKAKIISHPHYYSLLAAYLECQKVGAPPEVSARLTAMAQELEARQRTAFGGLGNATEPELDQFMEAYHEMLVKFREELTRPLQEALEFMRRVESQLNSLSISGRSLRNILSSGSSEEDQEGSGGETELPEVDAHGVDQELKHHLLKKYSGYLSSLKQELSKKKKKGTLPKEARQQLLSWWDLHYKWPYPSETQKVALAESTGLNLKQINNWFINQRKRHWKPSEEMHHLMMDGYHTTNAFYMDGTSSTTAG

SEQ ID NO: 21712 - protein, 268 aa, Glycine max
  misc_feature (10)..(10): Xaa can be any naturally occurring amino acid
  misc_feature (22)..(22): Xaa can be any naturally occurring amino acid
ITERYLSGQXVGPPPIVRDLFXDLESRISMQFNRFVDEACHQIERNERNVRQMGVLSYIPRFATLATRMEQYIQGQSRDLVDQAYTKFVSIMFATLEKIAQTDPKYADIFLFENYAAFQNSLYDLANIVPTLAKFYHQASEAYEQACTRHISMIIYYQFERLFQFTRRIEDLMFTVAPEEIPFQLGLSKMDLRKMLKSSLSGVDKSIAAMYKKLQKNLTSEELLPSLWDKCKKEFLDKYESFAQLVAKIYPTETIPSVAEMRDLLASM

SEQ ID NO: 21713 - protein, 297 aa, Zymomonas mobilis
MVNQRIAVIVNPTAGKRRHHSVQRFVDYLEKANCEVLVKKTRFQGHATELARELADSGEYTHIVAAGGDGTIAEVAEGIVGSGVILCVLPIGTANVFAHELSIAFNEIQNAADIIKGHWVRLWPACLFNDGKRSLSIQMIGIGIDAHIVHHISSRLKRMIGKTAYLFQTIRSLWQYPFYEMLVSIEGRATEKATAVIISKGAFYAGNYRLLPWSKQKEKAFSVLLFQSPSKMSYLYAVAAFFMGKIADCKHIKIVKAEKVKIEANTRIPIQSDGDARGCTPATIEISTKALKVAIPA

SEQ ID NO: 21714 - protein, 448 aa, Bifidobacterium longum
MLTDEYIKRVYDQVVARDGDQPEFLQAVREVFETLQPVVEKHPEYEKAGVLERIVEPERTIKFRVAWVDDEGKVQVNRGYRIQFNSAIGPYKGGLRFHPTVTESVVKFLGFEQILKNSLTTLPMGGGKGGSDFNPKGKSDAEVMRFCQAFMTELSRHIGQFTDVPAGDINVGGREIGYLFGQYKRIRDEYSGVLTGKGLEFGGSLARTEATGYGVCYYTQEALRVLRNDSFEGKTVVISGSGNVATYAAQKAEQLGAKVVTVSDSNGYIYDPNGINVEVVKQIKEVERGRIKEYAERVPGSEYHEGSKGVWTVKGDIALPCATQNEVDGESAQKLVDNGVTVVVEGANMPSTPEAIEVYQKNGVLYGPAKAANAGGVAVSGLEMSQNSYRLSWTFEEVDAKLKSIMEEIVANSLAAAKEYGHEGDLMLGANAAGFVKVANAMVAQGVL

SEQ ID NO: 21715 - protein, 417 aa, Alkaliphilus metalliredigenes
MSEKTLNPFEIAQQQVKGACDKLGVEDAVYEILKNPMRVMEVAIPVKMDDGSLKSFVGYRSQHNDAVGPFKGGVRFHQDVNRDEVKALSTWMTFKCGVVGVPYGGGKGGITVDPRDLSQGELQRLSRGYARAIAPIIGEKVDIPAPDVGTNGQVMSWFIDEYQKTTGEFAPGVFTGKPVDFYGSLARNEATGFGVAIMARDAAKKIGLSLNGATVAIQGFGNVGSFAAIYMVGMGAKVTAISDHTACIFDENGLDIDALIEYVKGNKQVQGFPGAQKELHRDELFGMDVDILMPCALENQITLKNVNDIKAKIVSEGANGPTTPEADKIMYDKGIIVVPDILANAGGVTVSYFEWVQNLMRYSWSFEEVQEKQEKLMVKSFDDIWTLMHEHNVDMRTAGYMMSIKRIATAMKYRGWY

SEQ ID NO: 21716 - protein, 329 aa, Gibberella zeae
MSPHSASTTVNELVNEYADIIKGKVILTTGVTLNSLGGLFIQETASKSPELLILAGRNASKLQELAEAIAKGYPSVKTRNLVVDLSSLASVRKAAEGVNSWEDVPVIDVLVNNAGIMAVPYAKSVDGFESQFAICHLSHFLLTNLIMDKILASKSPRIVNISSNVHSLGPVRFADPHFSNGETYNEWSAYGQAKTSNALFSISLAQKLGGRGLQSYSVHPGLILTTGLGTHLDFASMEGDLGAIIKAHRERGNTEGWKFLDPVPVEVGAATHAFAAFDPNLRANNGAYLLETRVSDPFVDTYKSWARDPVDAEKLWRLSEELVGQKFGY

SEQ ID NO: 21717 - protein, 236 aa, Helianthus annuus
MDFHGFAEHALELRLSTTSSVAENTTNPIKKPSPSSDHCLEPSLTLALSGDSCGGSSFSIASAKREREVPSEESERGGENTSGEEDEDGGVNGKKKLRLTKAQSGLLEEAFKLHTTLNPKQKQELARDLKLRPRQVEVWFQNRRARTKLKQTEVDCEYLKRCCNTLTDENQRLRQEVQELKAQKVSPALYMQLPTTTLTVCPSCEQIGDTKSATSKNPCTKKPSFFNPFTSSSAAC

SEQ ID NO: 21718 - protein, 484 aa, Methylococcus capsulatus
MSDEILINVTPPETRVAIVENGVVQEVLIERTRRRGLVGNIYKGRVCRVLPGMQAVFVDIGLERAAFLHISDLSAAEREKAGTDKIEAIFREGQEIAVQVVKDPIGTKGARLSTEISVPSVYEVYMPFSKTSGVSQRIECEAERARLRACVEAFQREHGTGGFIARTSAEGVDESLLRADMLFLLKLWNSIAQRIKTAKVKVLLHEDLPLSMRVLRDLRRTRVDKIRVDSRETHARLTKFAREFVPEIAPMIEHYAGERPLFDLYGVEEEIQKALERRVTLKSGGYLIFDQTEAMTTVDVNTGAFVGGRNLEETIFKTNLEAAQAIARQLRLRNLGGIIIIDFIDMRDEDHKAQVLHALSRHLERDPAKNTISEVSPLGLVEMTRKRTRESLEQVLCEPCPACGGRGVLKTAETTCLDIFREIIREVRQYQVQELLVLASNEVVERLLDEEADTLSELESFIGVPIKFRAESQYNQEQYDVVIL

SEQ ID NO: 21719 - protein, 380 aa, Cryptomeria japonica
FSIKGNGIGNGNGHCNGYSNGHGHCINGYSNGISASVSSNGVSHLPYSNGNTVHHSNSNGHIHTSPSFGDGRRRCFWYEEEIEDDLRWCFALNRILHTGVSEYQDIALIDTRPFGKALVIDGKMQSTEVDEFIYHESLVHPALVYHSQPKSAFIMGGGEGSTAREILRHKCVKKVVMCDIDKEVVDFCKKYLVVNREAFSNSRLELVINDARTELQSRQERFDVIIGDLADPVEGGPCYQLYTKSFYELVIKPKLNHQGIFVTQAGPAGVLTHTQVFSSIYNTLRQVFKHVMPYSAHVPSFADTWGWVMASDHPLTLEAGEIDDRIKQRIKGELQFLDGQTFLVAATLNKSVRKSLSKETHVYTEETARFIHGHGKASYQ

SEQ ID NO: 21720 - protein, 729 aa, Saccharomyces cerevisiae
MFYNRWLGTWLAMSALIRISVSLPSSEEYKVAYELLPGLSEVPDPSNIPQMHAGHIPLRSEDADEQDSSDLEYFFWKFTNNDSNGNVDRPLIIWLNGGPGCSSMDGALVESGPFRVNSDGKLYLNEGSWISKGDLLFIDQPTGTGFSVEQNKDEGKIDKNKFDEDLEDVTKHFMDFLENYFKIFPEDLTRKIILSGESYAGQYIPFFANAILNHNKFSKIDGDTYDLKALLIGNGWIDPNTQSLSYLPFAMEKKLIDESNPNFKHLTNAHENCQNLINSASTDEAAHFSYQECENILNLLLSYTRESSQKGTADCLNMYNFNLKDSYPSCGMNWPKDISFVSKFFSTPGVIDSLHLDSDKIDHWKECTNSVGTKLSNPISKPSIHLLPGLLESGIEIVLFNGDKDLICNNKGVLDTIDNLKWGGIKGFSDDAVSFDWIHKSKSTDDSEEFSGYVKYDRNLTFVSVYNASHMVPFDKSLVSRGIVDIYSNDVMIIDNNGKNVMITTDDDSDQDATTESGDKPKENLEEEEQEAQNEEGKEKEGNKDKDGDDDNDNDDDDEDDHNSEGDDDDDDDDDEDDNNEKQSNQGLEDSRHKSSEYEQEEEEVEEFAEEISMYKHKAVVVTIVTFLIVVLGVYAYDRRVRRKARHTILVDPNNRQHDSPNKTVSWADDLESGLGAEDDLEQDEQLEGGAPISSTSNKAGSKLKTKKKKKYTSLPNTEIDESFEMTDF

SEQ ID NO: 21721 - protein, 112 aa, Gluconacetobacter diazotrophicus
MKLVTAIIKPFKLDDVRESLTPLGIQGLTVSEVKGFGRQKGQTEIYRGAEYHVSFLPKVKIEVAVSDDIVDQVVDVILQSAHTGKIGDGKIFVSSLDSVIRIRTRETGEDAL

SEQ ID NO: 21722 - protein, 343 aa, Corynebacterium glutamicum
MRIATLTSGGDCPGLNAVIRGIVRTASNEFGSTVVGYQDGWEGLLGDRRVQLYDDEDIDRILLRGGTILGTGRLHPDKFKAGIDQIKANLEDAGIDALIPIGGEGTLKGAKWLSDNGIPVVGVPKTIDNDVNGTDFTFGFDTAVAVATDAVDRLHTTAESHNRVMIVEVMGRHVGWIALHAGMAGGAHYTVIPEVPFDIAEICKAMERRFQMGEKYGIIVVAEGALPREGTMELREGHIDQFGHKTFTGIGQQIADEIHVRLGHDVRTTVLGHIQRGGTPTAFDRVLATRYGVRAARACHEGSFDKVVALKGESIEMITFEEAVGTLKEVPFERWVTAQAMFG

SEQ ID NO: 21723 - protein, 565 aa, Zea mays
MAADAAAAAMSATSLCDDLEPATVRTRIRDVLAAGAARAGDRVVVGGWVRTGREQGKGSFAFLELSDGSCAATLQAIVDAAVHPLARLTGTGTSVLVEGVIKEPPEGTKQNVELKVSRVLEVGEVDAAVYPLPKGKVKLTLEKLRDVVHLRSRTNTIGAVARIRHQLAYASHRFFDENGFLYVHTPIITTSDCEGAGEMFQVTTLFSQAEKTEKELRENPKPSDSEIEAAKVLVKEKGDVVAQLKAAKASKQEISTAVDELNRAKEIVSKLEERFKLKPGIPRKDDGSIAFENDFFKRQAFLTVSGQLQVETYACALSSVYTFGPTFRAENSHTSRHLAEFWMVEPEIAFANLQDDMNCAEKYVQYLCKWLLDHCQEDMEFMVKNYDKSAIERLELVSSTPFVRISYTKAVELLKNVTDKKFDNKVEWGIDLASEHERYLTEDIFKKPVIVYNYPKGIKAFYMRLNDDDKTVAAMDVLVPKVGELIGGSQREERLDVLKQRILDAGLPLEPYEWYLDLRRFGSVKHSGFGLGFERMILFATGMENIRDVIPFPSSKKFYAQIMGK

SEQ ID NO: 21724 - protein, 483 aa, Saccharophagus degradans
MRILLWLSNNLRLSDNPALHAAVDSADANGEVLPAYIKDTANPWPIQGAAAWWLHHSLAAFTNSIKNKGGVLSLFEGDPATLVPELISQNKIDAVYLSQGFEPYEVQLQANIHKWCKQHNIECKRFAGHLLLNPDTHLNKQGKPFQVFTPYYKAALATHTIPRAKPIPSNLAKVWAAKKLPKSVALNKLKLLPNLNWADQFNSQWQPGEEGAHKNLREAIEDKIASYTRDRDFPAVDGTSLLSAHLRFGEISPRQIWQQVATQMDGEQCAPFLRQLMWRDFSYALLHHWPHIPQQAFKQQFEKFPWQKASNKNVAKQLHAWQTGTTGYPIVDAGMRQLWQTGWMHNRVRMIVASFLTKHLRIHWHEGAKWFWDTLVDADLANNTAGWQWVAGCGADAAPYFRIFNPVLQGEKFDKQGEYIKTWVPELAALPAKFIHAPWLAPQDILQTAGISLGNNSTYPLPIVDHKYAREAALAAYQQLKGD

SEQ ID NO: 21725 - protein, 112 aa, Gluconacetobacter diazotrophicus
MKFIIAIIKPFKLDDVREALGTIGIQGLTVTEVKGYGRQKGQTEIYRGAEYQIQFVAKVKIEVAVADSMLDQALDTIRAAAHTGTIGDGKMFVLELQQAIRIRTNETGEIAL

SEQ ID NO: 21726 - protein, 423 aa, Thermobifida fusca
MTAQSTSLTQSLAQLDPEVAAAVDAELARQRDTLEMIASENFAPRAVLEAQGTVLTNKYAEGYPGRRYYGGCEHVDVIEQLAIDRAKALFGAEHANVQPHSGAQANTAVYFALLQPGDTILGLDLAHGGHLTHGMRINYSGKILNAVAYHVRESDGLIDYDEVEALAKEHQPKLIIAGWSAYPRQLDFARFREIADQTGALLMVDMAHFAGLVAAGLHPNPVPYADVVTTTTHKTLGGPRGGLILAKEELGKKINSAVFPGMQGGPLQHVIAAKAVALKVAASEEFAERQRRTLSGAKILAERLTQPDAAEAGIRVLTGGTDVHLVLVDLVNSELNGKEAEDRLHEIGITVNRNAVPNDPRPPMVTSGLRIGTPALATRGFGDADFAEVADIIAEALKPGFDAATLRSRVQALAAKHPLYPGL

SEQ ID NO: 21727 - protein, 145 aa, Unknown
  Shewanella sp. MR-4
MNWLKKIFSKHTSVPDDRDPNQSNAYDLIGGDKVIRAIANSFYKKMASSEETQALFAIHRAPIAESEQKLYEFLSGWLGGPQLYQQKYGHPALRARHMPFAVDETMRDQWLFCMKFAIEKHIKKPEHRAAIYEAISTLADHMRNQ

SEQ ID NO: 21728 - protein, 312 aa, Chlamydia trachomatis
MTHAKLVIIGSGPAGYTAAIYASRALLTPVLFEGFFSGIAGGQLMTTTEVENFPGFPEGVLGHQLMDLMKTQAQRFGTQVLSKDITAVDFSVRPFVLKSGKETFTCDACIIATGASAKRLSIPGAGDNEFWQKGVTACAVCDGASPIFRDKDLFVVGGGDSALEEAMFLTRYGKRVFVVHRRDTLRASKVMVNKAQANEKIFFLWNSEIVKISGDTLVRSIDIYNNVDETTTTMEAAGVFFAIGHQPNTAFLGGQVALDENGYIITEKGSSRTSVPGVFAAGDVQDKYYRQAITSAGSGCMAALDAERFLEN

SEQ ID NO: 21729 - protein, 650 aa, Nostoc punctiforme
MSKKIALLIGVSEYGEGIPPLSSALNDVEAMQRVLQNPNLGGFEQIERLLNPDAIAMRKAIQKLFREAGKDDLVLFFFSGHGITNDEDHLYLATRNTAKEDFEATAVDANFIRGQSNNCYAKRQVLILDACYSGAIAQGWRTKSVGVDIKKQLGAEGRVVLTSSSATQTSFEQEGSTLSLYTQYLVEGIETGAADKDNDGNIYVHELHAYAKAKVKIVKSNMTPDIILDKEGYNIFLAHAPKNPEAEYRKLVEKYVKEDGELDEFAFLILKPKRKTFELTDEKAEKIETDVLEPLRRRVANLKSYKQAFAKAVEQKYPLYEFTLNKLKDYQQDILGLRDEDVAQIELEITSIKEAEYQKQLQIQKQQEKEEYGNNLRRYEQKFKKAVQAQYPLDEYVHNGLKQFQQLLGLKNEHVKRIEEIILAPIEEAERIRQQQEGERLKRQREEAKRLRLQREQQKAEQVRQQEAETLQRPRQQKNDDLISENGVDYTRLHDLLKAGKWKEADQETLAVMLKATGREKDGWLSSESIENFPCTDLRTIDQLWVKYSNGRFGFSVQKRIWESVGRDYDKFGDRISWRKDEKVVKDLWFGFKQEETMEKRWLDRHEITYTTSTSYGHLPWLPNSTILNTNLFSRVQTCSFCPPTNTNRL

SEQ ID NO: 21730 - protein, 203 aa, Pichia angusta
MNNEYDYLFKLLLIGDSGVGKSCLLLRFAEDTYTQDYISTIGVDFKIRTIELDGKTIKLQIWDTAGQERFRTITSSYYRGAHGIIIVYDVTDQESFNNVNQWLQEIDRYATSGVMKLLVGNKCDLTDKKVVDYAVAKEFADSRGIKFLETSASQSTNVEQAFIVMSKQIKSQMANSQPASNTAGKPSVNLSGTSVINQQGGCC

SEQ ID NO: 21731 - protein, 755 aa, Cryptococcus neoformans
MAAGLAYDLVLIFWRIVINIFFREIRPRGAFNIPREGPVLFICGPHANQFLDPLLLFSEARKEAGRRVSVLTAAKSMNRKFIGAVARIMDSIPVARAADYAAAGKGRIILSESDPLIVTGIGTSFIEQVKPRSQLMLPKSAGYASAPVAEVISDTEIRLKSEFVVPSKDGSANVKASHRVRNESELKEGLQFKVLPHVEQEDTYGACFQRLYEGGCIGVFPEGGSHDRTDFLPLKAGFSIMALGAIAAHPGLDVKLVPVGLSYFHAHKFRSRAVIEFGSPISVDPELVELYKQGGAKKREACGKLLEQVHDGLRAVTLRAPDWETMQVIQAARRLYRVPGQHLTLGQVVELSKRMMEGYLTYKDEPKIIDLRQKVIAYNRLLRDMGIADHQVERASSRSIKSLLLLVYRVGLLLWWSILALPGALLHAPVFILAKLISIQKAKEALAASTVKIQGRDVLATWKVLVSLAVTPLLYIFYSVLATFLAYKYDLAPEWRHWTPVVIFCWLPGWAMASLKFGEAGVDVAKSLRPLFLSVWPYNQREVNRLREMREGLTNEISEVIDEFGPQLYDNFQKGRILPSASVPQTGRNPGLLSRKSQTADSSVLSHPMLWLDERIFGWSRSASVGQSVWSSSAANKQQESEAAPASPYDSEGEEEEEADVDYDDVLAIIDTRRSSGGGVGLASPKGKKRRYTGQARSEGSVASPKSDIEGVPLPRADDNGVVRLHKRPGAAKDGISETKGEEGLGLDTGREKGQ

SEQ ID NO: 21732 - protein, 441 aa, Medicago truncatula
MNNSVASENSFIIESDEEDDKDFNKGDDGNDSDSSNYSNENPPQRKQSSYNPSWPQSYRQSIDLYSSVPSPSIGFLGNSSLTRLSSSFLSTSLTRRHTPEVLPSVTKPLIQPTEEEKHQRRSSHTLLPPLSRRSSLLKKESKVSHEVPSRHCSFGQAVLNGINVLCGVGILSTPYAAKEGGWLGLSILFIFGILSFYTGLLLRSCLDSEPGLETYPDIGQAAFGTAGRIAISIVLYVELYGCCIEYIILEGDNLASLFPNAYLNLGGIELNPQTLFAVVAALAVLPTVWLRDLSVLSYISAGGVIASVLVVLCLLWIGIEDVGFQRSGTTLNLGTLPVAIGLYGYCYSGHAVFPNIYTSMAKPNQFPAVLVACFGVCTLLYAGGAVMGYKMFGEDTLSQFTLNLPQDLVATKIAVWTTVVNPFTKYPLYACMHLDGKDYSS

SEQ ID NO: 21733 - protein, 189 aa, Lactobacillus acidophilus
MSENNKHIKATDIKENPKYDTAIFAGGCFWCMVEPFDNITGVEEIISGYTGGHTINPTYADVCTGKTGHTEAVKITYDPGKISYNQLLNYYWQVTDPTDAMGQFQDRGDNYRPVIFYNSQFQKEAAEKSKQELANSGKFDKPIVTSIEKAMPFYPAEDYHQDFYKKDPERYALEESGGRSDFIKKHWSK

SEQ ID NO: 21734 - protein, 219 aa, Magnaporthe grisea
MARRPARCYRYCKNKPYPKSRFNRGVPDPKIRIFDLGRKRATVDDFPLCIHLVSNEYEQLSSEALEAARICANKYLVKNAGKEGFHLRVRAHPYHVVRINKMLSCPGADRLQTGMRGAWGKPNGTVARVNIGQIILSVRTRDSNRALALEALRRSQYKFPGRQKIIISKNWGFTPLRREEYLEKKAAGRVKVDGAYVQFLANHGSLENNMKRFPEAFAA

SEQ ID NO: 21735 - protein, 717 aa, Sinorhizobium meliloti
MFETHKVEIEWAGRPLKLETGKIARQADGAVLATYGETVVLATVVSAKAPKPGQDFFPLTVNYQEKTYAAGKIPGGYFKREGRPSENETLVSRLIDRPIRPLFPDGYKNDTQVIITVMQHDLENNPDVVAMVAASAALTLSGVPFMGPVGGARVGYINGEYVLNPHLDEMDESTLDLVVAGTQEAVLMVESEAKELPEDVMLGAVVFGQKGFQPVIDAVIRLAEVAAKEPREFNPEDHSALENAMLSIAEDELRNAYKITEKAARYAAVDAVKAKVKEHFLPEGVENPAHTAEEIAAVFKHLQAKIVRWNILDTKSRIDGRDLVTVRPIVAEVGILPRTHGSALFTRGETQAIVVATLGTGEDEQYVDSLTGMYKENFMLHYNFPPYSVGETGRMGSPGRREIGHGKLAWRAIHPMLPTAEQFPYTLRVVSEITESNGSSSMATVCGTSLALMDAGVPLAKPVAGIAMGLIKEDDRFAVLSDILGDEDHLGDMDFKVAGTDAGITSLQMDIKIEGITEEIMGVALNQAKGGRLHILGEMAKAISESRGQLGEFAPRIEVMNIPVDKIREVIGSGGKVIREIVEKTGAKINIDDDGTVKIASASAKEIEAARKWIHSIVAEPEVGQVYEGTVVKTADFGAFVNFFGARDGLVHISQLASERVAKTTDVVKEGDKVWVKLMGFDERGKVRLSMKVVDQATGKEVVAEKSEKKDGGEAAE

SEQ ID NO: 21736 - protein, 127 aa, Cucumis melo
PDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKT

SEQ ID NO: 21737 - protein, 343 aa, Thuja occidentalis
MVSQKENKKRYALALLIVVSILINHADGETIGVCYGMLVDSMPSKSDVVNLLKSRNIGKARLYEANRDALEALKGSGIEVIVGVGNTELQKIAGDQAAANGWVNDNIVPFASSVTIKYIAVGNEVYANKELINYLLPAMNNIQTAMRNANLQNIKVSTPHAASVLSNSFPPFSGKVLALIWAAILKFLSDNGSLFMGPSLSILQATLATRNSISLDYALFRSTNPIVNDGGRMYNNLFDAMVDSFIFAMEKLGYPKIPIVITESGWPSAGTDVATVDNAGTYNNNLIKHVFSSDGTPKRPGNTIETYIFALFNENMKSGSEEERHFGLFETNKNPVYPVNFSP

SEQ ID NO: 21738 - protein, 477 aa, Burkholderia vietnamiensis
MSTDDKIQTYEQEDLKRDLKNRHIQMIAIGGAIGTGLFYGSSWAIRTAGPAILLVYLVAAIAIYFVMRALGEMAVEEPVSGSYISYSNRYIHRFAGFLNGWNAFIFLLATSAADLNALGNYMHFWFPGIPIWVTAGAAVSLMFVVNIIGVKIYGEAEFWFSLVKVVAIVAMIVFGVGMVLFGIGNNGVPIGYHNLIDHGGFFPKGAGGTFLAIVMVAFAFGGVENLGLAAGEAQDVKTTMPKAVNATFWRLLIFYVGAIAVLLLVFPWTSLTSKGSPFVEVFTKIGIPAAAGIMNLVVIMAVLSAVNASVFTNSRTFYNLSLQKNAPAFLGVTNSRKVPHRAILMVFATMFAGVMLNYLMPEQAFELFSSVTVFALVCAWGSIVISHLRFRKNKIRKGEDGQLGYKMPFYPYSNYIALIFLAAVLIGIAILPDMRMSLVVSAVWVLVVFIAYTFYVRKESTRESIASETGDAKDLLA

SEQ ID NO: 21739 - protein, 411 aa, Oryza sativa
MGKHEFLTPKAIANRIKAKGLQKLRWYCQMCQKQCRDENGFKCHCMSESHQRQMQVFGQAPDRVVEGFSEEFLDAFLTLLRRAHRHSRIAATVVYNEFIADRHHVHMNSTRWATLTEFVKFLGREGHCKVEDTPKGWFITYIDRDSEQAVKARLKRKRIKSDLAEDERQERMIARQIERAQQSMGKTNGELGDDASPDGSEEEDAKEANKAAGKIAIALQRAVPGPKVNPLDDKPKVKFGFEEEDEVSARDKEKEELAKKKGKDAINAAEARRSALDELMKEEEKAKERSNRKDYWLCPGIVVKVMSKSLAEKGYCKQKGVVKRVIDKYVGEIEMLESKHVLRVDQDELETVIPQIGGLVRIVNGAYRGSNARLLSVDTERFCAKVQVEKGLYDGKVLKAIEYEDICKIFH

SEQ ID NO: 21740 - protein, 107 aa, Zea mays
  misc_feature (71)..(71): Xaa can be any naturally occurring amino acid
  misc_feature (77)..(77): Xaa can be any naturally occurring amino acid
TARPTHSVHSASAIGAVGYDKRVEITVCEEPDFVDLHGRLLHGLFRSQNDYDLDVTRCTIMYELYHNDVDXKFYASXSLCIYALKIVVSTCGSTKLLVTISRMLELA

SEQ ID NO: 21741 - protein, 72 aa, Shewanella oneidensis
MAKEDNIEMQGTILETLPNTMFRVELENGHVVIAHISGKMRKNYIRILTGDKVTVQLTPYDLTKGRIVFRAR

SEQ ID NO: 21742 - protein, 268 aa, Methanosarcina mazei
MARDRRDYYYHQAKEEGYRSRASFKLKQINEKHNVIKRGDSVVDLGAAPGGWLQVAKQLSGGKVLGVDLQRIDPIEGVETIQGDINAESTIKKIIKIVGEKGADVVLCDAAPNLSGNWSYDHARSIELATSALECAKKILKPKGNFAVKVFQGDMFNDYLDEVRNNFVRVKAYSPQASRSQSAEIYIIGKKFLTAPLRKGDKFVVDIEKLGSSGDGAVLIEGFVVFVKEVEVGEKVRIKISDVKPNFAFADVEERIESSETENREKSD

SEQ ID NO: 21743 - protein, 514 aa, Rhodopirellula baltica
MIHRAPLHLLYLNVLVIATCGLIYELLAGTLASYLLGDSVTQFSLIIGVYLSALGFGAWLSQYVTTKLARVFIEVELALALLGGFSTPLLFLAFPMIEWFQWLLFGSVIVIGTLVGLELPLLMRILKEHLEFEELISRVLAFDYLGALFASLLFPIFLVPRLGLNRTAIVFGLLNALVGLWGTYLLRPLLAKKGLDGLRGRAFLVIGLLIAGFIKADSITSLAEENTLGGRIVYADTSPYQRIAVTRNEKGFQLYLNGHLQFNSVDEYRYHEALVHPVMSVCKDARRVLVLGGGDGLAVREILRYDHVESVTLVDLDPAMTRLATQFEPLAELNGRSLERDRVTVVHRDAFLWVGEGDEQFDAVVIDFPDPGNYSIGKLYSSRFYNLLRERMTEDAGLAIQCTSPLVAPKSYWCILRTMQASGFDVTPYHAPVPTFGIWGFALARIAEDPESDSDWRLPPELSAKVAGLRYLTPSTMAGLFDLPADQQPRDVPPNRLNDQILVRFYDEEWGQNQ

SEQ ID NO: 21744 - protein, 224 aa, Ostreococcus tauri
MHSINYGHRKRRAWWTPGSCVRCVDARGTTSLRMKTRGIARWDDAACEGPGTGTRDARSGFGGDSSRARAAMKEAQERRMKMEREGHGTLSEWKEKGIFARRIMDKHLSALSKKYFDTKFIKISAPDAPFFVTKLQVKVLPCLIFFKNGVAFDRLVGFEDLGGKDDYPTAKLERILLDAGAVVPVERNDSDSEDEAEEIRREAMNRMIRGGYHRNDDDEDSDFE

SEQ ID NO: 21745 - protein, 828 aa, Picea abies
MKDANVETEDLNGMIGMKEQSSRKETEMVTESCGDNAAEFLDNSLGKAEDLIPPSSPEWTDYECTETDDLMDAARIFDCVNLPVFEDLQDLGSAAPATSSLGSATTSSSSASVSSPSSSSWVSRNIKLEAEGVERHSSTCAAPGTPSGGDHDVTLCGTDSATSCSYNQSTLVPTLQSHDHNNACNSNAECLYPDPDHSEKIDVLEELQNLDLLDGSDVWDPLFIVPDSSVLEGLQSSLCSGSFEERADDSSSEELPMVFFEWLKSNRDSISPEDLRSIKLKRSTIENAAKHLGGGKKGMLHLLKLILAWVQNHHLQRKRKLYSSHQRALNEAGMCTGTPASYNFSGMDYFNPWNSGGMVQQQDHLQNGLYNDIPPSCTVPVYLNSGDPSMFGAMQALPGSVDAIHAAKYRRIPIDDVAAGSFRDVPNLVNGNAGFTNPNDCQTILQQSAVFDGTPWPAQMAALLHQGSQNQQQAYCNSSLQASQDHKYRFAASQSHLDYTNYRSPIPAASTKEARKNRMARQRRSMSHHHHHQNRQWSSSTAMPPQPADTVNLTLMQYQRQTFMQTDRRQGWKPEKHLKFLLQKVLKQSDVGNLGRIVLPKKEAEIHLPELEARDGISIAMEDIVTSRVWNLRYRFWPNNKSRMYLLENTGDFVRSNGLQEGDFIVIYSDTKTGKYMIRGVKVPRSDTTSASAAATPPTTTKSASGSCLIPDGEDAAAGARVLKIGKSYGVPTSQAVGVTFADSMADASSSSVSDATHSCSEGDPFLRDMINQFSPTKGPENDNVPNLERFPSLDSGDLTIEEILDLVESPDMADPGKSPDNIGESKA

SEQ ID NO: 21746 - protein, 570 aa, Unknown
  Marinobacter sp. ELB17
MPGDPSAGHFAKDAIMQGHASTPAATKAWQALLHHQQRLTTKPMAQLFAEDSQRASRYLLEAAGLTLDFSKNRLDDGALADLMALAEECQLASRRQALYAGEPVNNTENRPALHTALRASAGQTIQVNGKNVIEEVHATLEQMQQFVNAVTGGERRGCTGERFTDVVSIGIGGSFLGPKLATEALTPYHHGGIRCHYAANIDGTEICEILRQISPHTTLFLVQSKSFKTPETLENAKVAREWLVQHCPQTDAVARHFAAVSANVDAAQAFGIEADSLFPMWEWVGGRYSLWSAIGLPVALSIGMDNFRQLLAGAEAMDEHFMQAPLAQNMPVVMAMLGVWYNNLWGACSHAILPYDQYLRSLPDHLQQLDMESNGKRVTRAGVAVTYHTGPIIWGGLGANGQHAYHQLIHQGTRLIPADFIIPLVSHNPIANHHADLFANCLSQSQAMMAGKTLEQARRELIAEGRSAQDVDRLASHKVVPGNQPSNTLVMQQLTPCTLGAMMALYEHRTFVQGVIWDLDSFDQWGVELGKQLGQNILPRLLGQPAPANEGNSDSSTDALIARFRAANGA

SEQ ID NO: 21747 - protein, 567 aa, Solanum ptychanthum
PRKGCDVLVEALEREGVTDVFAYPGGASMEIHQALTRSNIIRNVLPRHEQGGVFAAEGYARATGFPGVCIATSGPGATNLVSGLADALLDSIPIVAITGQVPRRMIGTDAFQETPIVEVTRSITKHNYLVMDVEDIPRIVREAFFLAKSGRPGPVLIDVPKDIQQQLVIPNWDQPMRLPGYMSRLPKLPNEMLLEQIVRLISESKKPVLYVGGGCSQSSEELRRFVELTGIPVASTLMGLGAFPTGDELSLQMLGMHGTVYANYAVDSSDLLLAFGVRFDDRVTGKLEAFASRAKIVHIDIDSAEIGKNKLPHASICADIKLALQGLNSILEGKEGKLKLDFSAWRQELNEQKVKYPLNFKTFGEAIPPQYAIQVLDELTNGNAIISTGVGQHQMWAAQFYKYKKPRQWLTSGGLGAMGFGLPAAMGAAVGRPGEIVVDIDGDGSFMMNVQELATIKVENLPVKIMLLNNQHLGMVVQWEDRFYKANRAHTYLGDPANEEEIFPNMLKFAEACGVPAARVTHRDELRAAIQKMLDTPGPYLLDVIVPHQEHVLPMIPSGGAFKDVIT

SEQ ID NO: 21748 - protein, 567 aa, Solanum ptychanthum
PRKGCDVLVEALEREGVTDVFAYPGGTSMEIHQALTRSNIIRNVLPRHEQGGVFAAEGYARATGFPGVCIATSGPGATNLVSGLADALLDSIPIVAITGQVPRRMIGTDAFQETPIVEVTRSITKHNYLVMDVEDIPRIVREAFFLAKSGRPGPVLIDVPKDIQQQLVIPNWDQPMRLPGYMSRLPKLPNEMLLEQIVRLISESKKPVLYVGGGCSQSSEELRRFVELTGIPVASTLMGLGAFPTGDELSLQMLGMHGTVYANYAVDSSDLLLAFGVRFDDRVTGKLEAFASRAKIVHIDIDSAEIGKNKLPHASICADIKLALQGLNSILEGKEGKLKLDFSAWRQELNEQKVKYPLNFKTFGEAIPPQYAIQVLDELTNGNAIISTGVGQHQMWAAQFYKYKKPRQWLTSGGLGAMGFGLPAAMGAAVGRPGEIVVDIDGDGSFMMNVQELATIKVENLPVKIMLLNNQHLGMVVQWEDRFYKANRAHTYLGDPANEEEIFPNMLKFAEACGVPAARVTHRDELRAAIQKMLDTPGPYLLDVIVPHQEHVLPMIPSGGAFKDVIT

SEQ ID NO: 21749 - protein, 506 aa, Methanosarcina barkeri
MGSDSGTESAVDEIQKAAKSDEKFQEAVSAQNLEKKDPIKVIIIGGGACGMAVATKIRRQSDFEITVISRDSHTAYSHCGIPFVLGREIKSFEKLIVKPKDFFKRNRIDVRLNECVSSIDLDLKVVRTGERTYPFDKLVIATGSLPFIPLTGSTNVLPYGVFTLRNLDDGVLFEKALKTVERVCIIGAGTIGIECAVALSRRGVKAILINRSKNLLSRQLDPDISEIIREHLESLGIEVISGELAVYPENFWKEKILYVGERQLPADLVLLASGVKPEVSLALEAGIEIGKAGGIIVNEILQVKAGDKAREEFLPYVYAGGECVEVTDLITGEAKLSQLGTTARHMADIIGNNITGKSTPLGPLANPWVAVAGDLQFGGVGITSKEAESHGIKINTGFSLSRTRASYYPGRKDLYIKLLFKDDILVGAQLAGGEGIKERIDALSLAIRKKTTIRDLLDLETCYTPPVSMLVDPLRLAVKATIRNIKEKKGKQIQEKEMEGKQIQEK

SEQ ID NO: 21750 - protein, 543 aa, Unknown
  Acinetobacter sp. SE19
MSQKMDFDAIVIGGGFGGLYAVKKLRDELELKVQAFDKATDVAGTWYWNRYPGALSDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRFMFETFGDIATNMEANIEAQNFIKGKIAEIVKDPAIAQKLMPQDLYAKRPLCDSGYYNTFNRDNVRLEDVKANPIVEITENGVKLENGDFVELDMLICATGFDAVDGNYVRMDIQGKNGLAMKDYWKEGPSSYMGVTVNNYPNMFMVLGPNGPFTNLPPSIESQVEWISDTIQYTVENNVESIEATKEAEEQWTQTCANIAEMTLFPKAQSWIFGANIPGKKNTVYFYLGGLKEYRSALANCKNHAYEGFDIQLQRSDIKQPANA

SEQ ID NO: 21751 - protein, 338 aa, Unknown
  Shewanella sp. MR-4
MKNSADITVLGAGSYGTALAISLASNGHKTLLWGHDPAHMQTLAQDKCNQAFLPGIAFPECLHIEADLAKALAASNNVLVVVPSHVFGSVLAQAKPLLRQDARIVWATKGLEPETGRLLQDVARDVLGEQYPLAVLSGPTFAKELAMGLPTAISVAGTCPKFTAELVELLHSPKRLRVYANDDFIGLQLGGAVKNVIAIGAGMSDGIGFGANARTALITRGLVELTRLGEALGASTATFMGMAGLGDLVLTCTDNQSRNRRFGLALGKGCDVDTAQAEIGQVVEGYRNTKEVFTLAKRMGVEMPITEQIYQVLYQGKAPLDAAKELLSREKKSETPAQ

SEQ ID NO: 21752 - protein, 800 aa, Unknown
  Delphinium 'MagicFountains dark blue'
MEMLGKRSNYSLLSQFPDDDTHHHQPPYHHSNFPYESHSADGKKNKGKLDWDGDHRHQLGGGRIAGFAPSIGLQRQSSGSSFAESSISGDYGVPTNDPEVFGCFQDEMLQSGELAAARGREAAASSSTKSWAQQTEESYQLQLALALRLSSDATCADDPNFLDTLPDESNRSSLVSAEVLSHRFWVNGCLSYFDRIPDGFYLINGMDPYVWTICTDMQKNGRVPSIESLKAMHPGDNSLVEVVLIDNHTDYRLKELHSRVISLSQSCNSSNELVEQLGRLVCIHMGGAASPDESDLAPRWKECSEVLKDCLDSVVIPVGSISIGLCRHRALLFKVLADIIDLPCRIAKGCKFCRTADASSCVVRVGLDREYLVDLIEKPGCLYEPDSLLNGPSSILIPSPLRLPNFNPVERTEDSKSLAKKYLMDCQSLNLVFSDAPAGLSDNMQHQTDPSFEHLDGTHADMVNLMSVSGSADSSVSLPPKVAQSEEHGWQRVRPTHTSRDPGSQVVPSTEFSFDVEDLDIPWDNLIIKEKIGAGSFGTVHRADWNGSEVAVKILMEQDYHATCFKEFIREVALMKRLRHPNIVLFMGAVTRRPHLSIVTEYLARGSLYRLLHKSDPREIPDEFRRISMAYDVAKGMNYLHRRNPPIVHRDLKSPNLLVDNMYTVKVCDFWLSRLKANTYLSAKSAAGTPEWMAPEVLRDEHQTEKCDGYSFGVILWELMTLQKPWNNLNQAQVVAAVGFKHKRLPIPSSLDPDIAVLIEACWSKDPSKRPSFSSIMEYLQSLVAPPTPQPAHSAFSTLT

SEQ ID NO: 21753 - protein, 345 aa, Capsicum annuum
MDRVKGPWSPEEDELLQQLVQKHGPRNWSLISKSIPGRSGKSCRLRWCNQSSPQVEHRPLTPEEDDTIIRPHARFGNKWATIARLLNGRTDNAIKNHWNSTLKRKCCSLSADEGRELADQIFENHQPPLKRSVSAGSAMPVSGFHFSPGSPAGSDSDSSLHVTSSSQSHVFKPVAKTGGIFPPPSIDISSPSIDPPTSLSLSLPGADLAELSSRSAESTQSKNPFQLSLPPPVQVPPPPPPPPPPPQPQPVTAVPFEQQDKIFVPFSQELLRVMQEMIKTEVRNYMMGIEQKQQHPQQQHYQQQQQFQQQTHQLPSGLGLGLCMQQASDGYRDRAANRMGISKFD

SEQ ID NO: 21754 - protein, 267 aa, Rhodopseudomonas palustris
MLADLIEAPTPEQHFSSPPLRMAVASSEGIRIDQHFGQTELFRVYDVSASGAVAVETRDVNQHAAGDEDRRDTICRMLKDCRILLVAKIGITPQEKLAGHGIEAIDRFAGKAVEAALTEVYVSKSAAKADLPLDASTFRLMHTMLRVTDLARSIDFYTRLLGMIVLEQREHKKNQFTQTYLGYAAGFSGMTLELVFNWSDDQAYTHGTSYGHIAIGVTGIAALCDRLAAQGVKMPRPPRAQRHGEAIVAFIEDPDGHRIKLVQAPNA

SEQ ID NO: 21755 - protein, 285 aa, Burkholderia thailandensis
MSTTLLFHPTPDVAYGFPNARRLARIESAHQEIEVWETSLLGRLFTLDGRPMTSVGDEFVYHECMTHPAALAHPAPRKALVLGGGDGGAARQLLRHPCIERIVVAELDAAVVDMARRFLGDVHQGALDDPRVELVIGDAARYVDHACEHFDLAVFDLTPPDSPAAGLYTPKFYTRLKRILTPQGAVSLHLGSPLYHEARVVSLLAGLRASFAVVAPLCAHVPLYGSPWLMAIASDALDAASLFSHDVEARLAERRIEGLRFYDAKLHPALFTLPHALRDTLGMHR

SEQ ID NO: 21756 - protein, 303 aa, Pseudomonas aeruginosa
MRHLTLATTQFACSWSLDDNLDRAERLVREAAARGAQLVLLQELFATPYFCIEQDHRHLRLAETFRGSRVLARFSSLARELGVVLPLSWYERAGNARFNSLAVADADGRLLGVYRKAHVPNAIGYQEKEYFSPGDSGFRVWDTAVGRIGVGICWDQWFPETARCLALLGAEVLLFPTAIGSEPGAAQLDSRDHWQIAQRGQAAANLVPLVAANRIGREVACGDPALAMRFYGSSFIADHKGALLAAAGRDEEAVLVCGLDLDAIGEERLAWGVYRDRRPELYGPLMSLDGRDPASRHAWEVSP

SEQ ID NO: 21757 - protein, 75 aa, Enterobacter nickellidurans
MMLGQGSDVKSAQEKTGQVVEGYRNTKEVRELAHRFGVEMPITEEIYQVLYCGKNAREAALTLLGRARKDERSSN

SEQ ID NO: 21758 - protein, 469 aa, Zymomonas mobilis
MSDTRPILIWFRHDFRLRDNAAITAAIQSRNPVICFYIQESADAKTESAADWWVAESLLALNRQLKEKGGQLHLFEGDAEKIIPEIVQQSHACKLFWNRRYDFKGKETDQILKKSIRAMGLEVQSFPNNLLNEPWTVKNDKGQPFRIFSAYWRAVQRHMNIQAVLPCPENWVFSTREIRHCLGYKDIAILAKETQDSSWKIKLKQSHRFGENEAHKQLKSFIENDLAHYAKERDFPAKDGTSLLSAFLRSGQISSKQIWHEVTKNGSGEGTSKFLEELGWREFAWSVLWEHPDLNQHNLRPEFDKMPWKKASDNLQRWKEGQTGYPFIDAGMRALWQTGFMPNRLRMVTASFLVKHLLIDWREGKKWFAQTLVDYDPACNATNWQWVAGSGIESAPYFRIMNPILQSQKFDPDGQYIREWVKELADVSTAFIHTPWKADKQPANYPLPIIAHEEGRNRALRAWKEIRHA

SEQ ID NO: 21759 - protein, 645 aa, Gibberella zeae
MASPISRSILRRMSTQVTPKTEAAPEMKEWTTSQATAAPPKIVSAARKKQRIVQDGILSLRTNSAHEHKVSTWTTPNKNSNSATPATPAQQYREWKRIQANTRSLGSKLVKRYIPTELVNNPPGPEDITLELLLASQTHIGHKTSLWNPANSRYIYGVRQGVHMISLETTAAHLRRAARVVEEVAYNAGLILFVGNRKGQMEIVTQAAEMAGACHLFTKWTPGGITNRDVILKMAGTKVVDHKDVELPGFENYRGSARPLMPDLVVCLNPLENYTLLYECGLKSIPTIGVIDTNADPSWVTYTIPANDDSLRAMAVVGGVLGRAGQRGYQRRMADAKKDKSTWQNPPDIVQHMSREKKVAIAERKNVMGQMQHNLEGFSEEEQKILREQFYGEESEVTETDLIKMMAQTASVDVKPSAADSASDSRLANIEEELSGLKAAAEAIEAETHYAPNPTPTESAPASSEQPIVSEVVVEAQSAESSPDSRLLSIEEQLSSLKVVAEAIEAEAQSATKPTESVLASAEQPIVSEVVVEAQVAAQPAQSSPDSRLASIEEQLSSLKVVADAIEAETQTTTKPAESIPSSPEEPVISQVVVEAQVESQVESQIETQPAESTSDSRLTSIEEQLSGLKDVAEAIEADIKSGKQ

SEQ ID NO: 21760 - protein, 687 aa, Triticum aestivum
MDASAGSSPPRHSQGDAPRRGGPHRGKGPAVEIRQGEDDFMFAQDTFPALPDFPCLSSPSSSTFSSSSSSNSSSAFAAPAGAGGRGAEGARGEPSEPAAAGDGMDDLSDIDHLLDFASINDDVPWDDEPLFPDVGMMLEDVISEQQLQQPPAGHGTAGRTAPHAASGGGEDAFMGGGGTGSAADDLPLFFMEWLKNNRDCISAEDLRSIRLRRSTIEAAAARLGGGRQGTMQLLKLILTWVQNHHLQKKRPRVGAMDQEAPPAGGQLPSPGANPGYEFPAETGAAAATSWMPYQAFSPTGSYGGGAIYPFQQGCSTSSVAVSSQPFSPPAAPDMHAGAWPLQYAAFVPAGATSAGTQTYPMPPPGAVPQPFAAPGFAGQFPQRMEPAATREARKKRMARQRRLSCLQQQRSQQLNLSQIQTGGFPQEQSPRAAHSAPVTPPSSGWGGLWAQQAVQGQLMVQVPNPLSTKSNSSRQKQQKPSPDAAARPPSGGAATPHRPGQASASNKQRQQGARTPAAAPAAGDKNLRFLLQKVLKQSDVGTLGRIVLPKEAETHLPELKTGDGISIPIEDIGTSQVWSMRYRFWPNNKSRMYLLENTGDFVRSNELQEGDFIVLYSDVKSGKYLIRGVKVRAQQDLAKHKNASPEKGGASDVKAGGEDGGCKEKSPHGVRRSRQEASSMNQMAVSI

SEQ ID NO: 21761 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQTIISYRSAGDVTLQ

SEQ ID NO: 21762 - protein, 316 aa, Oceanicola granulosus
MSAASTVPVIDLAAYRAAGEAERAAIAAEVDRACRETGFLAIAGHGVPEDEIAAVRAAVRGFFDGPAEAKEAVRPAKGQPYGYLGLGAEALARSRGEETPPDLKESFNGGPLTRPEGESDPDALAFCYAPTPFPDQPGFRAAWEAYYARMETLAAQIMELFAAALDLPADYFAPYIDAPISALRALNYPAAERPPEAGQQRAGAHTDYGSLTILLPDPGSRGLEILTPGGEWRGVAPPEGAFVINIGDLMELWTGGRWRSTLHRVVVPPEAALERRGSLAFFHQPNWHAEIAPLEGGGASVTSGPYLMAKFAAATA

SEQ ID NO: 21763 - protein, 360 aa, Debaryomyces hansenii
MSTAAFKRQSVPLSKLFQSYGKNNSQSKYGGYFLATLIGSGILATSYFNNNKNGNTPSNNHKKLLAGSGIVNTAAIPKGKSIKDYQSLYNEIAEKVRDQDDADDGAGRYGLLTRLAWHTSGTYKKEDNTGGSYGGTMIYKPESTDGENSGLNHGRDFLQEFKDKYSWLSHGDLWTLGGVVAVQECGGPKIKWRPGRQDISDKTRVPENGRLPDASKDADYVKGVFGRMGFNERETVCLIGAHCLGKCHKENTNYDGPWGPSFNMFTNDFFVRLLQNWHVKKWDGKKQYEDDETNSFMMLPTDMALKEDSSFLKYVKMYADDEKLFFSDFAKNFSTLLELGVTFPDSIKPTEFKTLDEQDK

SEQ ID NO: 21764 - protein, 316 aa, Brassica napus
  misc_feature (16)..(16): Xaa can be any naturally occurring amino acid
  misc_feature (20)..(21): Xaa can be any naturally occurring amino acid
  misc_feature (23)..(23): Xaa can be any naturally occurring amino acid
  misc_feature (31)..(31): Xaa can be any naturally occurring amino acid
  misc_feature (53)..(53): Xaa can be any naturally occurring amino acid
  misc_feature (57)..(57): Xaa can be any naturally occurring amino acid
IGEGGFGQVFKGWLDXKTLXXSXPVVGIPVXVKKSNPDSAQGLHEWQCEVKFXGKFXHPNLVKLLGYCWEENQFLLVYEYLPKGSLENHLFSKGEALTWDTRLKIAIEAAQGLNFLHNSEKSVIYRDFKASNILLDSNFNAKLSDFGLAKLGPINGFSHVTTRVMGTQGYAAPEYMATGHLYVRSDVYGFGVVLLEILTGLRALDPNRPPLQLNLVEWAKPGLTQKKKIQKMMDPRLEHKYPISAVIRTAALILRCVEEDPKNRPPMDEVLRELEIVRTMRDEPKEEKRKRSGGGPDNNRINRYGSPHVRGTGRTR

SEQ ID NO: 21765 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQLNCHNRSMGSTTLQ

SEQ ID NO: 21766 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQYHSGSRSVITSGLQ

SEQ ID NO: 21767 - protein, 297 aa, Unknown
  Marinobacter sp. ELB17
MYFPTIEDYVGKTPLVRLQRLPGDTSNVILAKLEGNNPAGSVKDRPAISMIQQAEIRGDIKPGDTLIEATSGNTGIALAMAAAIKGYRMVLIMPSNMSEERRASMRAYGAEIIAVSKEDGMEGARDLAERMQAEGKGKVLDQFANADNPLAHYRTTGPEIWQQTNGRVTHFVASMGTTGTVMGVSRYLKERNPDVRIVGLQPSEGAAIPGIRRWPEAYMPKIFDAKAVDQVMDIGQVEAETTMRALAEKEGIFCGVSSGGSIAAALRLSQTLENAVIVGIICDRGDRYLSTGVFPGA

SEQ ID NO: 21768 - protein, 137 aa, Glycine max
  misc_feature (84)..(84): Xaa can be any naturally occurring amino acid
YDIDTEAGEKRKEEEMIELEGPLGKSDAVNHELVSLERELSTLRKNGKVDAFGLYLYGLVLKQKGSENLARTVLVESVNSYPWXNWNAWTELQSLCKTVDILNSLNLNSHWNEDFFLASVYQELRMHNDSLSKYEYL

SEQ ID NO: 21769 - protein, 489 aa, Aspergillus nidulans
MSTVVEEATRIARQFEYSPEQVQRGVKEYIREVEEGLSEEGTTLSQIPTFVTSVPNGTEKGLYLAVDLGGTNFRVCSIDLHGNHTFSLTQSKIMIPREMMTSGSAKELFLFLARQIESFLRIHHNEHFEAHLKRKIAGTAREEDLFDLGFTFSFPVRQLGINKGTLIRWTKGFDIPDAVGQDVCALLQNAIEELNLPVRVAALVNDTVGTLMARSYTSPGETGTFLGAIFGTGTNGAYVEKLNKITKMAKIEHSDYDKSTGEMIINAEWGSFDNHLSVLPTTEYDRQLDADSNNPGIQMFEKRVSGMFLGEILRLVLLDLHKSQGLFKPASGSDVFIPESSSLYRQWGIDTSLLSIVEADKSKDFEQVKSALKDHLKVERASENDCKAVQTVVHAIGKRAARLAAVPIAATLISTGKLKEELVDIGVDGSLVEFYPNFEGYMREAMREVPEVGDAGDKKVRIGISKDGSGVGAALIALVASKEGTKPPL

SEQ ID NO: 21770 - protein, 383 aa, Unknown
  Citrus sinensis x Poncirus trifoliata
MAIDCIKNIPTMLHQPKEEYKDEQKPLVFDASVLKHQTQIPKQFIWPDDEKPCVNAPELQVPLIDLGGFLSDDPVAAKEASRLVGEACRKHGFFLVVNHGVDSSLIADAHRYMDHFFELPLNEKQRARRKLGEHCGYASSFTGRFSSKLPWKETLSFRYSAEKSLSNNIVEDYLLNTMGDEFKQFGRVYQDYCESMSRLSLGIMELLAISLGVGRAHFKEFFEENDSIMRLNYYPPCQKPELTLGTGPHCDPTSLTILHQDQVGGLQVFVDNEWRSISPNFEAFVVNIGDTFMALSNGRYKSCLHRAVVNSQTTRKSLAFFLCPKNDKVVSPPSELVDTYSSPRIYPDFTWPMLLEFTQKHYRADMKTLEAFTNWLQQKKQLK

SEQ ID NO: 21771 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQILTGLRSVGAVVLQ

SEQ ID NO: 21772 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQTGFYHRSSTKVSLQ

SEQ ID NO: 21773 - protein, 353 aa, Medicago truncatula
MYALDQFQLLHQDHQMTMKMDHMTTRKRETKKTSPSPPREEDKVHVVDLHGMSLDSLPKLSLDLAIISKLNLSNNNLQNIPESLTARLLNLEMLDVHSNQLRSLPNSIGCLSKLKVLNVSGNFIQSLPATIENCRALEELNLNFNMLSKLPDTIGFELIKLKKLAVNSNKLVCLPRSTSHMMTLMVLDVRLNCLRSLPDDLENLVNLETLNVSQNFRYLESLPYSIGLLLSLVELDVSYNNIKTLPDSIGCLQKLQKLSVEGNPLISPPQEVVEQGLHVVKEYMCNKMNSSHHIPTKKRWWMVKCGTFNGEMKRSEHKGFHKLHYQPMNGLASPGFMGRLSPLRLFSPRRSLS

SEQ ID NO: 21774 - protein, 385 aa, Cyclamen persicum
AGGVAAGAALIFAAPAIAFAWWRRRKPQEYFYDVPAEEDPEVHLGQLKRFSLRELQVATDGFSNKNILGRGGFGKVYKGRLADGSLVAVKRLKEERTPGGELQFQTEVEMISMAVHRNLLRLRGFCMTPTERLLVYPYMANGSVASCLRERPPSAPPLDWPTRKRIALGSARGLSYLHDHCDPKIIHRDVKAANILLDGEFEAVVGDFGLAKLMDYKDTHVTTAVRGTIGHIAPEYLSTGKSSEKTDVFGYGIMLLELITGQRAFDLARLANDDDVMLLDWVKGLLKEKKLEMLVDPDLEKNYVEPEVEQLIQVALLCTQGSPVDRPKMSEVVRMLEGDGLAEKWDEWQKVEVLHEEVELAPHPNSDWIVDSTENLHALELSGPR

SEQ ID NO: 21775 - protein, 279 aa, Schizosaccharomyces pombe
MTSFPASHGFGPRKRGYQMDLTNVQPVENKPAWISMKSPLEKEIANEYEALKVTERKEDTQDYNEPELHNSNDPTVDLYADTYATQAATESDSELEDALFSQLDEFDDTAYREQRLEMLKKEFARVEAAKEKGHMQFLTVENEREVMDFTLSSKKVVIHFYHPDFIRCKIIDSHLEKIAKVHWETKFIRIEAANAPFLVVKLGLKVLPAVLCYVNSQLVDKIIGFADLGNKDDFETSLLEFRLLKSSAIDRLKEESSSNKSIYHDELQNNQSDDSDFFE

SEQ ID NO: 21776 - protein, 133 aa, Oryza sativa
MKVRDYELDQYGVVNNAIYASYCQHGRHELLESVGISADAVARSGESLALSELHLKYYAPLRSGDKFVVKVRLASTKGIRMIFEHFIEKLPNRELILEAKATAVCLNKDYRPTRISPEFLSKLQFFTSEGSSS

SEQ ID NO: 21777 - protein, 326 aa, Unknown
  Rhodococcus sp. RHA1
MLTITALTPPESLSRTRETGRTPLRVGLVQHRWHDNDEDLRAELDEGIAAAAKLGARVVFLPELTLSRYPASTPGGDNPGRTAEDLLTGPTFTFAAKAAAEHGVLVHASLYERNDSEDGVQYEDGLGFNTAILVAPSGELLARTRKLHIPVTAGYYEDTYFRGGPATDPYPVHTAEALGGVKLGLPTCWDEWFPEVARAYSLGGAEILVYPTAIGSEPDHPQFDTQPLWQQVIVGNGIANGTFMVVPNRHGSEGLITFYGSSFISDPYGRILAQAPRDESAVLVADLDLQQREDWLALFPFLATRRPDTYGVLTEPVDHASPFGRA

SEQ ID NO: 21778 - protein, 303 aa, Mycobacterium tuberculosis
MTKWTAADIPDQTGRTAVITGANTGLGFETAAALAAHGAHVVLAVRNLDKGKQAAARITEATPGAEVELQELDLTSLASVRAAAAQLKSDHQRIDLLINNAGVMYTPRQTTADGFEMQFGTNHLGHFALTGLLIDRLLPVAGSRVVTISSVGHRIRAAIHFDDLQWERRYRRVAAYGQAKLANLLFTYELQRRLAPGGTTIAVASHPGVSNTELVRNMPRPLVAVAAILAPLMQDAELGALPTLRAATDPAVRGGQYFGPDGFGEIRGYPKVVASSAQSHDEQLQRRLWAVSEELTGVVYPVG

SEQ ID NO: 21779 - protein, 574 aa, Nostoc punctiforme
MVALTEKTEKRLTIQTVEIAQETTAIRSLDWDRDRFDIEFGLQNGTTYNSFLIRGEQTALVDTSHEKFRQLYFDTLTGLIKPTEIDYLIISHTEPDHSGLVKDLLLMAPEITVVGSKVAIQFLEDFVHQPFKRRIVKNGDRLDLGNGHEFEFVIAPNLHWPDTIFSFDHKTKTLYTCDAFGLHYCSDSTFDEDLVAIEEDFHYYYDCLMGPNARSVLSALKRMGELKTIDMIATGHGPLLSHNVEELVGRYRIWSQTQAKPETVIGIFYVSEYGYSDRLVQAIANGIGKTGVAVEIVDLGSEVDLQELRELVSRCAGLIVGLPPASGAASIQSALSTVLGSAKEKQAIGVFETGGGDDEPIDPLLSKFRNLGLTTVFPAIRIKQTPTENTYKLCEEAGTDLAQWVTRDRSIKAMKSLGADLDKALGRLSGGLYIITAKKGDVSSAMLASWVAQASFKPLGFSIAVAKDRAIESLMQVGDRFVLNILEEGNFQPLMKHFLKRFAPGADRFEGVRTQPAENGAPILNDALAYMECEVVSRMDCGDHWAVYSNVYAGRVSKPDALTAVHHRKVGNHY

SEQ ID NO: 21780 - protein, 621 aa, Listeria monocytogenes
MCGFVGCVHDRITEITGADKETFRQMNSMITHRGPDDEGYFTDDHVQFGFRRLSIIDVENGHQPLTYENERYWIIFNGEVYNYVELREQLVAEGMTFETESDTEVIIATYAKYKEKTAERLRGMFGFVIWDKQEELVYGARDPFGIKPFFYAEEDGKLFMGSEKKSILHALKEKELDEVSLQNYMTYQFVPEPDSLTKNVKRLEPGHQFTKKIGQPMEITTYWKASFAPVTKSEDAWIKEVRDVMYDSVKMHMRSDVPVGSFLSGGIDSSIIAAIAKEYHPAIKTFSVGFERDGFSEIDVAKETADKLGVENISYVISPEEYMKELPKIVWHMDDPLADPAAIPLYFLSREARKQVTVALSGEGADELFGGYNIYNEPNSLAMFNKMPSVFKSMLNSVARIMPEGMRGKSFLERGTTPMEERYIGNAKMFTEKEKQILLPKYQAGHDYTNITDPFYAETTNYHPVERMQYIDIHTWLRGDILLKADRMTMANSLEVRVPFLDKEVYNVARNIPDTMKTTNGTTKYILRKAAATFVPEHVLNRRKLGFPVPIRHWLKDEMNAWVKNIIKESPTDHLINKQYVLGLLDDHCAGKFDYSRKIWTVVIFMIWYDVYVADKYDFGK

SEQ ID NO: 21781 - protein, 1068 aa, Burkholderia thailandensis
MLFNATQQEELRVAIVDGQKLIDIDIETAGREQRKGNIYKGVVTRIEPSLEACFVNYGEDRHGFLPFKEVARQYFKEGVDMRSARIQDALREGQELIVQVEKEERGNKGAALTTFISLAGRYLVLMPNNPRGGGVSRRIEGDERQELRETMAQLQIPDGMSMIARTAGIGRSAEELQWDLNYLLQLWRAIEAASQSGHPGQPMLIYLESSLVIRAIRDYFQPDIGEILIDTTEIYDQARAFMDIVMPDNVGKVKRYHDDVPLFSRFQIEHQIETAYSRTVPLPSGGAIVIDHTEALVAIDVNSARATKGADIEETATRTNLEAADEVARQLRLRDLGGLIVIDFIDMESAKSQREVEQRLKDALKHDRARVQMGKISRFGLMELSRQRLRPALSEGSHVTCPRCNGTGHIRDTESSALQVLRIIQEEAMKENTAAIHCQVPVEVTAFLLNEKRQEINKIESRFKVGVVLIPNKHLDTPHYKLERLRHDDARLDDPRASWKMAEEAARELEAETGYSKRAEETKPRQEAAVKGITPERPAPSPAPQRQSAPEAAAPVAAAPASGGFMKWLKGLFGVQPAAAPAPAPAAQEAAARPARERGERGEKAERGERGGDRNRNRRGGAAQQAGGRDQAAAGGGRGQAQRAEREGKETREPREGREARGGRDNREGREAREARETREPREPREQREPREPREPREQREPRERAETADASEAPRGERRERGERRKPAQHVATLETVNRGESALAEAAEKPAYAPGAEAGVDADSNARDGEERRRRRRGRRGGRREREDEGAAHAAEGGEGVTVEAFEHAEQAQQGVAPAAGHEPQHVAQAGAGAAAVAAAAIAADSAAHVESGAKVEPQPAAGAPVADTQRAEAAPARLVEAPAQAASTAQAEVEQAAPATAAHVQPAAADVAHEPPAPAATAPAEAAPAEAPAAEASEVAAPAVAPAVVAEPAPVAETQQPAAVAAAAPLAAPVAHEPAPVAETHVPAAARAEAATPASVSTAGASLDTVLEAAGLVWVNTDTDKLRAAQAAAAQIVPPARVPRERKPLPPVDAAPMQQVETTHR

SEQ ID NO: 21782 - protein, 414 aa, Hyphomonas neptunium
MDLSGAKRIVIVGAGQAAAQAVQSLRLGGYAGELTIVGEETALPYQRPPLSKAYMKGEMAEERLYFRPAAWYEDNKIEVMLGSRVTSIDRAARVAHLEHGAELPYDALVIATGSRPRTLPCQGADLTGVHDLRSLSDVERIRPQMVEGRRMVIIGAGYIGLEAAAVARTMGLDVTVLEMAPRVLARVTSPVMSEFYAAEHIAKGVKILTSTALSHLEGKDGHINAAALADGTKLPADIVLVGIGILPNEELAKDAGIACSNGILTDRDGRTSDPHVFAAGDCASRPLVHYGRTGRLESVHNAIEQGKLVAAAILGQNRPAEDCPWFWSDQYDLKLQIAGLSTDYDTIVLRGDPEDRKFAAFYLRNGTLIAVDAVNSPPEFLASKKLIMTGAKIAPEVLSDTSIPMKDIAAKAAA

SEQ ID NO: 21783 - protein, 372 aa, Unknown
  Shewanella sp. ANA-3
MNLSEIAYRRVVVKLGTSVLTSGSKQLDKAHMVELARQMAALMRSGVEVVLCTSGAIAAGREHLQYPELPDTMANKQLLAAVGQSQLILAWAQLFSIYGLHVGQLLLTRADLHDRERYLNARDTLNALLANNIIPIINENDAVATNEIKVGDNDNLSARAALLCDADLLILLTDQKGLFDADPRTNPNAKLISQVEKIDDSLRLLAGGSVSGLGTGGMSTKLEAADIARRAGIEVVIASGHHPDVIKKVVGKESVGTHFSAIENPLESRKQWILAGPAAQGSLVLDAGAVKAVTEKGRSLLSKGIIGVKGEFERGATLQLVDQKGKIIARGITRYCGEALGLIAGKHSDEIESVLGYDYGDAIVHRNDMVVL

SEQ ID NO: 21784 - protein, 425 aa, Unknown
  Shewanella sp. ANA-3
MSQTNQAQYLQQLGSQAKQASYALANLSAVQKADLLEAIAEALTQNTQAILAANAKDVAAAKAEGLNDAMIDRLLLNESRLAGIIGDIGDVVRLADPVGEEFGSRVLDNGLRLTRRRVPLGVIGVIYEARPNVTVDIAVLALKTGNAVILRGGKETLESNKLISEVIRGAIASQGLPVDAVQLIDSPDRALVTGLLKLDQYVDMIVPRGGQALQRLCAEQATIPVILGGIGICHLYVDKHADLERALEVIANAKVQRPTVCNALDTLLVDTAVAERFVPQIAEYLHRLGVRFSVCEQSYALLDGLGFDISPATEQSFATEWLSLTLGIKVVSDIDTAIAHIRTYSSGHSEAILTDDIHVATHFMNEVNSAAVYVNASTRFTDGGQFGLGAEVAVSTQKLHARGPMGLEALTTYKWLAWGDYTSRA

SEQ ID NO: 21785 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQTNTPCRSGNNMNLQ

SEQ ID NO: 21786 - protein, 500 aa, Unknown
  Marinobacter sp. ELB17
MHPEQNFINAVWFKRDLRLADHAPLQAACHAGLPVMLLYMVEPSQRQNPHLSLRHWRFIMKSISDMNLQLNRAGCEAGVALVHGECIESLTRLQQRYSLHTLFSHEETGDASTFERDQQVAHWCQQQDVNWQEFTTNAVIRGVFNRDGWDRHWQQVMGAPQQNADLRQLRVIRPTALPDWQPPSEWQQANSQFQTGGELAANQWMESFFNARGRFYSGSVSSPIASRTFCSRLSPYLAFGNISLRQAYQQYRANRQKAGWDRSLRAFASRLHWHCHFIQKFESECAMEQRPVNRGYLTYPYRTDDGVNADLAAWQDGRTGYPLVDACMRCLQATGYINFRMRAMLVSFLCHLLNIDWQRGVHHLARLFLDYEPGIHYSQFQMQAGLTGINTIRIYNPVLQSQEQDPQGTFIRQWVPELAELPDTLLHQPWLLTPMEEQMFDLQISQHYPAPLFELAPAYAAARDRLWDWRSRPDVKQEAGRVLQRHVNAPGSNNLHQRRR

SEQ ID NO: 21787 - protein, 423 aa, Unknown
  Magnetococcus sp. MC-1
MSNDSIKLIDEIGKKARKAARQLAWLDSGSKNATLHAMADALIACKKILQVENEKDLEAGEKNGLTDAMLDRLRLTDQVIASMAEGIRQVAALPDPIGEINHMRRLANQLQVGKMRVPLGVIGIIYESRPNVTADAAALCVKSGNAVILRGGSEAFHSNRAIAAALAQGMEKGRVPSDAVQVVSTTDRAAVSALLKADQYVDIIIPRGGKGLIQRVMDEATIPVIKHLDGICHTYIDADADPAKAIDITFNGKMQRTGVCNATETLLIHEKVAKTILPALAKRLNQADCVLRGCPETIRLVGEVAPVIPATEEDWDTEYLAAILAIRVVKNLEEAMDHIDAHSSRHTEVIVTENHATAMRFVREVDASAVMVNASSRFNDGFQFGLGAEMGISTDKLHVRGPVGLEGLTCEKWIVLGDGQLRS

SEQ ID NO: 21788 - protein, 274 aa, Pinus contorta
MASCGIGSCGFAGGQISSLKPHTNQLLGVGAGVHGEARVTMRKATTKKVSVSASTSPWYGPDRVLYLGPFSGEPPSYLTGEFPGDYGWDTAGLSADPETFAKNRELEVIHSRWAMLGALGCVFPELLARNGVKFGEAVWFKAGAQIFSEGGLDYLGNPSLVHAQSILAIWACQVILMGAVEGYRIAGGPLGEVTDPIYPGGSFDPLGLADDPDAFAELKVKEIKNGRLAMFSMFGFFVQAIVTGKGPIENLADHLADPVSNNAWAYATNFVPGK

SEQ ID NO: 21789 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQVLFNTRSGTVAKLQ

SEQ ID NO: 21790 - protein, 377 aa, Unknown
  Magnetococcus sp. MC-1
MREATEAWQRVAAAQRIVVKIGSNLLTTKDGVCEDWIAARCAEIAALMGRGKQVVVVTSGSVAAGASRLGLGRRPATLPEKQAAAAAGQGKLMQIYEQAFNTHGLHTGQILLTRDDVANRRRYLNARDTLETLLTLGLVPVVNENDTVVVEEIRFGDNDTLAALVAGLVEAELLVLLSDVDGLYSADPRKDERAQRIELVVEVTPEIEALAGGTGSEVGSGGMVTKLRAAKMAARTGCMTVLANGFQADPIGAVMGGGVGTLFLSLGDAISSRKRWIANGLTCEGSLFLDEGAVAALLKGKSLLARGVVAVEGVFDRGAALYCCDVQGRRIAKGLVNYRSDHMEQIKGKHSWEIEAALGFIIDEEVMHRDDMVQLVK

SEQ ID NO: 21791 - protein, 377 aa, Unknown
  Shewanella sp. ANA-3
MSKRDYYEVLGVGRDASEREIKKAYKRLAMKFHPDRNPGDKAAEASFKEVKEAYEILTDANKKAAYDQFGHAGVDPNRGGGGGYGGAGDFGDIFGDVFGDIFGGGRRGGQRQAARGSDLRYNLELSLEEAVKGLTKELRIPTLASCDVCDGSGAKKGSSATTCGTCHGQGQVQMRQGFFTVQQPCPTCHGRGKIIKDPCSKCHGDGRVEKTKTLSVKIPAGVDTGDRIRLAGEGEAGEFGAPPGDLYVQVTVREHAIFVRDGNNLYCEVPISFSKAALGGEIEVPTLDGKVSLKIPAETQTGRMFRLRGKGVKSVRSHAVGDLLCKVVMETPVNLNERQKELLREFEATLTGESKKHSPKAEGFFDGVKKFFQDLNS

SEQ ID NO: 21792 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQGCLSCRSIVIVGLQ

SEQ ID NO: 21793 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQGCSRSRSDVIEGLQ

SEQ ID NO: 21794 - protein, 289 aa, Capsella rubella
MMLEKDDLGLSLGLNYPKKQMNLNSNPSVSVTPSSSSFGLLRRSSLNESFTSSVPNSDSSQKETRTFIRGIDVNRPPSTAEYGEEDAGVSSPNSTVSSSTGKRSEREEDTDPQGSRGGISDDEDGDNSRKKLRLSKDQSAILEETFKDHSTLNPKQKQALAKQLGLRARQVEVWFQNRRARTKLKQTEVDCEFLRRCCENLTEENRRLQKEVTELRALKLSPQFYMHMSPPTTLTMCPSCEHVSAPPPQQPPQAATSAQHHRGSLPVNAWAQGTRISHGLTFDALRPRS

SEQ ID NO: 21795 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQTGDSDRSMKKTILQ

SEQ ID NO: 21796 - protein, 461 aa, Unknown
  Oceanospirillum sp. MED92
MNISLSKGQISAIILLPLCILSLLLGPAADYLNQQQLTAACLILGAIVLYATSAIPEHVTALIFMAVAMLLAVAPAETVFSGFYSTACWLIFAGLIIGIAINETGLAQRIAAGFSNHLDSSYLKLISGIVIMATLLGFLMPSSMGRAVLFIPIAMAVADRCGFKTGSNGQIGVALAAAFGCHVPTFAVLPANVPNMVMIGAAETIHNWTPLYAEYLFLHFPILGLLKGILIISLILWLYPDSPKRNHEATEQSRMSFNEYKLLFIVLITLGFWLTDSFHHISAAWIGLTAACVLLLPGIGLVSSKSLNNKFNIGSLIFVVGILGLGTLINHSGLGALAGDHLNNWLPLAPGEDLSNFISLAMTAFTTGIVTTLPGVSAVLTPFAEQLADKSGFSLQAVLMTQVLGFSTILFPFQSAPLMVGMQIAKVPIKHAAKLCFVLTPLTLFILFPLDYLWWQLLGWI

SEQ ID NO: 21797 - protein, 815 aa, Escherichia coli
MKRMLINATQQEELRVALVDGQRLYDLDIESPGHEQKKANIYKGKITRIEPSLEAAFVDYGAERHGFLPLKEIAREYFPANYSAHGRPNIKDVLREGQEVIVQIDKEERGNKGAALTTFISLAGSYLVLMPNNPRAGGISRRIEGDDRTELKEALASLELPEGMGLIVRTAGVGKSAEALQWDLSFRLKHWEAIKKAAESRPAPFLIHQESNVIVRAFRDYLRQDIGEILIDNPKVLELARQHIAALGRPDFSSKIKLYTGEIPLFSHYQIESQIESAFQREVRLPSGGSIVIDSTEALTAIDINSARATRGGDIEETAFNTNLEAADEIARQLRLRDLGGLIVIDFIDMTPVRHQRAVENRLREAVRQDRARIQISHISRFGLLEMSRHRLSPSLGESSHHVCPRCSGTGTVRDNESLSLSILRLIEEEALKENTQEVHAIVPVPIASYLLNEKRSAVNAIETRQDGVRCVIVPNDQMETPHYHVVRVRKGEETPTLSYMLPKLHEEAMALPSEEEFAERKRPEQPALATFAMPDVPPAPTPAEPAAPVVAPAPKAAPATPAAPAQPGLLSRFFGALKALFSGGEETKPTEQPAPKAEAKPERQQDRRKPRQNNRRDRNERRDTRSERTEGSDNREENRRNRRQAQQQTAETRESRQQAEVTEKARTADEQQAPRRERSRRRNDDKRQAQQEAKALNVEEQSVQETEQEERVRPVQPRRKQRQLNQKVRYEQSVAEEAVVAPVVEETVAAEPIVQEAPAPRTELVKVPLPVVAQTAPEQQEENNADNRDNGGMPSFSPLASSPARKWSASSSLS

SEQ ID NO: 21798 - protein, 429 aa, Mycoplasma penetrans
MIKLNFTNFLEGNKSTEKIFKSYASKIETLNNSIEEKKCKGASMLGWMDYPSKYNKNEIKELINVSQEWYNNKKIKNVVVLGIGGSYIGVRAGIDWVLPEFNREKEIYYVSSMSSSYVYSLIEKLKKEDFYLIVISKSGTTLEIGVAFRLFYSLLFEKFGSEGAKERTVAITDKEKGTLRKIADTQDIQTFSIPDDVGGRFSAITPVGLFAMGVMGLDVNKVLKGCAKAIEDTKEPDIEKNTAYQYAALRHYMYSKKEKYNEVFCVYEDALRFFTEHLKQLFAESEGKEGKGLLPVNCLFTTDLHSVGQFLQEGNQIFFETCISIKNPLNDVVINEFLKDEDGLGFLNGKKLDYINKVAASSTIDAHHIDGKIDIIQINLDNRNEESFGYLYSWFSKVVAMSGLLLKVNPFDQPGVEAYKSRMFTKLKK

SEQ ID NO: 21799 - protein, 344 aa, Unknown
  Bradyrhizobium sp. BTAi1
MTKYKLEYIWLDGYKPVPNLRGKTQIKEFSSFPTLEQLPLWGFDGSSTMQAEGHSSDCVLKPVAVYPDAARTNGVLVMCEVMMPDGKTPHPSNARATILDDPDAWFGFEQEYFFYKDGRPLGFPEYGYPAPQGPYYTGVGFKNVGDVARKIVEEHLDLCLAAGINHEGINAEVAKGQWEFQVFGKGSRTAADQMWMARYLMLRLTEKYGIDIEFHCKPLGDTDWNGSGMHCNFSTKYMREVGGKEYFEKLMDAFKEARADHIAVYGPDNHMRLTGKHETASIDTFSWGVADRGASIRVPHSFVNNGYKGYLEDRRPNSQGDPYQIASQVLKTISTVPTGAKAAA

SEQ ID NO: 21800 - protein, 306 aa, Lactobacillus acidophilus
MTSKARLIYNPVSGHEQMPKNVADILDVLEQAGYEASAFRTTPEQNSARNEATRAAKEGFDLIVAAGGDGTINEVVNGIAFLENRPKMAIIPAGTTNDYARALAIPRDNIPDAAKVILKNKTRKMDIGKAIFGNQTQYFVNIAASGSLTELTYGVPSEVKSALGYAAYLIKGAEMLPHLTENEMRLTYDDGVYEGKLSMFLLGMTNSIGGFEQVMPDAQLSDGLFQLIVVKPSDPVSMMKLMALALNGKHVDDPNIIYTKTRSLKAELIGKSAGQDLPVNLDGEIGGYCPVDFHNLQQHIEFYVGG

SEQ ID NO: 21801 - protein, 138 aa, Ajellomyces capsulatus
MPPKAAEKKPSTAGKAPAGKAPEKKEAGKKTTAAGGEKKKRSKTRKETYSSYIYKVLKQVHPDTGISNRAMSILNSFVNDIFERVATEASKLAAYNKKSTISSREIQTSVRLILPGELAKHAVSEGTKAVTKYSSSAK

SEQ ID NO: 21802 - protein, 315 aa, Glycine max
MWFLGWKGASGFSASSTAEQVTQGIDGTALTAIVTGATSGLGLETTRVLALRGVHVVMAVRSLDSGKNVKETILKEIPSAKIDVMELDLSSMASVRKFAADFNSSGLPLNILINNAGVMATPFTLSQDNIELQFATNHLGHFLLTNLLLETMKKTVGVCNQEGRIVILSSEAHRFAYREGIQFDKINDESGYSSYFAYGQSKLANILHANELARRLKEEGVEITVNSLHPGSIITNILRYHDYINALANMVGKYFLKNVQQGAATQCYVALHPQVKGISGEYFMDSNKGNPASLAKDSELAKKLWEFSLSLTNPK

SEQ ID NO: 21803 - protein, 186 aa, Unknown
  uncultured bacterium
FWVSPTICTQAGLKAVDLFEACASGKIKALWVMSTNPAVSMPDANSVAAAIQNVPFVVVSDIMERTDTGDLADVLLPAAGWGEKDGTITNSERRVSRQRSFLKAPENTRPDWQIICDVAGRMGWTDAFSYTTPAEIFAEYVALSAATGDFGRDLDLSVFADADYANLIPTQWPANDKRFFADGQFY

SEQ ID NO: 21804 - protein, 427 aa, Mannheimia haemolytica
QNLILNMNDNGFKVVAYNRTTSKVDEFLEGAAKGTNIIGAYSLEDLAAKLEKPRKVMLMVRAGEVVDQFIEALLPHLEEGDIIIDGGNSNYPDTNRRVKALAEKGIRFIGSGVSGGEEGARHGPSIMPGGDESAWQYVKPIFQAISAKTDKGEPCCDWVGRDGAGHFVKMVHNGIEYGDMQLICEAYQFLKDGLGLSYDEMHEIFKEWKNTELDSYLVDITTDILAYKDEDGEPLVEKILDTAGQKGTGKWTGINALDFGIPLTLITESVFARCVSAFKDQRVAASRLFNKEIGKVEGDKKVWVEAVRRALLASKIISYAQGFMLIREASEQFGWDINYGNTALLWREGCIIRSRFLGNIRDAYEANPYLVFLGSDPYFKDILENCLADWRKVVAKSVEIGLPVPCMASAITFLDGYTSARLPANLL

SEQ ID NO: 21805 - protein, 226 aa, Glycine max
MVHCLDGLKQLYIAVINFCDADLCPEPRGLQHPEVLARETVFSVSEIEALYELFKKISSGVMDKGLITKDEFQLALFKTTKKESLFTDRVFDLFDTKHSGILDFKEFALALSVFHPSASIDDKIEFSFQLYDLKQQGFIQRQELKQMVVATLAESGMNLADDVIESIIDKTFEEVDTKHDGKIDKEEWRNLVLQHPSLLKNMTLQYLKDITTTFPSFVFHSQVDDV

SEQ ID NO: 21806 - protein, 475 aa, Unknown
  Nostoc sp. PCC 7120
MVKDSLTFSSNTMTTTAVNPYLEGNFAPVHEEITTDTLKVIGELPPELSGMFVRNGPNPQWTPIGQYHWFDGDGMLHGVRISNGKATYRNRYVRTQRWQIEHEAGQAIWTGLMEPPQTELPSRNTGNTALIWHAGQLLALWEGGAPYAIQVPDLASIGEYTYNNQLSSAFTAHPKVDPVTGEMMFFGYSFAPPYLHYSVVSATGELVRTVPIDLPMGVMMHDFAITANYTIFMDLPLTFSVERMQRGEPMLMFESDRPSRFGILPRHGDNSQIRWFEAPSCYVFHTLNAYEDKDEVVLFACPMRSTTVLASPDSQTDPEADIPRLHRWRFHLKTGKVHEEMLDDVASEFPRINENFLGQPTQYGYTSRLAKGSIPLFEGLIKYDLSNAKSQNYEYGQGRYGSEAVFVPRPGATVEDDGWLITYVYDTGEESSELVVINAQDINSEPIARVLLPQRVPYGFHGIWVTEEQLNFRRI

SEQ ID NO: 21807 - protein, 322 aa, Arabidopsis thaliana
MWFFGSKGASGFSSRSTAEEVTHGVDGTGLTAIVTGASSGIGVETARVLSLRGVHVVMAVRNTDSGAKVKEDIVKQVPGAKLDVMELDLSSMQSVRKFASEYKSTGLPLNLLINNAGIMACPFMLSKDNIELQFATNHLGHFLLTKLLLDTMKSTSRESKREGRIVNLSSEAHRFSYPEGVRFDKINDKSSYSSMRAYGQSKLCNVLHANELTKQLEEDGVNITANSLHPGAIMTNLGRYFNPYLAVAVGAVAKYILKSVPQGAATTCYVALNPQVAGVSGEYFQDSNIAKPLPLVKDTELAKKVWDFSTKLTDSQSGESSS

SEQ ID NO: 21808 - protein, 948 aa, Rhodopseudomonas palustris
MALVHETDFGTPPSLSENMVTLTIDGRSVSVPEGTSIMRAAMEIGTAIPKLCATDMVDAFGSCRLCLVEIDGRSGTPASCTTPVADGLVVHTQTERLKQIRKGVMELYISDHPLDCLTCSANGDCELQDMAGAVGLRDVRYGYSGEKHPNPGLDESNPYFTYDASKCIVCSRCVRACEEVQGTFALTIAGRGFDSVVSPGMQESFLGSECVSCGACVQACPTATLNEKSVIEIGTPERSVVTTCAYCGVGCTFKAEMRGEELVRMVPYKDGKANRGHSCVKGRFAWGYANHKERILKPMIRGKITEPWREVSWDEAFAYAASELKRIQAKYGRDSVGGITSSRCTNEETFLVQKLIRAGFGNNNVDTCARVCHSPTGYGLSTAFGTSAGTQDFDSVEHADVVMIIGANPTDGHPVFGSRLKKRLRQGAKLIVVDPRRIDLVRSAHVEAAQHLPLKPGTNVAVLTALAHVIVTEGLANEAFVRERCDWSEYEHWAAFVSDEKHSPEATAAFTGVDPQAVREAARLYATGGNGAIYYGLGVTEHSQGSTTVMAIANLAMATGNLGRPGVGVNPLRGQNNVQGSCDMGSFPHELPGYRHISTDAVRESFEALWNVKLDNEPGLRIPNMLDAAVEGSFKALYVQGEDILQSDPNTKHVAAGLEAMECVIVHDLFLNETANYAHIFLPGSTFLEKNGTFTNAERRIQRVRKVMTPKNGLEDWEVTLRLAEAVGYKMNYTHPSQIMDEIAALTPTFTGVSYDRLEELGSIQWPCNERAPEGTPVMHIDHFVRGKGKFVITEYVATDERTGPRFPLLLTTGRILSQYNVGAQTRRTANTVWHDEDRLEIHPHDAEQRGVRDGDWVRLASRAGETTLRALITDRVAPGVVYTTFHHPDTQANVVTTEYSDWATNCPEYKVTAVQIAPSNGPSEWQRSYEQQAAAARRIAVPAEAAE

SEQ ID NO: 21809 - protein, 231 aa, Sulfolobus solfataricus
MGKVVLVGAGPGDPELITLKGIKYLQMADVIVYDKLVSRELINYAKPSSFVIFLSNDDIEVDLLRKYALEDKLVIRLKNGDPYIFGRGGKICQELIKDGIECEVIPGVSSVNSVPAYAGIPLTFNGVSDMVTIVSAVSQGGKLFNFQKIPDYGTLVVLMGGRRLEEVSKWLMAKRDPSEDVAVIERGTYLDQKVHVNKLEKLAEVGNNLATPSLLVLGNVVRLREILWKFR

SEQ ID NO: 21810 - protein, 212 aa, Triticum aestivum
  misc_feature (53)..(53): Xaa can be any naturally occurring amino acid
MATLVKHLILCSSTTTSSSASPSPSNRRSPSSPDGADKRAHLTQSSTRRLAVXASTAMVATAALSARRPAAPHPAMAAVRAPAPPGTVPRWGTRSYVRERFFEPGLTTEEAAARIRQTAEGMRTLRPMLETMSWKYVLFYVRLKSKYLDLDLTTAMAGVPEPRRPEYVLVANELVDNMTEFDRFVRTPKVYESYLYYEKTLKSLDDVAEFLG

SEQ ID NO: 21811 - protein, 134 aa, Alcanivorax borkumensis
MRLVRKLDFPEMKFSLYFLGYLSEEEAGDVPKNDAQRLTFTFGREAMLELTHNWGSEEDPDFSYHDGNAEPQGFGHIGITVPDVYAAAERFEKMDVTFVKRPDDGKMKGLAFIKDPDGYWIEILQADMMEQQQS

SEQ ID NO: 21812 - protein, 196 aa, Bdellovibrio bacteriovorus
MTYNPRDHYFRKAKQENFAARSVFKLEEIDQKFKMFKPGQVVLDLGASPGSWSQYASKMAGEKGRVLGVDLSPVTVKLKNAVFIQADLRDLNLEDIFKEHGFVPPFDIVMSDMAPKTTGIRMTDQARSMELCELALDVARRFLKKDGHFVCKLFHSDDFGKLRDEMKKTFAKVEAVKPDSTRKISKEIFLVGLSKK

SEQ ID NO: 21813 - protein, 949 aa, Bacteroides thetaiotaomicron
MKTDLLASRHIGINEEDTAVMLRKIGVDSLDELINKTIPANIRLKEPLALAKPLTEYEFGKHIADLASKNKLYTTYIGLGWYNTITPAVIQRNVFENPVWYTSYTPYQTEVSQGRLEALMNFQTAVCDLTAMPLANCSLLDEATAAAEAVTMMYALRSRTQQKAGANVVFVDENIFPQTLAVMTTRAIPQGIELRVGKYKEFEPSPEIFACILQYPNSSGNVEDYADFTKKAHEADCKVAVAADILSLALLTPPGEWGADIVFGTTQRLGTPMFYGGPSAGYFATRDEYKRNMPGRIIGWSKDKYGKLCYRMALQTREQHIKREKATSNICTAQALLATMAGFYAVYHGQEGIKTIASRIHSITVFLDKQLKKFGYTQVNAQYFDTLRFELPEHVSAQQIRTIALSKEVNLRYYENGDVGFSIDETTDIAATNVLLSIFAIAAGKDYQKVEDVPEKSNIDKALKRTTPFLTHEVFSNYHTETEMMRYIKRLDRKDISLAQSMISLGSCTMKLNAAAEMLPLSRPEFMSMHPLVPEDQAEGYRELISNLSEDLKVITGFAGVSLQPNSGAAGEYAGLRVIRAYLESIGQGHRNKILIPASAHGTNPASAIQAGFETVTCACDEQGNVDMGDLRAKAEENKEALAALMITYPSTHGIFETEIKEICEIIHACGAQVYMDGANMNAQVGLTNPGFIGADVCHLNLHKTFASPHGGGGPGVGPICVAEHLVPFLPGHSIFGSTQNQVSAAPFGSAGILPITYGYIRMMGTEGLTQATKIAILNANYLAACLKDTYGIVYRGATGFVGHEMILECRKVHEETGISENDIAKRLMDYGYHAPTLSFPVHGTLMIEPTESESLAELDNFVDVMLNIWKEIQEVKNEEADKNDNVLINAPHPEYEIVNDNWEHSYTREKAAYPIESVRENKFWVNVARVDNTLGDRKLLPTRYGTFE

SEQ ID NO: 21814 - protein, 659 aa, Schizosaccharomyces pombe
MEYYTSKEVAEWLKSIGLEKYIEQFSQNNIEGRHLNHLTLPLLKDLGIENTAKGKQFLKQRDYLREFPRPCILRFIACNGQTRAVQSRGDYQKTLAIALKKFSLEDASKFIVCVSQSSRIKLITEEEFKQICFNSSSPERDRLIIVPKEKPCPSFEDLRRSWEIELAQPAALSSQSSLSPKLSSVLPTSTQKRSVRSNNAKPFESYQRPPSELINSRISDFFPDHQPKLLEKTISNSLRRNLSIRTSQGHNLGNFGQEILPRSSRRARPSELVCPLSSLRISVAEDVNRLPRIDRGFDPPLTVSSTQRISRPPSLQKSITMVGVEPLYQSNGNEKSSKYNVFSESAHGNHQVLSFSPGSSPSFIEQPSPISPTSTTSEDTNTLEEDTDDQSIKWIRGALIGSGSFGQVYLGMNASSGELMAVKQVILDSVSESKDRHAKLLDALAGEIALLQELSHEHIVQYLGSNLNSDHLNIFLEYVPGGSVAGLLTMYGSFEETLVKNFIKQTLKGLEYLHSRGIVHRDIKGANILVDNKGKIKISDFGISKKLELNSTSTKTGGARPSFQGSSFWMAPEVVKQTMHTEKTDIWSLGCLVIEMLTSKHPYPNCDQMQAIFRIGENILPEFPSNISSSAIDFLEKTFAIDCNLRPTASELLSHPFVS

SEQ ID NO: 21815 - protein, 685 aa, Unknown
  Magnetococcus sp. MC-1
MDRASTSTRSFRAPNRVVLSGGLTLLLSLLLTGLLAVQENGRYQNQLRVTVLEQLSQLRGLLENEINLSFHLTMGLLAYVAIEPNISQQNFQLMAREIIAQSRNIRNLGLAPDNVLSYIYPLSGNERALGLDYRKNAKQWPAVQLAISERRTVVAGPVKLVQGGEAFISRTPIYRTGMDGKKGAYWGLASTVIDKDKLFTTAGIYEVSKQIKLAIRGRDGLGAQGDLISGEGELFNERAVLQNVQLPDGRWQLAAEPLNGWDQDSPYVPVIWGAGIGGGMLAGGLVYLWLIGVARHQHILQQALQDAQAADRVKSEFYATMSHEIRTPMNVVLGMSDILLETVQEPEQRQQLARLQQAGSALLELINNILDISRIEEKRLTLHMAPMDLRSLVEDLLGFFQLPYHEKGIALVSEWEQGLATHILGDSGRLRQVLTNLLGNALKFTERGQVVVVVRRDPEDATYLRIEVRDSGIGLHADQLLHIFDKFTQAESGLTRRYGGSGLGLAICKQLVVLMGGRIWVESEDGVGSCFIFTLPYQEVTELERRQMQDEAAEWSVDVPRKVLLVEDSVDNQQLIVAYLKASPYQVSIAQNGAEGVAMAKQDAYDLILMDMQMPVLDGYAATRSIRQWERQQGREPVPIVALTAHALEGDLEKSIEAGCSLHLTKPIRKAQLLNQLRGFFKEAP

SEQ ID NO: 21816 - protein, 347 aa, Zea mays
MELDSIECVSYSDGMEDDDDTAAVTSSQLPRPFLKSSSTAGAAAAAAAAVNVVVVSDRAGAAGTVAGAGPLVISPATGVHELLECPVCTNSMYPPIHQCQNGHTLCSTCKTRVHNRCPTCRQELGDIRCLALEKVAESLELPCRYYSLGCPEVFPYYSKLSHESQCSFRPYNCPYAGSECSVVGDIPFLVAHLRDDHKVDMHSGCTFNHRYVKSNPREVENATWMLTVFHCFGQYFCLHFEAFQLGLAPVYMAFLRFMGDENDSRNYSYSLEVGANGRKMIWEGTPRSIRDSHRKVRDSHDGLIIQRNMALFFSGGDRKELKLRVTGRIWKEQQNPDSGACIPNLFS

SEQ ID NO: 21817 - protein, 120 aa, Oryza sativa
MEEQMFREQQMQRGGRHHQHHTTREQEQQQKQQQRRRLMNNATNGGGGDGGSRCYFSTEAILVLACVTVSLLVLPLILPPLPPPPTLLLLLPVCLLALLVVLAFMPTDMRTMASSYFFCL

SEQ ID NO: 21818 - protein, 745 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQIVTSTDLE

SEQ ID NO: 21819 - protein, 406 aa, Campylobacter upsaliensis
MLENTLFFEKTSLEKIDAYARRINDEQESGDVGYYHLHKMGETLIEESLEFISQKAYVKKVVLVGMGGSSCGVKALKGLLFDEKDNDRELLILDNTSSHSVNQILKQIKLEESLFIITSKTGSTVEVISLFKLIIAHFNLNLNEFHKYFVFITDENSNLHKEGESLGIKCFFIPQNVGGRFSILSAVGIVPLCFCGYNVKALLKGAEACFEDFFSHKKDVILQKAYHYCTHKSANINVLFAYSDAFKGFNEWYIQLIAESLGKKQGYKRLGLTPIALIGARDQHSFLQLIMDGPKNKTITFLKIKDSQKAPLIPDIHFKFLDSLSNGVNLHELLNAQCDATMHALCAENLSVDVIELERLDAWHCGYLMYYYELFTSACGLMLGINTYDQPGVEVGKLILKNLLRK

SEQ ID NO: 21820 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQHFVAARSKTAEELQ

SEQ ID NO: 21821 - protein, 354 aa, Agaricus bisporus
MANTYHNDLLAPYLSLDQGDKIQAEYVWIDGDGGLRCKTTTVSKKVTDIGQLRIWDFDGSSTNQAPGHDSDVYLRPAAIFKDPFRGGDNILVLAETYNNDGTPNRTNHRHHAKKVFDEAKEHEPWFGLEQEYTLFDADDQPYGWPKGGFPGPQGPYYCGAGTGKVFARDLIEAHYRACLYAGINISGINAEVMPSQWEFQVGPCEGISMGDHLWMARYLLVRIAEQWGVKVSFHPKPLKGEWNGAGCHTNFSTKAMREAGGMKFIEDAIEKLAKRHDEHIAVYGEDNDLRLTGRHETGHISNFSSGVANRGASIRVPRHVASQGYGYLEDRRPASNIDPYRVTSIIAETTILDK

SEQ ID NO: 21822 - protein, 216 aa, Mycobacterium tuberculosis
MTPALVVGPAAWHAVHVTQSSSAITPGQTAELYPGDIKSVLLTAEQIQARIAELGEQIGNDYRELSATTGQDLLLITVLKGAVLFVTDLARAIPVPTQFEFMAVSSYGSSTSSSGVVRILKDLDRDIHGRDVLIVEDVVDSGLTLSWLSRNLTSRNPRSLRVCTLLRKPDAVHANVEIAYVGFDIPNDFVVGYGLDYDERYRDLSYIGTLDPRVYQ

SEQ ID NO: 21823 - protein, 360 aa, Glomerella cingulata
MATEAAVVSNPNTLAKYLKLDQKGSIMAEYIWIDADGETRSKSRTLKEKEYTPEDLPMWNFDGSSTGQAPGDNSDVYLKPVAVFPDPFRGSPNILVLSECWNADGTPNKYNYRHECAKLMEAHAAHEPWFGLEQEYTLLDLSNRPFGWPANGFPAPQGPYYCGVGTGKVVQRDIVDAHYKACLYSGVKISGTNAEVMPAQWEFQVGPCVGIEMGDHLWLARFLLARIAEEFGAKVSVDPKPIPGDWNGAGLHSNFSTKEMRVEGGMKHIEAAIKKLEGRHKEHIAVYGEGNEKRLTGRHETGAIDQFSYGVANRGASIRIPREYTAKGYGYFEDRRPASNADPYRITGILMETIYGSVDN

SEQ ID NO: 21824 - protein, 747 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQVNYITDLPLG

SEQ ID NO: 21825 - protein, 382 aa, Chlamydomonas reinhardtii
MAAGSVGVFATDEKIGSLLDQSITRHFLSTVTDQQGKICAEYVWIGGSMHDVRSKSRTLSTIPTKPEDLPHWNYDGSSTGQAPGHDSEVYLIPRSIFKDPFRGGDNILVMCDCYEPPKVNPDGTLAAPKPIPTNTRFACAEVMEKAKKEEPWFGIEQEYTLLNAITKWPLGWPKGGYPAPQGPYYCSAGAGVAIGRDVAEVHYRLCLAAGVNISGVNAEVLPSQWEYQVGPCEGITMGDHMWMSRYIMYRVCEMFNVEVSFDPKPIPGDWNGSGGHTNYSTKATRTAPDGWKVIQEHCAKLEARHAVHIAAYGEGNERRLTGKHETSSMSDFSWGVANRGCSIRVGRMVPVEKSGYYEDRRPASNLDAYVVTRLIVETTILL

SEQ ID NO: 21826 - protein, 380 aa, Chlamydomonas reinhardtii
MAFALRGVTAKASGRTAGARSSGRTLTVRVQAYGMAAEYIWADGNEGKPEKGMIFNEMRSKTKCFEAPLGLDASEYPDWSFDGSSTGQAEGNNSDCILRPVRVVTDPIRGAPHVLVMCEVFAPDGKPHSTNTRAKLREIIDDKVTAEDCWYGFEQEYTMLAKTSGHIYGWPAGGFPAPQGPFYCGVGAESAFGRPLAEAHMEACMKAGLVISGINAEVMPGQWEYQIGPVGPLALGDEVMLSRWLLHRLGEDFGIVSTFNPKPVRTGDWNGTGAHTNFSTKGMRVPGGMKVIEEAVEKLSKTHIEHITQYGIGNEARLTGKHETCDINTFKHGVADRGSSIRIPLPVMLKGYGYLEDRRPAANVDPYTVARLLIKTVLKG

SEQ ID NO: 21827 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQFYSFVRSVTEEKLQ

SEQ ID NO: 21828 - protein, 222 aa, Unknown
  uncultured bacterium
HLDIENPDHRQTVQDFWLSPTICTRAGLKAVDLFEACASGKIKALWVMSTNPAVSMPNANGVAAAIQNVPFVVVSDIMERTDTGDLAEVLLPAAGWGEKDGTVTNSERRISRQRSFLKAPENARPDWEIICDVAGRMGWTDAFNYTAPAEIFAEYVALSAATGDFGRDLDLSVFADVDYANLIPTQWPANEKRFFADGQFYHANGRATMLPIAQPKAPTIEV

SEQ ID NO: 21829 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQTFVSHRSKKESRLQ

SEQ ID NO: 21830 - protein, 379 aa, Pasteurella multocida
MLTPIQNFLKQEAAGGILLFIFATLAIILANTPLSYLYFDFLQTPVSVQIGAFIINKPLLMWVNDGLMAVFFMLVGMEVKRELLEGSLSSYQRAVFPAIAATGGMVVPAIVFLVFNATHPEFQEGWAIPMATDIAFALGVIALLGKRVPLALKIFLLALAIIDDLGAIVVIALFFSHDLSPQAFIFAGIAVAILITMNRLKITALSAYGIVGIILWASVLKSGVHATLAGVIIGFCIPLNGKKGERPLDDFEHTLSPWSAFAILPLFAFCNAGVSLIGMGMDNLTSTLPMGIALGLLLGKPLGIFSFCFVAVKLGIAKLSEGINFKQIFAVSVLCGIGFTMSMFLAGLAFGGESDSENVTALARLGILIGSGFSAVLGY

SEQ ID NO: 21831 - protein, 344 aa, Arabidopsis thaliana [sequence omitted]

SEQ ID NO: 21832 - protein, 427 aa, Mannheimia glucosida
QNLILNMNDNGFKVVAYNRTTSKVDEFLEGAAKGTNIIGAYSLEDLAAKLEKPRKVMLMVRAGEVVDQFIDALLPHLEEGDIIIDGGNSNYPDTNRRVKALAEKGIRFIGSGVSGGEEGARHGPSIMPGGDESAWQYVKPIFQAISAKTDKGEPCCDWVGRDGAGHFVKMVHNGIEYGDMQLICEAYQFLKDGLGLSYDEMHEIFKEWKNTELDSYLVDITTDILAYKDEDGEPLVEKILDTAGQKGTGKWTGINALDFGIPLTLITESVFARCVSAFKDQRVAASRLFNKEIGKVEGDKKVWVEAVRRALLASKIISYAQGFMLIREASEQFGWDINYGNTALLWREGCIIRSRFLGNIRDAYEANPYLVFLGSDPYFKDILENCLADWRKVVAKSVEIGLPVPCMASAITFLDGYTSARLPANLL

SEQ ID NO: 21833 - protein, 159 aa, Exiguobacterium sibiricum
MLQEQTFQRIDGTEATLKDYPGQAWLIVNTASKCGLTPQFEGLEQLHQDYRKQGLVVLGFPCNQFAGQDPGTDEEIQSFCQMNYGVTFPVFSKIEVNGKGTHPLFAELKALAPNTTGEQDVEWNFTKFLVTRDGEVTRFAPKTNPTDLVAAIERIVVPV

SEQ ID NO: 21834 - protein, 427 aa, Pasteurella trehalosi
QNLILNMNDNGFKVVAYNRTTSKVDEFLAGAAKGTNIIGAYSLEDLAAKLEKPRKVMLMVRAGEVVDQFIDALLPHLEEGDIIIDGGNSNYPDSNRRVKDLAAKGIRFIGTGVSGGEEGARHGPSIMPGGNIEAWEHVKPILQAISAKTDKGEPCCDWVGKEGAGHFVKMVHNGIEYGDMQLICEAYQFLKDGLGLSYDEMQAIFQEWKKTELDSYLIDITTDILGYKDEDGTPLVEKILDTAGQKGTGKWTGINALDFGIPLTLITESVFARCVSSFKDQRVAASKLFNKTISPVEGDKKVWIEAVRRALLASKIISYAQGFMLIREASENFGWDINYGATALLWREGCIIRSRFLGNIRDAYETNPDLVFLGSDDYFKGILENAMADWRKVVAKSIEVGIPMPCMASAITFLDGYTSERVPANLL

SEQ ID NO: 21835 - protein, 473 aa, Bacillus anthracis
MMNQNQGLKRELKSRHIFMIALGGVIGTGLFLGSGYTIHEAGPGGAIVAYLVGGFVMYLTMLCLGELAVAMPDAGSYQTYATKHISPAAGYVVGWMSWLNWSATIGIELIAVSILMKRWFPDVPSWIWCVVFAVLLFAINALSSRSFAEVEFWFASIKVITIIAFIILGGAAMFGFLDMKGNEPAPMFSSFTDYGGLFPNGLSAILITMIAVNFSFQGTELVGIAAGESENPEKTIPKAINNTVWRILVFFVLSIFILAGLFPWQQAGVIESPFVVVFDKIGIPYAADIINFVIITAVLSVANSGLYATSRMLWSMSNQGMISPIFGKLSKNGVPIYALIVSTIVGCLSLLSGIYAEDTVYLWLLSIAGFGAILVWASIALSNLLARRSYIKQGGDVKDLKFKTPLYPFVPLLALVLNVTVIVGMAFIPEQRMALYCGIPFMIVCLLFYRATRNKAHKVEHIEKTDTTEVDSL

SEQ ID NO: 21836 - protein, 386 aa, Tetragenococcus halophilus
MATKRDYYEVLGVDKGASDDEIKKAYRKLSKKYHPDVNQEADAEEKFKKFQKPMNTLSDPQKRAAYDQYGHAGADANFGGGGAGGFGGFGGGFSDAGGFGGFEDIFESFFGGGRSADPNAPRQGDDLQYSINLTFEEAVFGKDTEVSYKRNEVCHTCGGNGAKPGTQPETCHKCKGSGTINAERQTPLGRVMTRQTCDVCHGTGKEIKEVCETCHGTGHEKKTHSVNVSVPAGVEDGQQMRLANQGEAGTNGGPYGDLYVVLYCSHETCNIFDRDGSEIYYELPINFVQAALGDEVDVPTVHGNVKLKIPAGTQTSTKFRLRGKGAPRLRGNSTGDQQVTVKIITPKNLNEEQREALRNFAELTGQSTEEQQSEGFFDKMKDAFKK

SEQ ID NO: 21837 - protein, 213 aa, Brassica napus
MDQQEHGQSRAMNYGTNPYQTGTVGPTAPSGQMAFHQQQQLTQQLQVFWQNQFKEIEKTTDFKNHSLPLARIKKIMKADEDVRMISAEAPVVFARACEMFILELTLRSWNHTEENKRRTLQKNDIAAAVTRTDIFDFLVDIVPREDLRDEVLGSIPRGTVPEASAAGYPYGYLPSGTAPVGNSGMVMGYPGSALPPNPYMGSPIWQHQGPGHL

SEQ ID NO: 21838 - protein, 219 aa, Unknown
  uncultured bacterium
NSRLCMSSAVAGYTRSLGSDGPPCSYEDLDHCTVAFLIGTNTAECHPVLFQRLLKRKKRHPGSVTIVVIDPRQTDTARAADIHLAVAPGSDLALLHGIAHLVMRENGQDPTFIDNCTDNYDSFFDVVARWTPRRVALFCGIPEKRLREVAQLFHRREKVLSLWSMGVNQRREGTAVVGGIINLHLLTGQIGKEGAGPFSLTGQPNAMGGREAGGLSHLL

SEQ ID NO: 21839 - protein, 342 aa, Lactobacillus sakei
MQKRARLIYNPTSGHEVMKRSVADILDILEQAGYEASAYQTTPEPASAQKEATRAAKDDFDLVVAAGGDGTINEVVNGIAGLAKRPKMAIIPAGTTNDYARALKIPRDNPVDAAKVILKNQTLKMDIGQANDNYFMNIAGGGLLTELTYEVPSDFKSIFGYLAYIVKGAEMLPQIKPIQMHLEYDEGTYDGQASLFLLGLTNSVGGFEQVAPDAQLDDGNFSLIVVKTANMAELVHLMALVLKGGKHVDDPRIIYTKTSKLVARPADENDKMMINLDGEYGGDAPMTFINLQQHIEMYVNKEAIPDHAITTETPEELAAEDQFVKEVEEISKEDIDGDGKIG

SEQ ID NO: 21840 - protein, 190 aa, Wolinella succinogenes
MREITRTTKETNIKASLELYGSGVAKIETGIGFFDHMLESLAKHALWDLEISCEGDLQVDAHHSVEDCGIVLGLLLRESLYPAQGIERFGNASVVMDESCVECDLDVSNRPFLVFDMTIEGAVGEFDAELAEEFFRALAFNAGLSLHIVQKRGKNRHHLIEAAFKALAVAMRRACTQNPRIGTPSTKGLL

SEQ ID NO: 21841 - protein, 492 aa, Corynebacterium efficiens
MGAAGVPARFILDSVSMSLSTASPTIVWFRDDLRIRDNAALAWAADRGPVIGLFIDEDQPRALGGAARWWRDRSLTLLVDALATHGVPLLRRSGDPVVLLTEVVRETGAAAVTWNRRYHGPLRERDAEIKTQLREQGLEVHSHAGFLLTEPWEVTSGAGTGYKVYTPFSKAAFPLADESAARLGDPMPAQLTGPDTPVADTGGIDAPDPFWAAEMATHCRPGEQAALDRLGDFLDRMRERGGYADGRDEMARAVTSGLSPHLRFGEISVHRVWEEITAAADAGDIDATDAQVFRKELLWRDFAWHRLYALPDMATTNVREQFNRFGWAWDEHEAARLVDGRHPLSPTSSDEFHVALAAWRAGRTGIPLVDAGMRELWATGSMHNRSRMVVASFLTKNLQIHWRHGEEWFWETLVDADPASNAFNWQWAAGSGDDASPYFRIFNPETQARKFDPDETYIRRWIPEYGTPEYPAPIVDLKESRREALDAYEAVK

SEQ ID NO: 21842 - protein, 417 aa, Oryza sativa
MAPKAEKKPAEKKPAAGEEKSAEKAPAGKKPKAEKRLPASKASSKEGGAGDKKGRKKAKKSVETYKIYIFKVLKQVHPDIGISSKAMSIMNSFINDIFEKLAQEAARLARYNKKPTITSREIQTSVRLVLPGELAKHAVSEGTKAGYHFTQQRKNLKMSSHHLALLRKVIGDGGDAVIGDGGGGLQRLPRRRPWSRGGGRAAPESTPPAKYARGRRPRRGSGGHAPHPESGGGGGGGGGAREWRDVGTTMRGGGGRGRGKSAQAADRCCRRMPMDGGPPTPTLAEVLSLSPPTTPRSRAPSSSRRRRMAAQTLATTAAGGQTAAEVARPPDSTPPAESGEEGGVGVHTGEEGKAAAAGEGSDPFFPIIAAPSLPSPTQPPLLLPRHRGALLVTEEIGRRRRCRWEAATARDGDGADR

SEQ ID NO: 21843 - protein, 219 aa, Unknown
  uncultured bacterium
NSRLCMSSAVAGYTRSLGSDGPPCSYEDLDHCTVAFLIGTNTAECHPVLFQRLLKRKKRHPGSVTIVVIDPRQTDTAKAADIHLAVAPGSDLALLHGIAHLVMRENGQDPTFIDNCTDNYDSFFDVVARWTPRRVALFCGIPEKRLREVAQLFHRREKVLSLWSMGVSQRREGTAVVGGIINLHLLTGQIGKEGAGPFSLTGQPNAMGGREAGGLSHLL

SEQ ID NO: 21844 - protein, 219 aa, Unknown
  uncultured bacterium
NSRLCMSSAVAGYTRSLGSDGPPCSYEDLDHCSVAFLIGTNTAECHPVLFQRLLKRKKRSPGSITIVVVDPRRTDTAKAADIHLPIAPGSDLALLHGIAHLVMRENGQDPAFIDDHTEHYDAFFDVVARWTPRRVALFCNIPEKRLRDVAALFHRREKVLSLWSMGVNQRREGTAVVQGLINLHLLTGQIGKEGAGPFSLTGQPNAMGGREAGGLSHLL

SEQ ID NO: 21845 - protein, 219 aa, Unknown
  uncultured bacterium
NSRLCMSSAVAGYTRSLGSDGPPCSYEDLDHCTVAFLIGTNTAECHPVLYQRLLKRKKRHPGSVTIVVIDPRQTDTAKAADIHLAVAPGSDLALLHGIAHLVMRENGQDPTFIDNCTENYDSFFDVVARWTPRRVALFCGIPEKRLREVAQLFHRREKVLSLWSMRVNQRREGTAVVGGIINLHLLTGQIGKEGAGPFSLTGQPDAMGGREAGGLSHLL

SEQ ID NO: 21846 - protein, 935 aa, Haemophilus influenzae
MKRMLINATQKEELRVALVDGQRLFDLDIESPGHEQKKANIYKGKITRVEPSLEAAFVDYGAERHGFLPLKEIAREYFPDDYVFQGRPNIRDILVEGQEVIVQVNKEERGNKGAALTTFVSLAGSYLVLMPNNPRAGGISRRIEGDERTELKEALSSLDVPDGVGLIVRTAGVGKSPEELQWDLKVLLHHWEAIKQASQSRPAPFLIHQESDVIVRAIRDYLRRDIGEILIDSPKIFEKAKEHIKLVRPDFINRVKLYQGEVPLFSHYQIESQIESAFQREVRLPSGGSIVIDVTEALTAIDINSARSTRGGDIEETALNTNLEAADEIARQLRLRDLGGLVVIDFIDMTPIRHQREVENRIRDAVRPDRARIQISRISRFGLLEMSRQRLSPSLGESSHHICPRCQGTGKVRDNESLSLSILRLLEEEALKENTKQVHTIVPVQIASYLLNEKRKAISNIEKRHNVDIIVAPNEAMETPHFSVFRLRDGEEVNELSYNLAKIHCAQDENTEESLLSRNVETTAVIEQPAVESAVVALSISEAAPTPVERKSNEPSLLAKIIAKIKGLFATKSEENKPKNNRTSRNPNRNQRRSQDRRSSRRPRSENNETERTEEQVRNVRERNQRRPRRNLVEESIAESAVNSTPVFEAKEERTEPVTQRRQRRDLRKRVRVEDNETVVENNFSTTEKMPEVDVITVQNNDEKPVHQNQRSERQERQRRTPRHLRAANNQRRRRDQEPKSPMPLFAAVVSPELASGKAWIDYSTVNLPKENHFLSVDELLEQEKTKKGFITPAMGIVVEEKSPDVKPALDFITQPANESVQKKVQESLDRLSSYKPQEVVESIDPAINVDEPETLEKVSKFVRTYEFNGRLGTISSVPHTKAEMTLAKANDEMPEDFPIRAWQDSRYYFYGKGAAGHHCAISHVYSEPTRTKSE

SEQ ID NO: 21847 - protein, 219 aa, Unknown
  uncultured bacterium
NSRLCMSSAVAGYTRSLGSDGPPCCYEDLDHCSVAFLIGTNTAECHPVLFQRLLKRKKHDPKSLTIVVVDPRCTDTAKIADHHLAVAPGTDLALLHGLARLVIEDNGFDSDFIDAATEGFSAYAKTINAWTAEETAKLCGINEQELREVGRLWSRREGILSLWSMGVNQRREGTAIVSGLINLHLLTGEIGKPGAGPFSLTGQPNAMGGREAGGLAHLL

SEQ ID NO: 21848 - protein, 222 aa, Novosphingobium aromaticivorans
MSRSDKNPHERLKTAKKRTASSARWLSRQLNDPYVKKAKAEGWRSRAAFKLIELDEKFGLLKGAKRVVDLGIAPGGWSQVVRKKAPAAKIVGIDLLPTEPIEGVTIFEMDFMADEAPEALQSALDGPPDLVLSDMAANTVGHKQTDHLRTMGLVETAVDFAVQTLAPGGAFVAKVFAGGTDTELLAILKKNFTTVKHAKPPASRKDSSEWYVIAQGFKGRPD

SEQ ID NO: 21849 - protein, 375 aa, Xylella fastidiosa
MTPIVFIDRDGTLIEEPPDFQIDAYEKLRLVNGVIPALLKLRDAGYHFVIVTNQDGLGSPAYPQASFDGPNALMLQIFSSQGIVFRDVLIDRSWPTDNAPTRKPGIGLMVAYLQDRDIDWARSAMVGDRPTDLQFAENLNIRGFQLRTPQFGGDWDWDGIAHTLADAPRRAVVQRHTKETTIRVEIDLDGAPQARITTGLPFFDHMLEQIAKHAGISLQISAVGDLHIDEHHTIEDTGLALGQAVRQALGDKRGIGRYGFDPPQLPWQVSGAAAHGGFTLPMDETQASAVLDFSGRPYCVFEGTFVRERVGDMPTELVPHFFRSLCDASGMNLHLSVHGDNDHHKVEACFKALARALRQALQRHGHVLPSTKGAL

SEQ ID NO: 21850 - protein, 536 aa, Oryza sativa
MPRRPSGGGGGAGPAAAAVRKVPLRKLLRAASVACGVQFGWALQLSLLTPYVQELGIPHAFASLVWLCGPLSGLLVQPLVGHLSDRIAPAASPLGRRRPFIAAGAASIAAAVLTVGFSADLGRIFGDSITPGSTRLGAIIVYLVGFWLLDVGNNATQGPCRAFLADLTEGMIVLFVMEMLEFHENDPRRTRIANAYFSLFMALGNILGYATGAYSGWYKIFPFTVTPSCSISCANLKSAFLLDIIILVVTTCITVASVQEPQSFGSDEADHPSTEQEAFLWELFGSFRYFTLPVWMVLIVTALTWIGWFPFILFDTDWMGREIYRGSPDDPSITQSYHDGVRMGSFGLMLNSVLLGFTSIVLEKLCRKWGAGLVWGVSNILMALCFVAMLVITYVAKNMDYPPSGVPPTGIVIASLVVFTILGAPLAITYSIPYAMAASRVENLGLGQGLAMGILNLAIVIPQLDTFCELQHEKSFSYKFSILLLCQLGSGPWDQLFGGGNAPAFAVAAAASFIGGLVAILGLPRARIASRRRGHR

SEQ ID NO: 21851 - protein, 183 aa, Coprinopsis cinerea
MIRFDALPPEVMQAMCTPMHQILAPAASPTSPGQFSGSLYLGSLAAVMDKELLRQHNITHIVHVLDAPWLPLSDNEGFNGYKISILDHDAEDLRPHLESACNHIDKALRGGKNVLVHCQQGVSRSASIVIAYLIRNHGMTFDNAHSLLKRKRPCVKPNPGFVKALQEWEAFWKRPNPMRRFTS

SEQ ID NO: 21852 - protein, 316 aa, Hevea brasiliensis
QVGVCYGMQGNNLPPVSEVIALYKKSNITRMRIYDPNRAVLEALRGSNIELILGVPNSDLQSLTNPSNAKSWVQKNVRGFWSSVLFRYIAVGNEISPVNRGTAWLAQFVLPAMRNIHDAIRSAGLQDQIKVSTAIDLTLVGNSYPPSAGAFRDDVRSYLNPIIRFLSSIRSPLLANIYPYFTYAGNPRDISLPYALFTSPSVVVWDGQRGYKNLFDATLDVLYSALERASGGSLEVVVSESGWPSAGAFAATFDNGRTYLSNLIQHVKRGTPKRPNRAIETYLFAMFDENKKQPEVEKQFGLFFPDKWQKYNLNFG

SEQ ID NO: 21853 - protein, 284 aa, Alkaliphilus metalliredigenes
MELWYTEEQTQHVRLSFKVKEHLFSEQSEFQKVDVLDTYEFGKLMTLDGLVMVTEKDEFIYHDMIVHVPMAVNPNIKNVLIIGGGDGGTARELMRYQSIKHVDMVEIDKMVCDVARDYFPTISSELENPRVSLYYEDGVAFIKDKENKYDLIIIDSTDPVGPGEGLFSQEFYTNCFKALTEQGILVNQNESPVYEQFAREAIRANSKLKKIFPIVEVYQAQIPTYPSGYWLFGFASKSLHPVKDLKSSVWNQLNLNTKYYNTQLHVGAFALPSYVKEQIENGNV

SEQ ID NO: 21854 - protein, 636 aa, Neisseria meningitidis
MLTPTQQVGLILQYLKTRILDIYTPEQRAGIEKSEDWRQFSRRMDTHFPKLMNELDSVYGNNEALLPMLEMLLAQAWQSYSQRSASLKNIDIERENNPDWILSNKQVGGVCYVDLFAGDLKGLKDKIHYFQELGLTYLHLMPLFKCPEGKSDGGYAVSSYRDVNPALGTIGDLREVIAALHEAGISAVVDFIFNHTSNEHEWAQRCAAGDPLFDNFYYIFPDRRMPDQYDRTLREIFPDQHPGGFSQLEDGRWVWTTFNSFQWDLNYSNPWVFRAMAGEMMFLANLGVDILRMDAVAFIWKQMGTSCENLPQAHALIRAFNAVMRIAAPAVFFKSEAIVHPDQVVQYIGQDECQIGYNPLQMALLWNTLATREVNLLHQALTYRHNLPEHTAWVNYVRSHDDIGWTFADEDAAYLGISGYDHRQFLNRFFVNRFDGSFARGVPFQYNPNTGDCRVSGTSAALAGLAQNDPHAVSRIKLLYSIALSTGGLPLIYLGDEVGTPNDDGWVQDSNKSDDSRWAHRPRYNEALYAQRNDPSTAAGQIYQGLRHMIAVRQSNPRFDGGRLVTFNTNNKHIIGYIRNNALLAFGNFSEYPQTVTAHTLQAMPFKAHDLIGGKTVSLNQDLTLQPYQVMWLEIA

SEQ ID NO: 21855 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQFDTSTRSGSGENLQ

SEQ ID NO: 21856 - protein, 476 aa, Oryza sativa
  misc_feature (378)..(378): Xaa can be any naturally occurring amino acid
MGSHRHRSAGQCSLVQPPRLITCLLLLLLLLLSPPALPCSASSSSSSSSVITHLPGFHGRLPFYLETGYIGIEEKTGTELFYYFVESETNPDTDPLVLWLVGGPRCSAFSGLAYEVGPLNFVLEAYNGSLPRLVYNQYSWTQMASIIFLDSPVGSGFSYARDSNGYDVGDISSSLQVVTFMKEWLNDHPRYRSHNFYVGGASYAGKVVRVIVQYISEAIEEQRQRPLIDLKLQGYIVGNPITGSKFDKNFHVPYSHGVGIISDQLYEAAVTHCKGDFVNPTNQLCANVVYTINKLMSEVSDGNILEDKCVKAAPKPTIDVSASRALLEEYSRLSKPPIRPSMDCASYGYYLSYCWMNDNTTRDALKIKKGTIGEWLRXNRGVFPYAKDIPNALDYHFNLTTRGYRALVMSGDHDLKVPFLSTQAWIRSFNFFIVDDWRAWHVDGQAAGFTITYANNLTFATVKVILSFNVLSIDLF

SEQ ID NO: 21857 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQYVRSHRSNGGRGLQ

SEQ ID NO: 21858 - protein, 572 aa, Saccharomyces cerevisiae
MCGIFAAFKHEDIHNFKPKALQLSKKIRHRGPDWSGNAVMNSTIFVHERLAIVGLDSGAQPITSADGEYMLGVNGEIYNHIQLREMCSDYKFQTFSDCEPIIPLYLEHDIDAPKYLDGMFAFCLYDSKKDRIVAARDPIGVVTLYMGRSSQSPETVYFASELKCLTDVCDSIISFPPGHVYDSETDKITRYFTPDWLDEKRIPSTPVDYHAIRHSLEKAVRKRLMAEVPYGVLLSGGLDSSLIAAIAARETEKANADANEDNNVDEKQLAGIDDQGHLHTSGWSRLHSFAIGLPNAPDLQAARKVAKFIGSIHHEHTFTLQEGLDALDDVIYHLETYDVTTIRASTPMFLLSRKIKAQGVKMVLSGEGSDEIFGGYLYFAQAPSAAEFHTESVQRVKNLHLADCLRANKSTMAWGLEARVPFLDKDFLQLCMNIDPNEKMIKPKEGRIEKYILRKAFDTTDEPDVKPYLPEEILWRQKEQFSDGVGYSWIDGLRDTAERAISDAMFANPKADWGDDIPTTKEAYWYRLKFDAWFPQKTAADTVMRWIPKADWGCAEDPSSRYAKIHEKHVSA

SEQ ID NO: 21859 - protein, 453 aa, Methylococcus capsulatus
MPFIPHTEAEVRDMLAAIGAGSIDELFAEIPPDLRCGELKDLPEALSEMEVCKLMEERAAENRSALCFAGAGAYEHYIPAAVWEIALRGEFYSAYTPYQAEASQGSLQVFYEYQSMMAGLMAMDVSNASLYDGASALGEAILMALRTNPESRSRKILLPRSLNPVYKRVVRTLTRNQRVELVDLDYDRSLGRIAENALETFEGGEFAAVVIPQPNHFGVLEEVDVLADWAHRHGARSIAVVNPTAMALLKPPGEWGEHGADLACGEGQPLGIPLSAGGPYFGFLCSRQDFVHQLPGRLVGRTVDVDGREGFTLTLQPREQHIRRGKATSNICTNQGLMVTAATLYMALMGPKGLRNVAAACHANASALLERLTRIDGVEPVFPAPFFHEAAIRLPRAADRVLAGLAERGILGGHVLSADYPELGDALLICATETRGPEDMDRYAAALAEVLEC

SEQ ID NO: 21860 - protein, 1870 aa, Gibberella zeae
MKGSDSLRRANRPAANFDLPPVALAQAQQQTQVQAQAQAQSFQSQSQPQESITNTVTSTSPEITNASLHGQAQAKAQALTTARFRSSSRPSLQDLALVDGTSTSNNHDLPPAYALSSSSSSTGPSSFSYPPAHVHPRPSTANAAATTHTHTRPRPLGPSSSDIATAEQAQFLRIHPVSSTSSLRPRSSTTSASAVASASASTSPSHTPNSLLRQHTSPPSAVDNNSAHFVPRGGLPPAPSIMYQANQRHVSGTDPSRPYQVPPPPPPPMGGPNNGHMPNMMNLPPPPPLPRYNTAPGSNGLSLPPPPGPPPASALGQQPPWHGAFGRMYDSRSGFNIPPPPPSSQHQPYNPKLHAQIAAGQTVSIPPPPPPNEAMSATYIPQGDTYGEGVGIPAFGLEDPTLTVNSQTLRPVTTPQSGTDTNATTPMDEATRERLYAANNAQPRGTSNSSNPTPPGSIPPEIAAQWPLDTVLLWLAQNQFSKDWQETFRALNLHGAQFLELGSGHGGRGNFGMMHQQVYPRLAQECTNSRTGWDQPREREEGKRMRRLIRSIVTGRPADVSKVSTSHGRKESLNGGHGNNLPSAGTDPMDSPNTPLTAPGPGFSSRRFSQTRSTTLPNSISASNINSESNHRNILKHVDTDGARRHSPNVSESSEATFRAPAVHSASPTGSPGIPPALYTSTTTPTIAQSPSAIKAGHRSRSSMDSVASVAAIYGSGVPSDAASLLNRNMNLGDIVHGRSHDARSRHSPSDGGDRSAGGETPSSAKDSNRLLSFLSRKKKQTKDDGAYPSPEDMNGSPTSPHGSFRPVGLGVRGSNGSDTNIDLSGSTLGDDRNGSTLNMRWNKISPVRTYVLATMDYWNYRMCDITEAETATEIRQVICMHLGLGDYENSHIYLTEAGKFEHVDPLDDPSLITVRRAKGDPLGTLKFFVTPPGVAPISSLSVKAEVPIILSPSYLSPGTPVEDAQQMSRQRSSSSPPTSRSNTLTNEKNEDKIAREAKQYRAEIERKQQEYLAKRKQAAMKGSPSETLGPGIVGRNVDFDQPRESPYEDKRPEPLFPQRRPPAPPSDPSATLIKANSLSRKTGASMRASSSSLEGYPSKRYPENEMAEKTKKANKQAPPAPGIGAALAGMGRNLSAIGQSAKNGRASSPSRSSTHSIPGGKDTFSTVEPSQGRGSPSTTSSSKLTTGNVTWNKKNLGFIVPDYSPSDSSFLLSPSPTVDAKFNATVPRAMSPAEMSPNSSRSRTSFPPNQQSPTHRRASHGPEPEFEDTDVHFSKPAPAPPADDDSDDSDDGLFAIPIANQNKGKAAAANADANGHSKRPSLHVNTERSRKGLSVAFKSPKSFGSGMDSNEDSGRQNPTTPHSETWEPEEKDKESKLGRRKSFIEKDVWANRPPTDALINNLDDFFPNLDLDQPVLDEPGESGMPPSPIAESSETNIDQQAQNVAPPQPSYPQHVPPAIPPTRQPSLYNENDTLGSDESTLKALDQHRPTSVAQRSIRRSGGLGRMKSIREVARGAHEANKRTTSTNQGQAATTNIMRRKSTKMFNANIVQIRPDRRGSVVMPQIPQDTVPKRQTTFRWFKGQLIGKGTYGRVYLGMNATTGEFLAVKEVEVNPKAAGGDKNKMKELVAALDQEIDTMQHLDHINIVQYLGCERKETSISIFLEYISGGSIGSCLRKHGKFEESVVSSLTRQTLSGLAYLHREGILHRDLKADNILLDLDGTCKISDFGISKKTDNIYGNDKTNSMQGSVFWMAPEVIRSQGEGYSAKVDIWSLGCVVLEMFAGKRPWAKEEAVGAIYKIANGERPPIPEDIQDTLGPLAVAFMMDCFQVNPFDRPTADVLLSQHPFCEVDPHYQFYDTALYHRIKSFK

SEQ ID NO: 21861 - protein, 488 aa, Methylococcus capsulatus
MLIFDRSREGRACASLFPQTPADIRGLPGHLLRQTPPPLPEVTELDVVRHYTRLSQKNFSIDTHFYPLGSCTMKYNPKAANVLARQPGFAALHPLGTERFGQGTLSCLYELQEYLKTLTGMTAVSLSPAAGAQGEFCGVAMIRAYHDARNDHERNEILVPDAAHGTNPASAAMCGYQVREIPTNADGDVDLEALKQAVGPKTAGIMLTNPSTLGVFEHRIPEIAALVHEAGGLLYYDGANLNAILGKVRPGDMGFDVIHLNLHKTFSTPHGGGGPGAGPVGVNARLQPFLPLPMVARSGNGYRWLAESDRPQSIGRLSAFAGNVGVLLRAYVYIRLLGYPGLRRVAEYATLNANYLQKRLVEAGFDTAFPARRAAHEFILSVQRQKKEHHVTALDFAKRLLDYGFHAPTVYFPLLIPECLMIEPTETENKETLDAFVDAMAAILKEAAEEPERLGQAPHCTPVRRLDEARAARHPDLAWKPAAPVPPR

SEQ ID NO: 21862 - protein, 375 aa, Xylella fastidiosa
MTPIVFIDRDGTLIEEPPDFQIDAYEKLRLVNGVIPALLKLRDAGYHFVIVTNQDGLGSPTYPQASFDGPNALMLQIFSSQGIVFRDVLIDRSWPADNAPTRKPGIGLMVAYLQDRDIDWARSAMVGDRPTDLQFAENLNIRGFQLRTPQFGGDWDWDGIAHTLADAPRRAVVQRHTKETNIRVEIDLDGAPQARITTGLPFFNHMLEQIAKHAGISLQISAVGDLHIDEHHTIEDTGLALGQAVRQALGDKRGIGRYGFDPPQLPWQVSGAAAHGGFTLPMDETQASAVLDFSGRPYFVFEGTFVRERVGDMPTELVPHFFRSLCDASGMNLHLSVHGDNDHHKVEACFKALARALRQALQRHGHVLPSTKGAL

SEQ ID NO: 21863 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQGYLTVRSMTRSNLQ

SEQ ID NO: 21864 - protein, 147 aa, Gossypium hirsutum
MAPKAEKKPAEKKPAEEKKAVAEKAPAEKKPKAGKKLPKEGGAAAGDKKKKRVKKSVETYKIYIFKVLKQVHPDIGISSKAMGIMNSFINDIFEKLAQEASRLARYNKKPTITSREIQTAVRLVLPGELAKHAVSEGTKAVTKFTSS

SEQ ID NO: 21865 - protein, 166 aa, Colwellia psychrerythraea
MTIERTILAGGCFWGMQDLIRKLPGVTSTRVGYTGGDVINATYRNHGNHAEGIEISFNTDVVSFRSILELFFQIHDPTTKNQQGNDLGASYRSAIYYCSTEQNTIAMQTIIDVDASGLWPGPVVTELVPVGDFWEAEIEHQDYLQNTPNGYTCHFPRSDWVLPSVK

SEQ ID NO: 21866 - protein, 145 aa, Capsicum annuum
MAPKAAAGKKPAEKKPVEEKKAEEVPAEKKPKAGKKLPKDAGRPDKKKKRAKKSIETYKIYIFKVLKQVHPDIGISSKSMGIMNSFINDIFEKLAQESSRLARYNKKPTITSREIQTAVRLVLPGELAKHAVSEGTKAVTKFTSS

SEQ ID NO: 21867 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQSSNRIRSVVGESLQ

SEQ ID NO: 21868 - protein, 135 aa, Arabidopsis thaliana; identical to SEQ ID NO: 572

SEQ ID NO: 21869 - protein, 146 aa, Nicotiana tabacum
MAPRADKKPAEKKPGAEKTPVAEKAPAEKKPRAGKKLPRDAGAAGDKKKKRAEMSVETYKIYIFRVLKHVHPDIGISSKAMGIMNSFINDIFEKLARESSRLAGYNKKPTISSREIQTAVRLVLPGELAKHAVSEGTKAVTKFTSS

SEQ ID NO: 21870 - protein, 476 aa, Xylella fastidiosa
MTANALFPLFANLHDRAVLVVGGGKVAERKTEALLKVGALPIIGAPSLTTSLQRWAETGRITWRQGTFEDSWLQEDIWLVIAATDQPEVNHAAARAAHAQRLFVNVVDDIALSNVQVPAVVERGPLRIAISSGGGAPMVARYLRQQLESLIDDSWGRLTTLFAQRRDTIRARYPNIEARRRFFETQLAGPLQRLLRKQRHAEAEAVLEAALAETPLTESGSVTLVGAGAGDAGLLTLNALRALNEADIILYDRLVSDTVLQMARRDAEQIEVGKSATGHSVRQEDIHTLMLQHAHAGQRVVRLKGGDPFVFGRGGEELEFLRTHGIPYEVIPGITAALACAAYAGIPLTHRDHAQSLCLITAHCQSSLDTLDWAALAQERQTLTFYMGVAGLPTIQQRLCEAGRAETTPFALIENGARAQQRVLTGTLKTLAHTAQTYAVRPPALLILGEVTALAEHLHWFGTAPLSAPCPPARIL

SEQ ID NO: 21871 - protein, 751 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTALQLLPNTRSIGSDMLQ

SEQ ID NO: 21872 - protein, 315 aa, Pasteurella multocida
MTIYSDNSYSIGNTPLVRLKHFGQGNIVVKVEGRNPSFSVKCRIGANMVWQAEKDGILTKEKEIVDATSGNTGIALAYVAAARGYKITLTMPETMSAERKRLLRGLGVNLVLTEGALGMKGAIAKAEEIVASDPQRYVMLKQFENPANPAIHQQTTGPEIWRDTDGQIDVLVAGVGTGGTITGISRYIKQDKGKAILSVAVEPAESPVISQTLAGEEIKPAPHKIQGIGAGFIPKNLDLALVDRVETVSSEEAMQTARRLMAEEGILGGISSGAAVAAADRLAKLPEFAEKLIVVILPSASERYLSTALFEGIEA

SEQ ID NO: 21873 - protein, 319 aa, Xylella fastidiosa
MTIYNTILDTIGHTPVVKLNRIAPAHVDLYIKVESFNPSGSVKDRLALAIILDAEQQGLLKPGDTIVEATSGNTGVALAMIAAARGYTFVATMVETFSIERRKLMRAYGAKVILTPATERGSGMVRKAKELAEQHGWFLASQFSNPANPAYHRNTTAAEILRDFAGRRLDHFVSGWGTGGTLTGVGEVLKIARPDIKITASEPANAALLQGKEWQPHKIQGWTPDFVPEVLNRSVPHHILSVTDDDAITVARRLAAEEGVFSGISGGASVATALQIAQQAEPGAVILAMLPDTGERYFSTPLFADINEHSDDAWLASLG

SEQ ID NO: 21874 - protein, 519 aa, Unknown
  Petunia x hybrida
MWDLNDSPDQRREINIDESEEGCSSHIELEPDDEKGKRVGSFSTSSSSAIAIDEISEEEDGEKGKKKRSSPSKLFGFSMVGPGDLEQPITRQFFPVDEAEAETGVVTNGSLNFPRAHWVGVKFYQNEPLGITGVVDVTQQQQQQQQPMKKSRRGPRSRSSQYRGVTFYRRTGRWESHIWDCGKQVYLGGFDTAHAAARAYDRAAIKFRGVEADINFNLEDYEGDLKQMTNLTKEEFVHVLRRQSTGFPRGSSKYRGVTLHKCGRWEARMGQFLGKKYVYLGLFDTEVEAARAYDKAAIKCNGKDAVTNFDPSIYENELNSTESTDSGADHNLDLSLGGSSSKKNNREFGDNRGQNPSSMQFDVDWRHNGLRPEKQTAPVDMDARRRDNGYNESETLQLLSKTHLHSPVSLKHNNSHQLQRFGQYMRPGESHMIQMFPPQFGSSNYQIQFPSGSNGGRIGATNVGDLSLSSSNASSQWQSNLPPQIFAAAAASSGFSQQIVRPQNWSSENGFHHFLMRPS

SEQ ID NO: 21875 - protein, 457 aa, Unknown
  Petunia x hybrida
MFDLNLCFEDEEELQFDNHNNSTETSNNSSSIINNIETTTTSSTCDDHEYISYSNNEYNNNSFVDFLKTDNNDQFLDSKELFPLSNGGEMAAPVNVYGNYGGTMEQRIIIPVQQQQQQQQQQVKKSRRGPRSKSSQYRGVTFYRRTGRWESHIWDCGKQVYLGGFDTAHAAARAYDRAAIKFRGLDADINFNVSDYQDDLKQMTNFTKEEFVHILRRQSTGFSRGSSQYRGVTLHKCGRWESRMGQFLGKKYIYLGLFDSEIEAARAYYKAAIKCNGREAVTNFELSTYEGELSTEADNGGASHNLDLNLGIASSSIADDQHDNTCLIGNSEFQCASIGLPEYRGAMNSPCTTMGSKMPHGRHLLWNGVNTSVFPTFKGTAIGKGMEVDSAPNWTWQDQNLYGGSSSVPLFSTAASSGFANSTTADVHQHYFSTGPLPYHHSPSLANMNFAQYYCRS

SEQ ID NO: 21876 - protein, 224 aa, Pichia jadinii
MAERTVKPQRRALVNRTTNETKIQISLSLDGGYVTVPESIFKDKKYDDATQVTSSQVISINTGVGFLDHMIHALAKHGGWSLIVECIGDLHIDDHHTTEDVGIALGDAVKEALAYRGVKRFGSGFAPLDEALSRAVVDLSNRPFAVVELGLKREKIGDLSCEMIPHFLESFAQAAHITMHVDCLRGFNDHHRAESAFKALAVAIKESISSNGTNDVPSTKGVLF

SEQ ID NO: 21877 - protein, 219 aa, Unknown
  uncultured bacterium
NSRLCMSSAVAGYTRSLGSDGPPCSYEDLDHCTVAFLIGTNTAECHPVLFQRLLKRKKRHPGSVTIVVVDPRQTDTAKAADIHLAVAPGSDLALLHGIAHLVMHENGQDPAFIDDCTDNYDTFFDVVARWTPRRVALFCGIPEKRLREVAQLFHRREKVLSLWSMGVNQRREGTAVVGGIINLHLLTGQIGKEGAGPFSLTRQPNAMGGREAGGLSHLL

SEQ ID NO: 21878 - protein, 521 aa, Bdellovibrio bacteriovorus
MGTSAELKGPNLSKGVDLSELREDKSLLGYVGEEPVILVRHDEEYFAIGATCSHYGGPLADGLVVGETVHCPWHHACFDLRTGEALKAPALNPVSAYNVEVRGSKVFVTSKKESTVRPREWSESQRYVIVGSGAAGTAAAIMLRKQGFIGSITIVSEDKSLPYDRPNLSKDYLAGNIPEDWVPLETEEFYQTHKIHFELSTKAEKVDAHRRSVFLSNGKTLRYDRLLLATGGEPIHPPIPGIKQDHVFYLRTLQDCQRIIGRTSWAQKVVIVGAGFIGLEVAAALRQRNLEVHVVAPEEMPLLKVVGVHVGSVLHKLHEEHGVIFHLGHTIKEIRQRSVLLDDGHSVDCDFVIVGTGIHPNTQLAEQAGCWVENGVLVNEYLETSVPGIFAAGDIARWPDPHSQRSIRVEHWEVAERQGQTAALNMMGDRIKFQDVPFFWTQHYDLSLGYVGHSDRFDRMDVMGDLNSRDFAVAYYEDQKVAAVLTLGRDRESLLVEEAIGQYDEKKIHEIFHQHERDHHP

SEQ ID NO: 21879 - protein, 219 aa, Unknown
  uncultured bacterium
NSRLCMSSAVAGYTRSLGSDGPPCSYEDLDHCTVAFLIGTNTAECHPVLFQRLLKRKKRHPGSVTIVVIDPRQTDTAKAADIHLAVAPGSDLALLHGIAHLVMRENGQDPTFTDNCTDNYDSFFDVVARWTPRRVALFCGIPEKRLREVAQLFHRREKVLSLWSMGVNQRREGTAVVGGIINLHLLTGQIGKEGAGPFSLTGQPNAMGGREAGGLSHLL

SEQ ID NO: 21880 - protein, 219 aa, Unknown
  uncultured bacterium
NSRLCMSSAVTGYTRSLGSDGPPCCYEDLDHCSVAFLIGTNTAECHPVLFQRLLKRKKRNPGSVTIVVVDPRRTDTAKAADIHLPIAPGSDLALLHGIAHLVLRENGQDPAFIDDHTDNYEAFFDVVARWTPRRVARFCNLPEKRLREVAQLFHRRERVLSLWSMGVNQRREGTAVVCGLINLHLLTGQIGKEGTGPFSLTGQPNAMGGREAGGLSHLL

SEQ ID NO: 21881 - protein, 322 aa, Bacillus methanolicus
MNKIAVLTSGGDAPGMNAAIRAVVRRGIFKGLDVYGVKNGYKGLMNGNFVSMNLGSVGDIIHRGGTILQTTRCKEFKTAEGQQQALAQLKKEGIDGLIVIGGDGTFEGARKLTAQEFPTIGIPATIDNDIAGTEYTIGFDTAVNTAVEAIDKIRDTAASHDRIYVVEVMGRNAGDIALWAGMCAGAESIIIPEADHDVEDVIDRIKQGYQRGKTHSIIVVAEGAFNGVGAIEIGRAIKEKTGFDTKVTILGHIQRGGSPSAYDRMMSSQMGAKAVDLLVEGKKGLMVGLKNGQLIHTPFEEAAKDKHTVDLSIYHLARSLSL

SEQ ID NO: 21882 - protein, 219 aa, Unknown
  uncultured bacterium
NSRLCMSSAVAGYTRSLGSDGPPCSYEDLDHCSVAFLIGTNTAECRPVLFQRLLKRKKRNPGSITIVVVDPRRTDTAKAADIHLPIAPGSDLALLHGIAHLVMRENGQDPAFIDDHTEHYDAFFDVVARWTPRRVALFCNIPEKRLRDVAALFHRREKVLSLWSMGVNQRREGTAVVQGLINLHLLTGQIGKEGAGPFSLTGQPNAMGGREAGGLAHLL

SEQ ID NO: 21883 - protein, 288 aa, Medicago truncatula
MISENSNSNGGDENGDKVKGSWSKTEDETLVKLVKENGARNWSVISNEIPGRSGKSCRLRWCNQLSPTVQHLPFTPAEDSIIIEAHAVHGNKWATISRLLPGRTDNAIKNHWNSTLRRRRTAAPAAVPPVTTIVQRVPTAVPVTVIPTGVMIGKRVNESYDGDYYKDLLSLGTRYKRPCVLVENNSGSRGSREGEETVTEDDDAGNKGVNVVRTSLSLFPPGFLKEEEERKEKQKEIEDFEDSNDDLKLLKNEKLRSMLQRMIAEEVRNYVDKMRLGGGLAPDSTLRK

SEQ ID NO: 21884 - protein, 219 aa, Unknown
  uncultured bacterium
NSRLCMSSAVAGYTRSLGSDGPPCCYDDLDHCSVAFLIGTNTAECHPVLFQRLLKRKKRYPGSVTIVVVDPRRTDTAKAADIHLPIAPGSDLALPHGIAHLVLRENGQDPAFIDDHTENYEAFFDVVARWTPRRVARFCNLPEKRLREVAQLFHRRENVLSLWSMGVNQRQEGTAVVCGLINLHLLTGQIGKEGAGPFSLTGQPNAMGGREAGGLSHLL

SEQ ID NO: 21885 - protein, 511 aa, Unknown
  Burkholderia sp. 383
MSAIPKSDPSGSSANPPKLHRALKARHLTMIAIGGSIGTGLFVASGASISQAGPGGAMVAYMAIGLMVYFLMTSLGEMAAFMPVSGSFATYGAKYVDEGFGFALGWNYWYNWAVTIAVELVAAQLVMHYWFPDVPGVWWSAAFLGVMFLLNALTVRGFGEAEYWFALIKVVTVVAFIGVGLLMIFGILKGAPSNGWGNLTIGDAPFAGGLPALMGVAMIAGFSFQGTELIGVAAGESENPRTTIPRAVRQVFWRILLFYVFAIFVIGVLIPYTDPNLLKTDVTDIGVSPFTLVFRHAGLAFAAGVMNAVILTAVLSAGNSGMYASTRMLYNLATEGRAPKIFAKLSRGGVPRNALYATTAVGALCFFTSLYGDKTVYLWLLNTSGMTGFIAWLGIAVSHYRFRKGYVKQGYSLDQLPYQSKWFPFGPLFAFVLCLVIALGQDYQAFLANRIDWAGVAATYVGIPLFLVVWLGFRFLKKSRLVRYEDMEIAPWIAAGRGAQQQPVANRETAG

SEQ ID NO: 21886 - protein, 211 aa, Dimocarpus longan
AWHSAGTFDLHSKTGGPFGTIRHPDELAHEANNGLDIAVRLLEPIKEQFPILSYADFYQLAGVVAVEITGGPEIPFHPGRPDKSDPPPEGRLPAATEGSDHLRDVFGHMGLSDKDIVALSGGHTLGRCHEERSGFEGPWTSNPLIFDNSYFKELLSGEKEGLIQLPSDKALLEDSVFRPLVERYAADEDAFFADYAESHLKLSELGFADAD

SEQ ID NO: 21887 - protein, 72 aa, Haemophilus influenzae
MAKEDCIEMQGTILETLPNTMFRVELENGHVVTAHISGKMRKNYIRILTGDKVTVEMTPYDLSKGRIIFRSR

SEQ ID NO: 21888 - protein, 312 aa, Hordeum vulgare
PPSVESIGVCYGMSANNLPAASTVVSMFKFNGIKSMRLYAPNQAALQAVGGTGINVVVGAPNDVLSNLAASPAAAASWVKSNIQAYPKVSFRYVCVGNEVAGGATRNLVPAMKNVHGALVAAGLGHIKVTTSVSQAILGVFSPPSAGSFTGEAAAFMGPVVQFLARTNAPLMANIYPYLAWAYNPSAMDMGYALFNASGTVVRDGAYGYQNLFDTTVDAFYTAMGKHGGSSVKLVVSESGWPSGGGTAATPANARFYNQHLINHVGRGTPRHPGAIETYIFAMFNENQKDSGVEQNWGLFYPNMQHVYPINF

SEQ ID NO: 21889 - protein, 228 aa, Unknown
  Erythrobacter sp. NAP1
MSKARRAIRNAAIALALTSAATPALALDKPVNAPAPERIAREGAGLKTAIFAGGCFWGVEGVFSHIKGVKSAESGYHGGAAATAKYNRITAGGTNHAEAVRITYDPYVIRYDELLRIFFSVVADPTLLNRQGPDVGAHYRSALVPTSAEQRAVAEAYLAQMDASGIWGRPIVTKVERMRTFYAAEDYHQDYMVKNPRSPYIVRWDAPKVEALRVMFPSDFRDSFLRDG

SEQ ID NO: 21890 - protein, 442 aa, Debaryomyces hansenii
MAESIAKDANNAFSLLKTLSNDQRSSALQKIHDALQKNKGQIIEANKIDMDNAVKGNLSSSLVKRLDLSNSGKFDTMLQGILDVANLPDPVGKCTLAKKIDEGLNLYRVSAPIGVLLIIFESRPEVIANITALAVKSGNAAILKGGKESYQTFKIMSDIVNTTLDKETDVPGPAVQLIQSREEVGDLLLQDKYIDLVIPRGSNELVRNIKSNTKIPVLGHADGICSIYIDKEADLDKATRVLVDSKTNYPAGCNAVEQLLIHQDIANDDEKLSKIINSLINAKVTSHVVPEIKSKLTNFNQEFIKDAADDAFDKEYLSFDISVKPVASAADAISHINTHSSKHTESIITENKATAETFMKAIDSAGVYWNCSTRFADGFRYGFGTEVGISTNKIHARGPVGLEGLMSYQYQLRGDGHIVADYVGGGGKKVFVHEDLDTNVNV

SEQ ID NO: 21891 - protein, 182 aa, Brassica napus
  misc_feature (129)..(129): Xaa can be any naturally occurring amino acid
  misc_feature (151)..(151): Xaa can be any naturally occurring amino acid
  misc_feature (153)..(153): Xaa can be any naturally occurring amino acid
  misc_feature (176)..(176): Xaa can be any naturally occurring amino acid
MSMSSMSSPSSAVFSPEPLSPSDHLCYVQCNFCETILAVSVPYTSMFKTVTVRCGCCTNLLSVNMRSAALPASNQLQLGPHSYFNTQNILEELRDAPSNMNMMMMNQHPNMNDIPSFMNIHQHEITKSXHPVNRPPEKRQRVPSAYNRFIXRXEIPRIKGGNPEISPEKPFRVVAXNGAPFL

SEQ ID NO: 21892 - protein, 726 aa, Arabidopsis thaliana
  misc_feature (426)..(426): Xaa can be any naturally occurring amino acid
MTEIDRSRAFAKDVKRIVVKVGTAVVTGKGGRLALGRLGAICEQLAELNSDGFEVILVSSGAVGLGRQRLRYRQLVNSSFADLQKPQMELDGKACAGVGQSSLMAYYETMFDQLDVTVAQMLVTDSSFRDKDFRKQLSETVKAMLRMRVIPVFNENDAISTRRAPYKDSTGIFWDNDSLAALLSLELKADLLILLSDVEGLYTGPPSDSTSKLIHTFIKEKHQDEITFGEKSKLGRGGMTAKVKAAVNAAYGGVPVIITSGYAAENISKVLRGLRVGTLFHQDAHLWAPVVDTTSSDMAVAARESSRKLQALSSEDRKQILHDIANALEVNEKTIKAENDLDVAAAQEAGYEESLVARLVMKPGKISSLAASVRQLAEMEDPIGRVLKKTQVADDLILEKTSSPIGVLLIVFESRPDALVQIASLXIRSGNGLLLKGGKEARRSNAILHKVITDAIPETVGGKLIGLVTSREEIPDLLKLDDVIDLVIPRGSNKLVSQIKNSTKIPVLGHADGICHVYVDKSGKLDMAKRIVSDAKLDYPAACNAMETLLVHKDLEQNGFLDDLIYVLQTKGVTLYGGPRASAKLNIPETKSFHHEYSSKACTVEIVEDVYGAIDHIHQHGSAHTDCIVTEDSEVAEIFLRQVDSAAVFHNASTRFSDGFRFGLGAEVGISTSRIHARGPVGVEGLLTTRWIMRGKGQVVDGDNGIVYTHKDLPVLQRTEAVENGI

SEQ ID NO: 21893 - protein, 324 aa, Triticum aestivum
MEAETAAKRAREGEGAAAADGAGEQAGISAVIPGWFSEISPMWPGEAHSLKVEKVLFQGKSDYQNVLVFQSSTYGKVLVLDGVIQVTERDECAYQEMITHLPLCSIKDPKKVLVIGGGDGGVLREVSRHSSVEQIDICEIDKMVVDVSKQFFPRLALGFEDPRVSLHIGDGVAFLKNAPEGTYDAVIVDSSDPVGRAQELFEKPFFESVSRALRPGGVVCTQAESIWLHMHIIEDIVTNCRQVFKGSVNYAWTTVPTYPSGVIGFMLCSTEGPSVDFQHPVFSIEEDEYSTKSKGPLKFYNSEFHTASFCLPLFARRVIEAKAN

SEQ ID NO: 21894 - protein, 172 aa, Arabidopsis thaliana; identical to SEQ ID NO: 432

SEQ ID NO: 21895 - protein, 457 aa, Debaryomyces hansenii
MQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGQ

SEQ ID NO: 21896 - protein, 393 aa, Unknown
  Frankia sp. EAN1pec
MSVRDMVEKDYYAALGVPKDASAADIKKAYRKLARELHPDKNPGDVKAEARFKEVSEAYDVLSDENRRREYDEARALFASGSYPGAGGRGGGMGGFGTPGGYGPGAGNLNLDDLLNGNGGGGLGGIFDNLFQRTPTGRAPRRGTDIAAEVTISFEKSLTGLEATVRLPGAATCATCAGIGARPGTSPRTCPVCRGLGVISRSQGGFALSEPCRDCLGKGSLIDHPCPDCHGTGRREREQRIRIPAGVSDGQRLRVRGRGSPGERGGAAGDLEVTVHVQSHPVFGREGHNLTINLPVTITEAALGASVKVPTIDGTPLTVKVPAGTSSGRRLRARNRGVPRPGGENGDLIVTLEVTVPKPSELSPKARTALQEFARAHPEDPRESLIAQMEGRA

SEQ ID NO: 21897 - protein, 735 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRTGDGRGGASTGTQRFAPLNSWPNNANLDKARRLLWPIKKKYGNKISWADLFILAGNVAIESMGGKTIGFGGGRVDVWHPEEDVYWGSEKEWLASERYSGDRELENPLAAVQMGLTYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTA

SEQ ID NO: 21898 - protein, 418 aa, Bradyrhizobium japonicum
MALRRRPPNRRCLVSEPLVIVGNGMAAARLVDELAKTSLGRYAVAVIGDEPRLAYNRVLLSSVLAGETGSHEIELRPADWWRHRGVTVRYGYRVTEIDTGRRELKIEGEESMEYSKLVLATGSTPLRLNVPGADLAGVHTFRDTRDVDLLLTLAAAKKRVVVVGGGLLGLEAAYGLAKAGAPVTLLHLMDRLMERQLDGPAADLLKTLVERKGIRILLNASTKCIHGDGHVEAVELADGSRIEADAVIFAAGIRPNIALAKDAGIAVNRGIVVNDVMQTASPDIFALGECAEHRGTCYGLVEPAYEQARVLARHLAGRPAAYQGSVVSTNLKVSGVSVFSAGDFIGGEGSESLVLSDRRRGTYKKLVIADGRLTGAVLIGDTVDALWYLELIRNRDKVAAIRTDMMFGRALARPSKAA

SEQ ID NO: 21899 - protein, 86 aa, Arabidopsis thaliana
MTKRYWNIDLEKIMRAGVHFGHGTRKWNPRMAPYISTKHKEGFNRLLKRDAAVLKRQLSRMETYLGGIKYMTGLPDIVIILDQQEE

SEQ ID NO: 21900 - protein, 466 aa, Colwellia psychrerythraea
MSVISITDVLAGNFPVNESITIHGWIRTRRDSKAGISFLALHDGSCFDAIQAIVPNELDNYESDVLKLTTGCSVKVTGILVESPGKGQAFEIQATEVEVLGFVEDPDTYPMAAKRHSIEFLREQAHLRPRTNIGGAVTRVRNCLAQAVHRFLHSKGYFWISTPLITGSDCEGAGEMFRVSTLDMENLPRNDEGKVDYNKDFFGKETFLTVSGQLNVETYCNALSKVYTFGPTFRAENSNTTRHLAEFWMVEPEIAFADLSDAADLAEEMLKYVFKAVLEERPDDMAFFQQRVDKTVLDRLNSVINTDFVRLDYTDAITILENCGKKFENQVSWGVDLNSEHERYLAEEHFNGPVVLQNYPKDIKSFYMRLNDDGKTVAAMDILAPGIGEIIGGSQREERLDVLDSRLEEMGLDIADYGWYRDLRRYGTVPHSGFGLGFERLVAYATGMQNVRDVIPFPRTPNNAAF

SEQ ID NO: 21901 - protein, 541 aa, Methanocaldococcus jannaschii
MCSISGIIVKDNQISAKYSIDMMKILKHRGRDNSGLLLDDEVIYFNDFEDVEDLEEEMIGNLSLAHNRLAIVGRYGVQPIPNEDETIWLVCNGEIYNYIELREYLKQNHEFRTDSDNEVIIHLYEEEKLEELDGDYAFAIYDKSKNVVRLARDMFGVKPLFYVDRDKYFAFASERKALWHLLINIDGCERDLDELNSKIKTLKPNSQLIYYLDDNRFEIIEGFKKLELNYMKERSYEEAKEYLDRALKNSVLKRVRGLDKVGIICSGGVDSSLIAKLASLYCEVILYAVGTENSEDLIYAERLAKDLNLKLRKKIISEEEYEEYVFKVAKAIDEVDLMKIGVGIPIYVASEMANEDGLKVVLSGQGADELFGGYARHERIYRERGEEELKKELLKDVYNLYKVNLERDDHCTMANGVELRVPFLDEEVVEIALSIPIEYKMSELSNRPYAESNISLKSEPINGLKNTNLNIKCVRSVRKKILRDVASQYLPDYIAYRPKKAAQYGSGGEKMIYKVAKKYGFSKKRINEFLDMLKRKIVSEF

SEQ ID NO: 21902 - protein, 523 aa, Pichia pastoris
MILHTYIILSLLTIFPKAIGLSLQMPMALEASYASLVEKATLAVGQEIDAIQKGIQQGWLEVETRFPTIVSQLSYSTGPKFAIKKKDATFWDFYVESQELPNYRLRVKRNNPEVLKVDFTKQYSGYLDVEADDKHFFYWFFESRNDPQNDPIILWLNGGPGCSSLTGLFFELGSSRINENLKPIFNPYSWNGNASIIYLDQPVNVGFSYSSSSVSNTVVAGEDVYAFLQLFFQHFPEYQTNDFHIAGESYAGHYIPVFADEILSQKNRNFNLTSVLIGNGLTDPLTQYRYYEPMACGEGGAPSVLPADECENMLVTQDKCLSLIQACYDSQSAFTCAPAAIYCNNAQMGPYQRTGKNVYDIRKECDGGSLCYKDLEFIDTYLNQKFVQDALGAEVDTYESCNFEINRNFLFAGDWMKPYHEHVSSLLNKGLPVLIYAGDKDFICNWLGNRAWTDVLPWVDADGFEKAEVQDWLVNGRKAGEFKNYSNFTYLRVYDAGHMAPYDQPENSHEMVNRWISGDFSFH

SEQ ID NO: 21903 - protein, 183 aa, Citrus unshiu
MRDGSLKGLFCTAPKSIRSVRRNSGSFNVTAFTEEQEALVVKSWNAMKKNSGELALKFFLRIFEIAPSAKKLFTFLKDSDIPVEQNPKLKPHATTVFVMTCESAVQLRKAGKVTVRESNLKDLGATHFKYGVADEHFEVTKYALLEPIKEPVPEMWSPELKNAWAEAYDQLAAAIKIEMKPPS

SEQ ID NO: 21904 - protein, 766 aa, Arabidopsis thaliana
MLRSLGLGLLLFALLALVSGDNDYVSCNCDDEGFLSVHTILECQRVSDLLIAIAYFSIPLELLYFISFSNVPFKWVLVQFIAFIVLCGMTHLLNAWTYYGPHSFQLMLWLTIFKFLTALVSCATAITLLTLIPLLLKWKVRELYLKQNVLELNEEVGLMKRQKEMSVQVRMLTREIRKSLDKHMILRTTLVELSKILDLQNSAVWMPNENRTEMHLTHELRANPMRSFRVIPINDPDVVQVRETKVVTILRKNSVLAVESSGCGGSEEFGPVAAIRMPMLHGLNFKGGTPEFVDTPYAIMVLVLPSANSRVWTDKEIEIAEVVADQVAVAISHASVLEESQLMREKLGIQNRALLRAKQNAMMASQARNTCQKVMSHGMRRPMHTILGLLSMFQSESMSLDQKIIVDALMKTSTVLSALINDVIDISPKDNGKSALEVKRFQLHSLIREAACVAKCLSVYKGYGFEMDVQTRLPNLVVGDEKRTFQLVMYMLGYILDMTDGGKTVTFRVICEGTGTSQDKSKRETGMWKSHMSDDSLGVKFEVEINEIQNPPLDGSAMAMRHIPNRRYHSNGIKEGLSLGMCRKLAQMMQGNIWISPKSHGQTQSMQLVLRFQTRPSIRRSILAGNAPELQHPNSNSILRGLRITLADDDDVNRTVTKRLLEKLGCEVTAVSSGFECLNALSNVEMSYRVVILDLQMPEMDGFEVAMKIRKFCGHHWPLIIALTASTEDHVRERCLQMGMNGMIQKPVLLHVMASELRRALQTASE

SEQ ID NO: 21905 - protein, 161 aa, Marchantia polymorpha
DSATHSVTFFAKIFEIAPGAKALFSFLKDSDIPFDKNPKLKAHALTVFRLTGDSACMLGEKGAIDALHPKLKELGKKHVGYGVIAAHFDVVKAALLSTIESLLPEDWPAEKKVATCGAWSQAYDELAGVMINEMQAIRDAEKAPAAEEAPEAPAAESKALP

SEQ ID NO: 21906 - protein, 176 aa, Pyrococcus furiosus
MRRTTKETDIIVEIGKKGEIKTNDLILDHMLTAFAFYLGKDMRITATYDLRHHLWEDIGITLGEALRENLPEKFTRFGNAIMPMDDALVLVSVDISNRPYANVDVNIKDAEEGFAVSLLKEFVWGLARGLRATIHIKQLSGENAHHIVEAAFKGLGMALRVATKESERVESTKGVL

SEQ ID NO: 21907 - protein, 361 aa, Oryza sativa
MEEISHHFGVVGASGVHGGHQHQHHHHPWGSSLSAIVAPPPPPQLQQQQTQAGGMAHTPLTLNTAAAAVGNPVLQLANGSLLDACGKAKEASASASYAPDVEAIKAKIISHPHYSSLLAAYLDCQKVGAPPEVAARLTAVAQDLELRQRTALGVLGAATEPELDQFMEAYHEMLVKYREELTRPLQEAMEFLRRVETQLNTLSISGRSLRNILSSGSSEEDQEGSGGETELPEIDAHGVDQELKHHLLKKYSGYLSSLKQELSKKKKKGKLPKDARQQLLNWWELHYKWPYPSESQKVALAESTGLDLKQINNWFINQRKRHWKPSDEMQFVMMDGYHPTNAAAFYMDGHFINDGGLYRLG

SEQ ID NO: 21908 - protein, 219 aa, Unknown
  uncultured bacterium
NSRLCMSSAVAGYTRSLGSDGPPCSYEDLDHCSVAFLIGTNTAECHPVLFQRLLKRKKRNPGSITIVVVDPRRTDTAKAADIHLPIAPGSDLALLHGIAHLVMRENGQDPAFIDDHTEHYDAFFDVAARWTPRRVALFCNIPEKRLRDVAALFHRREKVLSLWSMGVNQRREGTAVVQGLINLHLLTGQIGKEGAGPFSLTGQPNAMGGREAGGLAHLL

SEQ ID NO: 21909 - protein, 613 aa, Oryza sativa
MPTTFTPNSPASSCSIHHRASPSRGARNSVRFTRPRAAAAATNSVLSAPSSVPPAYVPPPPPPPTKMFPEAGDAAAAKAAARRCGKKKDGLNFFQRAAAVALDAFEEGFITNVLERPHALPRTADPAVQIAGNFAPVGEQPPVRSLPVSGRIPPFINGVYARNGANPHFEPTAGHHLFDGDGMVHAVRIRNGAAESYACRFTETARLGQERALGRAVFPKAIGELHGHSGIARLALFYARGLCGLVDPSHGTGVANAGLVYFNGRLLAMSEDDLPYQVRVTADGDLETVGRYDFDGQLGCAMIAHPKLDPVSGELFALSYDVIKKPYLKYFYFDADGTKSPDVEIELEQPTMIHDFAITENFVVVPDHQVVFKLGEMFRGGSPVVLDREKTSRFGVLPKHATSSLEMVWVDVPDCFCFHLWNAWEEAESGEVVVVGSCMTPADSIFNESDEHLESVLTEIRLNTRTGESTRRAVLPPAAQVNLEVGMVNRAMLGRKTRYAYLAVAEPWPKVSGFAKVDLATGELTKFEYGEGRFGGEPCFVPMGGAGAAASPARGEDDGYILSFVRDEAAGTSELLVVNAADMRLEATVQLPSRVPYGFHGTFINAGELATQA

SEQ ID NO: 21910 - protein, 861 aa, Klebsiella pneumoniae
MTETRTTCPYCGVGCGVIASRAPHGQVSVRGDEQHPANFGRLCVKGAALGETVGLEDRMLFPEVDGERATWPQAGGGRFAPAGDYRSARGQAVRFTSGQLLTEDYYAANKLMKGFIGAANIDTNSRLCMSSAVTGYKRARWGTVVPCSYEDVENSDLVVLVGSNAAWAHPVLYQRLAQAKRDNPQMRVVVIDPRRTATCDIADRHLALAPGSDGGLFVGLLNAIAASRRISDDFNDAQRALTIAQDWDLDKVAQFCGLPRQQIADFYREFIAAPRAITLYTMGINQSASGSDKCNAIINVHLACGKYGRPGCGPFSLTGQPNAMGGREVGGLATMLAAHMNFEPDDLRRPARFWGSERLAQTGGLTGLELFAAIGRGEVKAVWIMGTNAMVSLPGTSHAVTEPWPVSLVIISDVADTDTGRFAHIRFPALAWGEKSGTVTNSERRISLQRAFMPPPGEARAAGGLSPAGRGLASALPGSIRTRCSANTPRFQGMKTMASGRLISADWRISAATWIALEPVRWPVSRSEAAWSVHKGWHRDGKLRMVPVAPQPTRATTVASIALLNADPQQRADPRSMAHHDPHPAVRLMQHINEPVVEVPPAEPQRYHLLEGELARVRSPKGVMVAKVTIGEANGPGSLFVPMHWNNQFARQGRVNNLLAAVTDPHSGQPESKQTAVAIATWLPAWKGELFSRQPVPLPCRCTGGGGRPRALSIFRWPGDTPSRDWLVEWCQRQGWQMQVAEGGKVWNLLAWRAGELMLGWWSDASEPAISASWIHARFVPPQNAARAHALLSGRKGGVEMPRGRIICSCFSVGERAIGEAIAGGCRSPGGRLGGKLKCGTNCGSCIPELKALLAANVAQA

SEQ ID NO: 21911 - protein, 219 aa, Unknown
  uncultured bacterium
NSRLCMSSAVAGYTRSLGSDGPPCSYEDLDHCTVAFLIGTNTAECHPVLFQRLLKRKKKHPGSVTIVVVDPRQTDTAKAADIHLAVAPGSDLALLHGIAHLVMRENGQDPTFIDNCTDNYDSFFDVVARWTPRRVALFCGIPEKRLREVAQLFHRREKVLSLWSMGVNQRREGTAVVGGIINLHLLTGQIGKEGAGPFSLTGQPNAMGGREAGGLSHLL

SEQ ID NO: 21912 - protein, 132 aa, Rubus idaeus
MARTKETARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIR

SEQ ID NO: 21913 - protein, 381 aa, Vibrio cholerae
MSKRDFYEVLGVGRDASERDIKKAYKRLAMKYHPDRNSGDAGAAEKFKEVKEAYEILTDAQKKAAYDQYGHAAFEQGAGGFGGGGFGGGGADFGDIFGDVFGDIFGGGRRGGGPRAQRGSDLRYNMELSLEEAVRGCSKEIEVPTLVHCDACDGSGAKKGTSAQTCGTCHGHGQVQMRQGFFAVQQTCPTCHGKGKIIKDPCNVCHGQGRKQKTKTLNVKIPAGVDTGDRIRLSGEGEAGEMGAPAGDLYVQVHVKEHHIFERDGNNLYCEVPVSFAMAALGGEVEVPTLDGRVSLKVPAETQTGRMFRMRGKGVKGVRSAALGDLIVKLVVETPVNLSARQKELLKEFEESCGGEAATKHKPKAEGFFNGVKKFFDDLTS

SEQ ID NO: 21914 - protein, 1073 aa, Alkalilimnicola ehrlichei
MKRMLINATQPEELRVALVDGQQLYDLDIETPAREQKKANIYKGTITRVEPSLEAAFVQYGAERHGFLPFKEIAPSYYREGLKADGGRPSIRDAVREGQEVVVQVDKEERGTKGAALTTYISLAGRYLVLMPNNPRAGGVSRRIEGSDRAEIREALRQLDVPEGMGLIVRTAGVGRTVEELQWDLDYLLKLWSAIQKAAEARSAPFLIYQESDVIIRALRDYLRSDIGEILIDDPQVFEKAVEFVEQVMPYNRQKLKYYDDRVPLFTRYQIESQIESAFQRDVRLPSGGAIVIDHTEALISIDINSARATKGSDIEETALHTNLEAADEIARQLRLRDLGGLIVIDFIDMGPNRNQREVENRLREAVKADRARVQIGRISRFGLLEMSRQRLRSSLGESHQEVCARCGGQGTVRSVESLALSILRIVEEEAMKEKTGTVLAQLPVDVATFLLNEKRPSISEIEDRHRVAVVLIPNRTMETPHYDVQRLRSDDESTEDPSYRLASEEHPEPSPEWLEREAAPRSEEPVVQRVQPPSAPPPTAPVEESPKEEAPPPQRDAPEGSGASDVGISGLTGLFQRLRGFFGREADNDSAGQEGPVGEKAPAASGRRGSDQKGATNGRRGGGSNGGKGGRTRQKARPEDGRSASQPEATGKPESDARRDADETAEGAGRSGRSRRGRRGGRRRRRSGSTGGGQPEESAARQDQKGQTPPAAEAADDAPRDRAAGKAEAAAERPREGDRAAAEKPAASEKVKADKPALPTITEEEIQGSATPQLKDWPPRGQVATEAASPESAPADDESGTAAGSPKATQAQRPATADTEASDTKADAPASSGETPADQPTGAPPAAGGDGAKAPTAEKAAGEKPGARRKRSKPSVQPGTPPVLPQDIGPDEPSVRSGRPRISAAAPTEGNEADTAGSADVAPREPTPANTGTDQPPKPAPEPAPAKAPEPAPGSDSEPAAADQDAAPAEEVPNAADDGAAGPQATPWLEHEPESSREAIGAHSAGTPDAPDAQKAPADTADAADTAGDEGGDQTQETDEASRKGGSRRKGPAGESEARPESPDQGRSREDD

SEQ ID NO: 21915 - protein, 219 aa, Unknown
  uncultured bacterium
NSRLCMSSAVAGYTKSLGSDGPPCCYDDLDHCSVAFLIGTNTAECHPVLFQRLLKRKKRNPGSVTIVVVDPRRTDTAKAADIHLPIAPGSDLALLHGIAHLVLRENGQDPAFIDEHTDNYEAFFDVVARWTPRRVARFCNLPEKRLREVAQLFHRRERVLSLWSMGVNQRREGTAVVCGLINLHLLTGQIGKEGTGPFSLTGQPNAMGGREAGGLSHLL

SEQ ID NO: 21916 - protein, 219 aa, Unknown
  uncultured bacterium
NSRLCMSSAVAGYTRSLGSDGPPCSYEDLDHCTVAFLIGTSTAECHPVLFQRLLKRKKRHPGSVTIVVVDPRQTDTAKAADIHLAVAPGSDLALLHGIAHLVMRENGQDPTFIDNCTDNYDSFFDVVARWTPRRVALFCGIPERRLREVAQLFHRREKVLSLWSMGVNQRREGTAVVGGIINLHLLTGQIGKEGAGPFSLTGQPNAMGGREAGGLSHLL

SEQ ID NO: 21917 - protein, 840 aa, Oryza sativa
MAAAVAMRSGSGSDGGGGGYDKAGMDSGKYVRYTPEQVEALERVYAECPKPSSSRRQQLLRDCPILANIEPKQIKVWFQNRRCRDKQRKEASRLQAVNRKLTAMNKLLMEENERLQKQVSQLVHENAYMKQQLQNPSLGNDTSCESNVTTPQNPLRDASNPSGLLTIAEETLTEFLSKATGTAVDWVPMPGMKPGPDSFGIVAVSHGCRGVAARACGLVNLEPTKIVEILKDRPSWFRDCRSLEVFTMFPAGNGGTIELVYMQMYAPTTLVPARDFWTLRYTTTMEDGSLVVCERSLSGSGGGPSTASAQQFVRAEMLPSGYLVRPCEGGGSIVHIVDHLDLEAWSVPEVLRPLYESSRVVAQKMTTAALRHIRQIAQETSGEVVYALGRQPAVLRTFSQRLSRGFNDAISGFNDDGWSVMGGDGIEDVIIACNAKKVRNTSTSANAFVTPGGVICAKASMLLQSVPPAVLVRFLREHRSEWADYNFDAYSASSLKTSSCSLPGLRPMRFSGSQIIMPLAHTVENEEILEVVRLEGQALTHDDGLMSRDIHLLQLCTGIDEKSMGSCFQLVSAPIDELFPDDAPLISSGFRVIPLDMKTDGTPAGRTLDLASSLEVGSTAQPTGDASMDDCNLRSVLTIAFQFPYEMHLQDSVATMARQYVRSIVSSVQRVSMAISPSRSGLNAGQKIISGFPEAPTLARWICQSYQFHLGVELLRQADDAGEALLKMLWDYEDAILCCSFKEKPVFTFANEMGLNMLETSLVALQDLSLDKIFDEAGRKALYNEIPKLMEQGYVYLPGGVCLSGMGRHVSFEQAVAWKVLGEDNNVHCLAFCFVNWSFV

SEQ ID NO: 21918 - protein, 532 aa, Burkholderia vietnamiensis
MLDANLKNQLKAYLEKITRPIELVASLDDGAKSQELLALLNEIASLTSRVTVIERRDDAERKPSFSIGEPGKPAGIRFAGIPMGHEFTSLVLALLQTGGHPIKLDDDVIEQIRALDGDFAFETYFSLSCQNCPEVVQALNVMALINPRIRHVAIDGALFQDEVDARQIMAVPTMFLNGATFGQGRSSVKEILAKLDTGASARAAKSLENKPVFDTLIVGGGPAGAAAAIYSARKGIATGVVAERFGGQVLDTMAIENFVSVQETEGPKFAAALEQHVKQYDVDIMDVQRAEALIPGDVHQIRLANGAVLKAKTIVLATGARWREINVPGEREYRNRGVAYCPHCDGPLFKGKRVAVVGGGNSGVEAAIDLAGIVKEVTLLEYGAQLRADEVLQRKLRSLPNVTIVTQAQTTELTGDGNKLNALVYKDLQSGETKRIALEGVFVQIGLVPNTEWLKGTVELSKHGEIVVDARGGTSVPGVFAAGDVTTVPFKQIVIAVGEGAKASLGAFDHLIRQDATPVTTAAPQPAEALAA

SEQ ID NO: 21919 - protein, 901 aa, Bradyrhizobium japonicum
MTAIDPKLRTTKTTCPYCGVGCGVLATPDGKGGAAIAGDPDHPANFGRLCSKGSALGETVGLEGRLLYPMIRCKGVLERVAWSDALDHVAHRMQHIAARDGADAVAFYLSGQLLTEDYYVANKLMKGFVGTANVDTNSRLCMSSSVAGHRRAFGADTVPGCYEDLDQADLLVFVGSNAAWCHPVLFQRMLKNRQERGARMIVIDPRRTDTASDVDLFLGLKPGTDTALFSGLFVHFADSGALDQAYIASNTSGFDDALVRARNIAGSVTATALATGLSEQDVATFFKMFRDTPRVVTLYSQGVNQSAQGTDKVNAILNCHLATGRIGKPGASPFSLTGQPNAMGGREVGGLANQLAAHMNFTPPDIDRVRRFWKAPRIATHEGLKAVQLFEAINRGEVKALWVMGTNPAVSLPDADFVREALKKLELFVVSENVLSNDTVEAGPHVLLPALAWGEKSGTVTNSERRISRQRSFLPAPGEARPDWWILSETAKRLGFGDSFDYKSAADIFREHAALSAFENDGSRDFDIGALTSLSNEAFDALKPVQWPVREGGAPGERFFASGGFFTNDGKGRFVAPEVPALRSETGASRPLRLNTGRIRDQWHTMTRTGLSQRLGAHLPEPFVEVHPDDAGKFGIAHDGYARITTDYGQCILKVVVSDRQQRGTLFVPIHWSAMNASHGRVGALVQSFTDPFSGQPESKATPAAIAPYEYVFRGFALSRKQLDLPPNLLWTRVTVNGGFGYLFADNADLSRWPAWLEGVAGEDVAEYRDFGGGVYRAASFAGDRIETCLFVGPAHDAGDWEVVKSLFVADQVTDDQRGMLLSGKSGEGAAATGPIVCACFGVGRGTICDTIASGARTTAEIGATLKAGTNCGSCIPELKRLIATTEVAPVKQVKIAGAAG

SEQ ID NO: 21920 - protein, 494 aa, Persea americana
MDCSSPLSLFHLLLVCTVMVKCCSASDLHYSDALEKSILFFEGQRSGKLPTNQRLTWRGDSGLSDGSSYHVDLVGGYYDAGDNLKFGLPMAFTTTMLAWGIIEFGCLMPEQVENARAALRWSTDYLLKASTATSNSLYVQVGEPNADHRCWERPEDMDTPRNVYKVSTQNPGSDVAAETAAALAAASIVFGDSDSSYSTKLLHTAVKVFEFADQYRGSYSDSLGSVVCPFYCSYSGYNDELLWGASWLHRASQNASYMTYIQSNGHTLGADDDDYSFSWDDKRVGTKVLLSKGFLQDRIEELQLYKVHTDNYICSLIPGTSSFQAQYTPGGLLYKGSASNLQYVTSTAFLLLTYANYLNSSGGHASCGTTTVTAKNLISLAKKQVDYILGQNPAKMSYMVGFGERYPQHVHHRGSSLPSVQVHPNSIPCNAGFQYLYSSPPNPNILVGAILGGPDNRDSFSDDRNNYQQSEPATYINAPLVGALAFFAANPVTE

SEQ ID NO: 21921 - protein, 964 aa, Unknown
  Oceanobacter sp. RED65
MSTRATLTELENRDEFVNRHISNDQSDLQDMLNTVGAESLDDLTQQIVPPSILREPFLEMGEALPEHEALANLRAIANKNKVYKSYIGMGYHDTRLPNVILRNVLENPGWYTAYTPYQPEIAQGRLEALLNYQQMVIDLTGMELANASLLDEATAAAEAMALIKRQVRKNKSNVFFVDELCLPQTIDVLKTRADGFGWELHIGPAETATDVECFGALLQYPAVDGNIDDFEELIAQMHEKNAMVAMATDLMALTLLKSPGELGADVALGNSQRFGVPMGFGGPHAAFFATKDAFKRAIPGRLIGVSIDSNGNRALRMALQTREQHIRREKATSNICTAQVLLSNLASFYAVYHGRDGIKRIANRIHRMTEIMAAAITDADIEDLVIVNQSAFDTLTIEVPNKAEVLARADEAQVNLRTQSQVDFDNVVGFSIGETTSRADLETLYYVITGRRDIDIEMLDQEVESSIPESLKRTSDFLTHPVFNSYQTEHEMLRYMKRLESKDLAMNHSMITLGSCTMKLNATAEMIPVTWPEIGGIHPFAPKEQTPGYEELIQNLDTWLRDITGFDAICMQPNSGAQGEYAGLMAIKHYHESRGEGHRNVCLIPASAHGTNPASAQMAGMRVVLTKCDEQGNIDFDDLKAKAEELSESLSCLMMTYPSTHGVYEDGAKAICELIHEHGGQVYMDGANLNAQVGITSPGYIGADVSHMNLHKTFAIPHGGGGPGMGPIGVAKHLAPFVANHSLRPIEDASKGQSAVSAAPYGSASILPISYMYIHMMGAKGLRKATQMALLNGNYLAKKLGEHYPILYAGQNGRVAHECIVDLRPIKAETGITEVDIAKRLMDYGFHAPTMSFPVAGTFMIEPTESEAKAELDRFIEAMVSIKAEINAVKAGELDETNNPLTNAPHTVKDITGNWDRPYDREQGAFPVAAVYENKFWPSVNRIDDVYGDRNLICSCPAIEEYQD

SEQ ID NO: 21922 - protein, 603 aa, Solanum lycopersicum
MEERNSTRLSSSTNDTVWECVIPYIQESRDRDAVSLVCKRWWQIDAITRKHITMALCYTAKPEQLSRRFPHLESVKLKGKPRAAMFNLIPEDWGGYVTPWVMEITKSFSKLKALHFRRMIVRDSDLELLANRRGRVLQVLKLDKCSGFSTDGLLHISRSCKNLRTLLMEESYIIEKDGEWAHELALNNTVLENLNFYMTDLLQVRAEDLELIARNCKSLVSMKISECEITNLLGFFRAAAALEEFGGGAFNDQPELVVENGYNEHSGKYAALVFPPRLCQLGLTYLGRNEMSILFPIASRLRKLDLLYALLDTAAHCFLLQRCPNLEILETRNVVGDRGLEVLGQYCKRLKRLRIERGADDQEMEDEEGAVTHRGLIDLAKGCLELEYMAVYVSDITNEALEVIGTYLKNLSDFRLVLLDREERITDLPLDNGVRALLRGCHNLRRFALYVRPGGLTDVGLSYVGQYSPNVRWMLLGYVGESDHGLLEFSKGCPSLQKLEVRGCCFSERALALATLQLKSLRYLWVQGYRASSAGRDLLAMARPFWNIELIPARRVIANDGNNAETVVSEHPAHILAYYSLAGQRTDFPDTVKPLDPTYLLAE

SEQ ID NO: 21923 - protein, 206 aa, Zymomonas mobilis
MKARVGYSDFMQRIASIHRQTAETDVHIHLNLDGHGQYNVKTGIGFFDHMLDQLFRHSLIDCDVTVKGDLHIDPHHTIEDCALALGQAVQQALGDKAGITRFSHAYAPMDEALSRVAIDISGRPYLVWHSAFTQPRLGDLDTEMLEHWFLSFAQGAGLTLHVETLYGRNNHHIAESLFKALALALRQAVAIDAGKQGRIPSTKGSL

SEQ ID NO: 21924 - protein, 322 aa, Unknown
  Synechococcus sp. WH 8102
MAIASDITSLIGGTPLVRLNRLPLQSGCGADVIAKLESFNPSASVKDRIASAMVLAAEQEGTIQPGRTVLVEPTSGNTGIALAMVAAARGYRLILTMPDTMSTERRSMLRAYGAELQLTDGAQGMAGAIALANELVEEIPEAYLLQQFDNPANPAVHERTTAEEIWHDCDGHLDALVAGVGTGGTITGCARLLKQRNPQLQVVAVEPAGSAVLSGRPPGAHRIQGIGAGFVPAVLERDLIDEVMTVSDEEAMDVGRRLARQEGLLCGVSSGAAVAAALRLGQRSEWQGRRVLVMLASYGERYLSTPMFSGVASSPARQDPML

SEQ ID NO: 21925 - protein, 568 aa, Haloarcula marismortui
MPQTSSWRRSGRWRNDTRLALLGETPWDKPRPTSFTLDTGVSLRLALLGETPWDKPRPTSFTLDTGVSLRLALLGETPWDKPRPTSFTLDTGVSRVKYDQARWTDDSDDLYEPLLSEKTSKTVDIEDSPLPDDLTRDSLSLPDPAEPELARHYTRLSQMNYGVESGPFPLGSCTMKYNPSFTEDVAARADAAIHPGRPDSTVQGTLALCHRLQDYLGRIGGMDAVTLQPPAGAAGEFTGIQIAKAYHEHNDDERSEVVIPDSAHGTNFATAAMAGYEVVELPSGDDGRVDIEALEAAVGDDTAALMLTNPNTLGLFERDIEHVADIVHDAGGLLYYDGANLNALLGRARPGDMGFDVMHYNVHKTFATPHGGGGPGAGPVGVREELAQFLPNPHVRERGGNYEHYEPANSIGKVHGFYGNWPVLLKTFAYIARLGDEGLRDASAKAVLNANYLAEQIEYEVPFGPFHHEFVASAGEQDAADAAKRMLDYGVHPPTTKWPEIVDEALMTEPTEGETKRSLDQLAAAFNAVAGDSDAELADAPSRPAAKRIDQVTAARNPQLSWQALDDM

SEQ ID NO: 21926 - protein, 171 aa, Zea mays
MQSLQDKASEWSGVAAADAFAIDDVNIFESLGGTPQPFVDLSTNFYTRVYEDEEEWFREIFGGSKKEDAIQNQYEFLIQRMGGPPLFSQRRGHPALIGRHRPFLVTHRAAERWLHHMQQALDATESIDVGSKTKMMNFFRHTAYFLVAGNEMTRQQGHGVACKHATSKPAE

SEQ ID NO: 21927 - protein, 447 aa, Haloarcula marismortui
MSNSNSHATGSPYAPQTAAETAAMLDVVGADDLESLFDVPESVAFDGEFGIDARSERATRREVAGLLSRNADLTEFLGRGHYDHYVPSVVDDLASRSEFLTSYTQYQPEVAQGFLQALFEFQSMLVELTGLDVANCSMYDDATALGEAATLSQRVRSVSGDRILVPEHLREGKRAVLSNYAEGPDLTVESYPMTDGVADVPALADEIGDDTAMVYAESPTVRGVIEERLGAIGDLAHDHDALFCLGSDPIALSLLERPANVGADVVVGDAASLGTGTAYGFGLGMFVTREEYLRQVPGRLVGASEDAADRRAYTLTLQTREQHIRKERATSNICTNQAWVALRTAMHAAWLGPDGLVDLAEDCVTRARDLADRLDDIVGVTAPIHGRHHFREFLAHTDQPASAIVADLAADGFAVHAVDDHLVQVCVTETTTDATDEFVAAFREVAK

SEQ ID NO: 21928 - protein, 112 aa, Unknown
  Synechocystis sp. PCC 6803
MKKVEAIIRPFKLDEVKIALVNAGIVGMTVSEVRGFGRQKGQTERYRGSEYTVEFLQKLKIEIVVDEGQVDMVVDKLVSAARTGEIGDGKIFISPVDSVVRIRTGEKDTEAI

SEQ ID NO: 21929 - protein, 374 aa, Unknown
  Mesorhizobium sp. BNC1
MKADFYETLCVSRNADEKELKSAFRKLAMQYHPDRNPGDMEAEKKFKEINEAYETLRDPQKRAAYDRFGHAAFEQGMGARGGFNGGGFADIFEDIFGDIMGGARQRRSGGRERGADLRYNMEITLEESFTGKTAQIRVPTAVTCDECAGSGARPGSSPVQCPMCHGAGRVRASTGGFFSIERTCPQCQGRGQIIDDPCRKCSGQGRLTEERSLSVNIPAGIEDGTRIRLAGEGEAGLRGGPPGDLYIFLSIKPHEFFQRDGADLYCKVPISMTTAALGGSFEVTTLDGTQTRVKVPEGTQSGRQFRLRGKGMPVLRQPQVGDLYIQVAVETPQNLTRRQRELLEEFEKISSGENSPQSTGFFARMKDFFETFGE

SEQ ID NO: 21930 - protein, 390 aa, Nocardioides aromaticivorans
MRRHYEYLVVGGGVAGGRAVEALSKRADSVALVSAEHWRPYARPPLSKEALVEGRSIEDLCLRDSAWYDDNGAELWLGERVVGLDPTDSVVRLASGSEIGFDRLLLAPGVEPIRLPVPGSELAGVHYLRTYDDAVQLRHAVEVRGRPCRVVVVGGGFIGSELAASLGAMGALVTVVEATSQLMVQALGEEVGALLTRRHRQAGIDVRLDARVERLSGETTVQGVQLADGSELPCDLVVVGIGAKPRLEWLEGSGVELADGIVVDEHCRTSRENVFGAGDATVMYSPRLGRHRRVEHEANAQAQGVVAARNMLGGNAVHDPVDYCWSIQHDLDIWTLGETGRGGEVSVEIGDGGKHALATYRLAGNVVGVVGINRPDDLAPARELLTSLIA

SEQ ID NO: 21931 - protein, 339 aa, Streptococcus agalactiae
MKKQKKARLIYNPTSGQEIMKKNVAEVLDILEGFGYETSAFQTTPTKNSARDEAARAAQAGFDLIVAAGGDGTINEVVNGIAPLKRRPKMAIIPTGTTNDFARALKIPRGNPIEATKLIGKNQIVKMDIGQAQEDNYFINIAAAGSLTELTYSVPSQLKTTFGYLAYLAKGVELLPRVRKVPVKITHDKGEFIGDASMIFVAITNSVGGFEQIAPDAKLDDGKFTLILVKTANLIEIMHLIRLVLAGGKHINDKRVEYIKTSYLTIEPLSDERMMINLDGEYGGDAPITLANLKNHIRFFANTDEISDDALVLDKDELAIEAIAQKFANEVDDLEGLGD

SEQ ID NO: 21932 - protein, 667 aa, Debaryomyces hansenii
MIINDNRLTFLAIHLFITFQITRAELLQTSQSSCLTKSVCNVDSCLLDAGNIFKPQTSLSKIDSLNYTTPSAPKSTQISTSTPPSTSISTSISTVLSTLTSIISTTSAEVISSLPENSVVSSSEDLFTEISKSDSGIITDDLNNAHFEVTSDVNSTNSTNTTEPFIPVQNYTNKNIQLNQSNETIDECHFLSFEEWKRQKAVDNKQINDSQPQAETIANELVPTTSGIDNSTQIPVSLDEDQGKIYKDRFNYASVGCAATIVKTNSHAKGASAILVENKDSYLLNQCSSSQKFVVIELCQDILVDTVVIGNFEFFSSNFRKIRISVSDRFPVGSSGMKVLGEFEAENIRDVQSFNIENPLIWARYLKLEILSHYGDEFYCPISLIRVYGKTMMEEFKMAEGHESFIGGEPEIKNEELVINNSMKDISNFTGINIQNEECRVALPHLGLTEFLKDINSTASDYCDAMYPLINEPETTQTIETKTTQESIYKNIMKRLSLLESNASLSLLYIEEQSKLLSQAFTNLEKRQSSNFESLINSFNDTMHNQISYFKNAYFSIQVEASKLFKAQENNHQSLLEESHHKMTILGNQLKFQKRLSILNTMIIICILSYVVLTRDVYIEDHMYDHFQQPLRTSQNTSGYSNLLDKYKRKNSKRNNRSKRRKPKSTN

SEQ ID NO: 21933 - protein, 112 aa, Fremyella diplosiphon
MKKVEAIIRPFKLDEVKIALVNAGIVGMTVSEVRGFGRQKGQTERYRGSEYTVEFLQKLKVEIVVEDNQVDMVVDKIIAAARTGEIGDGKIFISPVEQVVRIRTGEKNTEAV

SEQ ID NO: 21934 - protein, 766 aa, Streptococcus agalactiae
MDNTVIVHYHSRKKNYFNLSLWQWRDGSEGQDAHFSRFDSFGAVAILKYPLPYFLSHYYVIVKDKNWHHKTIDYRIDCTKGGARKEVWIVDGDDNLYYSRQAAVSSHHYSRRQPHAYDMAINSRAFDKKWGFDGWLGFEYSETKTAFRLWAPTAERVELILYHSTDETASVSKVLSMKRGTAVNYKNHKENTHGVWFTELEGNYNYQAYTYRVYYRRRTFKITRDPYSIATTANGKRSIVIAPEALTPEGFKISHGKEAKWRLENPNQAVIYEMHVRDFSISETSGVKTDYQGKFKGLHQKDTVNQHGDKTTFDYVQDLGVNYIQLQPIFDHHQTFDDDGHYAYNWGYDPENYNVPEASFSSNPHEPATRILELKSAIQAYHDAGIGVIMDVVYNHTFSSTDSAFQLTVPDYYYRMNHNGTFQNGSGCGNETASEKEMCRKYILDSVLYWVKEYNIDGFRFDLMGLHDVETMNIIRNELNKIDPRILVYGEGWDMGAGLTPQNKAKKDNAYQMPGIGFFNDDVRDAVKGAEIYGEFKKGLVSGNSTEDIVAKGILGSDELVSYIDPSQVLNYIEAHDNYNLNDLLWELHPNDNEKQHIYRVEVASAMNLLMQGMAFMQLGQEFLRTKCYPTGDKGQLTQADKERAMNSYNAPDQVNQVNWDNVTFHKSTINFIRKIITLKTNSPYFSYSSFEEIRKHVFVESAQYHSGFISFTVEEHKKIKIIFNIKGKRLQNPFIGDIIISNHEEGKAIDSLDDELSVMIFDITK

SEQ ID NO: 21935 - protein, 490 aa, Aspergillus niger
MVGIGPKRPPSRKGSMADVPQNLLQQIKDFEDQFTVDRSKLKQIVNHFVKELEKGLSVEGGNIPMNVTWVLGFPDGDEQGTFLALDMGGTNLRVCEITLTQEKGAFDITQSKYRMPEELKTGTAEELWEYIADCLQQFIESHHENEKISKLPLGFTFSYPATQDYIDHGVLQRWTKGFDIDGVEGHDVVPPLEAILQKRGLPIKVAALINDTTGTLIASSYTDSDMKIGCIFGTGVNAAYMENAGSIPKLAHMNLPADMPVAINCEYGAFDNEHIVLPLTKYDHIIDRDSPRPGQQAFEKMTAGLYLGEIFRLALMDLVENRPGLIFNGQDTTKLRKPYILDASFLAAIEEDPYENLEETEELMERELNIKATPAELEMIRRLAELIGTRAARLSACGVAAICTKKKIDSCHVGADGSVFTKYPHFKARGAKALREILDWAPEEQDKVTIMAAEDGSGVGAALIAALTLKRVKAGNLAGIRNMADMKTLL

SEQ ID NO: 21936 - protein, 379 aa, Streptococcus agalactiae
MKNEMLALILAGGQGTRLGKLTQSIAKPAVQFGGRYRIIDFALSNCANSGINNVGVITQYQPLELNTHIGNGSSWGLDGIDSGVTVLQPYSATEGNRWFQGTSHAIYQNIDYIDRINPEYVLILSGDHIYKMDYDDMLQTHKDNLASLTVAVLDVPLKEASRFGIMNTDSNDRIVEFEEKPEHPKSTKASMGIYIFDWKRLRTVLIDGEKNGIDMSDFGKNVIPAYLESGERVYTYNFDGYWKDVGTIESLWEANMEYIGEDNKLHSRDRSWKIYSKNLIAPPNFMTEDANVKDSLVVDGCFVAGNVEHSILSTNVQVKPNAIIKDSFVMSGATIGEGAKINRAIIGEDAVIGDGVVIDGSKEVEVIGYKEVVGVPNED

SEQ ID NO: 21937 - protein, 112 aa, Unknown
  Bradyrhizobium sp. BTAi1
MKIVMAIIKPFKLEEVRDALTAIGVHGLTVTEVKGYGRQKGHTEIYRGAEYAVSFLPKIKIEVAIPSDQVDKTIDAISSAAKTGQIGDGKIFVISLDHAVRIRTGEADAAAL

SEQ ID NO: 21938 - protein, 112 aa, Unknown
  Bradyrhizobium sp. BTAi1
MKLVVAIIKPFKLDEVRQALTAIGVHGMTVTEVKGYGRQKGHTEIYRGAEYIVNFLPKLRIEIAVNSDIADKAVEVITTHARTGQIGDGKIFVTPIDHARRIRTGETDSDAL

SEQ ID NO: 21939 - protein, 112 aa, Unknown
  Marinobacter sp. ELB17
MKLITAIIKPFKLDDVREALSEIGVQGVTVTEVKGFGRQKGHTELYRGAEYVVDFLPKVKVEVAIGDDLMDQVIESITKAANTGKIGDGKIFVTELQQAIRIRTGETGEEAV

SEQ ID NO: 21940 - protein, 207 aa, Zea mays
MEADAAAKRTRESGEDATAAGISAVIPGWFSEISPMWPGEAHSLKVEKVLFQGKSDYQNVMVFQSSTYGKVLVLDGVIQVTERDECAYQEMITHLPLCSIKDPKKVLVIGGGDGGVLREVSRHSSVEQIDICEIDKMVVDVSKQFFPHLAVGFEDPRVSLHIGDGVAFLKNAPEGPAQELFEKPFFQLVARALRPGGVVCTQAESIW

SEQ ID NO: 21941 - protein, 432 aa, Lactobacillus sakei
MVKKISIIDAKDHVDEEVKIGVWLTDKRSSGKISFLQLRDGSAFFQGVVVKSQVSEEVFQLAKDVKQESSMWITGVIHEDTRSHFGYEIEVSNIELIGDSSEYPITPKEHGIEFLLDHRHLWLRSKRPFAIMKIRNEIIRATYEFFNQEGFMKMDPPILTGSAPEGTTELFHIEYFDNDAYLTQSGQLYAEAGAMAFGKVFTFGPVFRAEKSKTRRHLTEFWMIEPEMAFMEQDESLEVQEKYVAYLVQNVIDHCAYELKLLDRDIDQLKKYTQTPYPRISYDKAVEMLQAADFDIKWGDDFGAPDETYLSDQFEQPVFILNYPKAIKPFYMKPHPTRDDVYLCADLLAPEGYGEIIGGSERETDFDKLEAEIKSMGLDIEEYQWYLDLRRYGSVPHSGFGLGLERAITWICGIDHLREAIPFPRMINRIKP

SEQ ID NO: 21942 - protein, 492 aa, Solibacter usitatus
MTRPPLLDPSTEAGPIQRHSALLINPFYPKDPNASFGKHVLTPTLALTSFAATTPANWEVHYCDENLLGGRPPFRPMPQVVGITVHLTFAQRAFELAAWYRSRGSKVIMGGLHVLSCPEECAPHGDALAIGDGVQLWPRILEDVEGGTLKPRYLATYENDYRSDPAPRRSILPRRSFLTTTSLIATRGCHNRCEFCYLATDGLRMPYRMRDPAQVAAEFAADDQPYAVFTDNNLGSNREYLKALCNALKPLNKIWSAAVSIDVTDDPGLIRSMALAGCTGVFVGFESLTDENLTEARKKTPRTADYARRVRILHDNGIQVNSSFVLGFDHDRKDVFARTAEWVEENRLECSTFHILTPYPATPLFQQMAAQGRLLHRDWSLYDTAHAVFRPKHMSADELEEGYAWIYQRLFSHASIWRRRPEDRRAVAPYLAMSYLYKRSNRFWHLLIKHRLVHRVWRPLVELTRMRHVRFRRTLEGAAVRAPGVNVVSAGV

SEQ ID NO: 21943 - protein, 322 aa, Unknown
  Bradyrhizobium sp. BTAi1
METAAATPRPGRGRVFDSIVDAFGNTPIVRLRKLPEQHGVKATILAKLEYFNPAASVKDRIGVGMILAMEQAGVIKPDTVLIEPTSGNTGIALAFVAAARGYKLKLVMPESMSIERRKMLAFLGAEIVLTPAAQGMKGAIAAAEELLRTTPNSVMPQQFKNLANPEIHRRTTAEEIWNDTAGNIDVFVAGVGTGGTITGVGQVLKSRKPGLKVVAVEPEESPVLSGGQHSPHKIQGIGAGFVPDILDRSVIDEIVKINSTTAIETSRALARNEGIPGGISSGAAIAAAIELGKRPENAGKTILAIVPSFSERYLSTALFEGI

SEQ ID NO: 21944 - protein, 327 aa, Arabidopsis thaliana
  misc_feature (273)..(273): Xaa can be any naturally occurring amino acid
  misc_feature (288)..(288): Xaa can be any naturally occurring amino acid
  misc_feature (320)..(320): Xaa can be any naturally occurring amino acid
MASRIAKDVTELIGNTPLVYLNNVAEGCVGRVAAKLEMMEPCSSVKDSCRIGFSMISDAEKKGLIKPGESVLIEPTSGNTGVGLAFTAAAKGYKLIITMPASMSTERRIILLAFGVELVLTDPAKGMKGAIAKAEEILAKTPNGYMLQQFENPANPKIHYETTGPEIWKGTGGKIDGFVSGIGTGGTITGAGKYLKEQNANVKLYGVEPVESAILSGGKPGPHKIQGIGAGFIPSVLNVDLIDEVVQVSSDESIDMARQLALKEGLLVGISSXGAAAAAAIKLAQRPXENAGKLFVAIFPSFGERYLSTVLFDATRKEAXEAMTFEA

SEQ ID NO: 21945 - protein, 424 aa, Arabidopsis thaliana
MENMFRLMGSEDSSDRRRCIWVNGPVIVGAGPSGLATAACLREEGVPFVVLERADCIASLWQKRTYDRIKLHLPKKVCQLPKMPFPEDYPEYPTKRQFIEYLESYANKFEITPQFNECVQSARYDETSGLWRIKTTSSSSSGSEMEYICRWLVVATGENAEKVVPEIDGLTTEFEGEVIHSCEYKSGEKYRGKSVLVVGCGNSGMEVSLDLANHNANASMVVRSSVHVLPREILGKSSFEISMMLMKWFPLWLVDKILLILAWLILGNLTKYGLKRPTMGPMELKIVSGKTPVLDIGAMEKIKSGEVEIVPGIKRFSRSHVELVDGQRLDLDAVVLATGYRSNVPSWLQENDLFSKNGFPKSPFPNAWKGKSGLYAAGFTRKGLAGASADAVNIAQDIGNVWREETKRQKMRTRVGHRRCISVA

SEQ ID NO: 21946 - protein, 219 aa, Unknown
  uncultured bacterium
NSRLCMSSAVAGYTRSLGSDGPPCSYEDLDLCTVAFLIGTNTAECHPVLFQRLLKRKKRHPGSVTIVVIDPRQTDTAKAADIHLAVAPGSDLALLHGIAHLVMRENGQDPTFIDNCTDNYDSFFDVVARWTPRRVALFCGIPEKRLREVAQLVHRREKVLSLWSMGVNQRREGTAVVGGIINLHLLTGQIGKEGAGPFSLTGQPNAMGGREAGGLSHLL

SEQ ID NO: 21947 - protein, 164 aa, Mycoplasma penetrans
MFKMSDFYKFKVNKINGKEIELSEYKNKVVLVVNVASKCGFVKQYENLENMYQKYKDQGLVILGFPCNQFFFQEPKTNQEILSFCTTKYNVTFDMFEKINVNGKEANPLYTWLKEQMPWTARAKNVKWNFEKFLLDKNGNVKYRFESKKIPEEFEQEVVNLINE

SEQ ID NO: 21948 - protein, 219 aa, Unknown
  uncultured bacterium
NSRLCMSSAVAGYTRSLGSDGPPCSYEDLDHCAVAFLIGTNTAECHPVLFQRLLKRKKRHPGSVTIVVIDPRQTDTAKAADIHLAVAPGSDLALLHGIAHLVMRENGQDPTFIDNCTDNYDSFFDVVARWTPRRVALFCGIPEKRLREVAQLFHRREKVLSLWSMGVNQRREGTAVVGGIINLHLLTGQIGKEGAGPFSLTGQPNAMGGREAGGLSHLL

SEQ ID NO: 21949 - protein, 417 aa, Oryza sativa
MSSGGGRPPAAQHIVRSVRQRFVPLPPPLARAPFAAAPGDYHRFAAASRGGEIDEGIVIRRTPLKRKTPCGESEAAESSERMMTSPGFTEGVGSPLMTPVSGKSSRTTKSMAKFNKAGPQTPISNAGSPGNPSTPASSRYDNSLGLLTRKFINLLKQAQDGILDLNDAAKILDVRKRRIYDITNVLEGTGLIEKKLKNRIRWRGSDDSGTNLDSDISCLKTEVENLYIQEQALDRSISEIREKMEELTEDESNHRWLFVTEDDINGLPCFQNEALIAIKGPRGTTVEVPDPDEAGDYLQRRYRILLRSTMGPIDIYLVSQYKKMEELGETATPPRHASVVEPPSIATEAGHSSKQTMPLNVQQDIQETPELNASRAFGRMKKITPSDVDTDADYWLLTDDDISITHMWTTACILDEI

SEQ ID NO: 21950 - protein, 273 aa, Triticum aestivum
  misc_feature (207)..(207): Xaa can be any naturally occurring amino acid
AYLGDTLEQVCTKKQAATGPEFPGYRRPTRPVLEKAAGPAAGGGTGAGLGLDAQSMETLARWIPGWGLDAATLPLAVDLNRATDSETKAARTLTRDEGFDFRAAHWGELHRRLHEALPAAATVHWGHQFLSFEVSDLDDGGGIRGGVVATARLLGTGETVEVAGDLLVAADGCTSSIRRRFLPDLKLKYSGYCRWRGVFDFTGKESXASSPGSRRPYPKLGKLPCTSNLTEKDSRPCSYEVARGNTGSNWVVGKFNRPQKPRSFLGGRLAGNQ

SEQ ID NO: 21951 - protein, 389 aa, Shewanella oneidensis
MEKAIRNFLSQESAGGILLLIAVAFAMLMANSPLAGFYQGFLGTEVQVRVGALDLHKPLLLWINDGLMALFFLLIGLEVKRELLEGALSSVAQASLPTFAAIGGMLVPAGIYLLFNYGDPITQAGWAIPAATDIAFALGIMALLGSRVPVALKVFLLALAIIDDLGVIVIIALFYSSDLSTVSLIIASIAIVGLVALNRKGVTSLAPYGVLGLILWVAVLKSGVHATLAGVIIAFCIPLRAKDGSSPSEHLEHSLHPWSTFLILPVFAFANAGVALGNMSLDTLMSPVPVGIALGLMLGKPIGVMLFSFVAVKLKLAQLPDGIGWKQIAPVAAMCGIGFTMSMFIASLAFEQADPMFGDLARLGTLMGSIFAALIGYFWLSKVLPKKGV

SEQ ID NO: 21952 - protein, 563 aa, Oryza sativa
TCVVMASAPPVQEEPLQPGTNHFRSLLAAAVRSISWSYAIFWSISTSCPGVLTWNDGFYNGVVKTRKISNSADLTAGQLVVQRSEQLRELYYSLLSGECDHRARRPIAALSPEDLADTEWYYVVCMTYSFQPGQGLPGKSYASNASVWLRNAQSADSKTFLRSLLAKSASIQTIICIPFTSGVLELGTTDPVLEDPKLVNRIVAYFQELQFPICLEVLMSTSPSPNETEDADIVSEGLITHNAIEEGQMVVSDECVSNANRDPITMEIDELYSIYEDLDLDMDLDLDTVRFLEDNGWPVNPSSFQLVPASSTEAVAAAAAANDVDGVANSQVSCFMAWKSAKSNEMAVPVVTGIESQKLLKKVVDCGARMSTGRGSRAALTQESGIKNHVISERRRREKLNEMFLILKSIVPSIHKVDKASILEETIAYLKVLEKRVKELESSSEPSHQRATETGQQRRCEITGKELVSEIGVSGGGDAGREHHHVNVTVTDKVVLLEVQCRWKELVMTRVFDAIKSLCLDVLSVQASAPDGLLGLKIQAKFACSGSVAPGMISEALQKAIGG

SEQ ID NO: 21953 - protein, 219 aa, Unknown
  uncultured bacterium
NSRLCMSSAVAGYTQSLGSDGPPCCYDDLDHCKVAFLIGTNTAECHPVLFQRLLKRKKRNPGSLKIVVVDPRRTDTAKAADIHLPIAPGSDLALLHGIAHLILRENGQDPAFIDNHTENYEAFFDVVARWTPRRVARFCNLPEKRLREVAQLFHHRETVLSLWSMGVNQRREGTAVVSGLINLHLLTGQIGKEGAGPFSLTGQPNAMGGREAGGLSHLL

SEQ ID NO: 21954 - protein, 206 aa, Mycobacterium smegmatis
MSALANRRARVERKTKESEIVVDLDLDGTGVVDIDTGVPFFDHMLTSLGSHASFDLTVHAKGDIEIEGHHTVEDTAIVLGQALGQALGDKKGIRRFGDAFIPMDESLAHAAVDVSGRPYFVHTGEPESMVSFTIAGTGAPYHTVINRHVFESLAFNARIALHVRTLYGRDPHHITEAQYKAVARALRQAVEYDARVTGVPSTKGTL

SEQ ID NO: 21955 - protein, 329 aa, Oryza sativa
PTPFDPAKGYPAEAMQAIDLFGCAMLSLQIAKHFLRALLAKSASIQTIVCIPFMSGVLELGTTDPVSEDPNLVNRIVAYLKELQFPICLEVPSSTPSPDETEDADTVFDGLIEEDQMVILQGEDELGDVVVAECETNGANPETITMETDEFYSLCEELDLDLGSYQLVPTSARETVAAAAAAANDVDGVAYSHASCFVSWKRANPAEKVVAVPMTAGIESQKLLKKAVGGGTAWMSNIDDRGSVAITTTPGSNIKSHVMSERRRREKLNEMFLILKSLLPSVRKVDKASILAETITYLKVLEKRVKELESSSREPSRWRPTEIGQGKAP

SEQ ID NO: 21956 - protein, 528 aa, Streptococcus thermophilus
MKFTDLNLSEDIQSAVVAAGFEQPSPIQELTIPLALEGKDVIGQAQTGTGKTAAFGLPTLDKIRTEENTIQALVIAPTRELAVQSQEELFRFGRDKGVKVRSVYGGSSIEKQIKALRSGAHIVVGTPGRLLDLIKRKALKLNNIETLILDEADEMLNMGFLEDIEAIISRVPEERQTLLFSATMPDAIKRIGVQFMKDPEHVKIKAKELTNVNVDQYFIRVKEQEKFDTMTRLMDVDQPELSIVFGRTKRRVDELTRGLKLRGFRAEGIHGDLDQNKRLRIIRDFKNGQIDILVATDVAARGLDISGVTHVYNYDIPQDPESYVHRIGRTGRAGQSGQSITFVSPNEMGYLGIIENLTKKRMKGLKPPTAQEAFQSKKKVALKKIERDFADEAIHANFDKFKDDAVKLAQEFTPEELALYILSLTVQDPETMPEVEIAREKPLPFKPSGGGFGGKGGKGGRGNRGRDNNRRGGYRGDRNRDDRDGGRRDFKRKSKNNSRDFENRGNKRPHRASSEKKNGFVIRNKGDK

SEQ ID NO: 21957 - protein, 219 aa, Unknown
  uncultured bacterium
NSRLCMSSAVAGYTRSLGSDGPPCSYEDLDHCIVAFLIGTNTAECHPVLCQRLLKRKKRHPGSVTIVVIDPRQTDTAKAADIHLAVAPGSDLALLHGIAHLVMRENGQDPTFIDNCTDNYDSFFDVVARWTPRRVALFCGIPEKRLREVAQLFHRREKVLSLWSMGVNQRREGTAVVGGIINLHLLTGQIGKEGAGPFSLTGQPNAMGGREAGGLSHLL

SEQ ID NO: 21958 - protein, 390 aa, Glycine max
KERTAELVRKSMASSLGFEFLTKKPYSPPSWASHLHPLPSHFFSLAHLPTPIHRWNLPNLPTNTELWIKRDDLSGMQLSGNKVRKLEFLMADAIAQGADSIITIGGIQSNHCRATAVAAKYLNLDCFLILRTSDLLVDQDPGLTGNLLVERMVGAHVHLISKQEYAKIGSVTLTNVLKEKLIKEGRRPYVIPVGGSNSLGTWGYIEAVREIEQQIQKGTGNVKFDDIVVACGSGGTIAGLSLGSSLSALKARVHAFSVCDDPDYFHNFAQGLLDGLKAGVSSRDIVHIQNAKGLGYAMNTSEELNFVKEVAATTGVVLDPVYSGKAAYAMLKDMSENPKKWERRKILFIHTGGLLGLYDKVDQLASFVGNWQRMDVNESVPRQDGIGKMF

SEQ ID NO: 21959 - protein, 574 aa, Oryza sativa
MEETPLPSGKNFRSQLAAAARSINWTYAIFWSISTSRPGVLTWKDGFYNGEIKTRKITNSMNLMADELVLQRSEQLRELYDSLLSGECGHRARRPVAALLPEDLGDTEWYYVVCMTYAFGPRQGLPGKSFASNEFVWLTNAQSADRKLFHRALIAKSASIKTIVCVPFIMHGVLELGTTDPISEDPALVDRIAASFWDTPPRAAFSSEAGDADIVVFEDLDHGNAAVEATTTTVPGEPHAVAGGEVAECEPNSDNDLEQITMDDIGELYSLCEELDVVRPLDDDSSSWAVADPWSSFQLVPTSSPAPDQAPAAEATDVDDVVVAALDSSSIDGSCRPSPSSFVAWKRTADSDEVQAVPLISGEPPQKLLKKAVAGAGAWMNNGDSSAAAMTTQGSSIKNHVMSERRRREKLNEMFLILKSVVPSIHRVDKASILAETIAYLKELEKRVEELESSSQPSPCPLETRSRRKCREITGKKVSAGAKRKAPAPEVASDDDTDGERRHCVSNVNVTIMDNKEVLLELQCQWKELLMTRVFDAIKGVSLDVLSVQASTSDGLLGLKIQAKFASSAAVEPG

SEQ ID NO: 21960 - protein, 271 aa, Unknown
  uncultured bacterium
NSRLCMSSAVAGYTQSLGSDGPPCCYDDLDHCNVAFLIGTNTAECHPVLFQRLLKRKKRNPGSLKIVVVDPRRTDTAKAADIHLPIAPGSDLALLHGIAHLILRENGQDPTFIDEHTENYEAFFDVVARWTPRRVARFCNLPEKRLREVAQLFHHRETVLSLWSMGVSQRREGTAVVSGLINLHLLTGQIGKEGAGPFSLTGQPNAMGGREAGGLSHLLPGYRLVANDQHRQVVEQAWNLPAGSIAAKPGLAAWQQIEAMERGELDLWWVA

SEQ ID NO: 21961 - protein, 130 aa, Persea americana
ASCGSTTVTAKNLISLAKKQVDYILGENPAKMSYMVGFGERYPQHVHHRGSSLPSVHAHPNPIPCNAGFQYLYSSSPNPNILVGAILGGPDSRDSFSDDRNNYQQSEPATYINAPLVGALAFFAANPVAN

SEQ ID NO: 21962 - protein, 418 aa, Haloarcula marismortui
MSPEVNPFESLQEQIDDASDYLEYSTDVLERLKHPERVLETNLSVEMDDGSVEVFRAYRSQFNGDRGPYKGGIRYHPQVTRDEVKALSGWMVYKCAAVNIPYGGGKGGIEIDPRQYSASEIERITRSFAKELRLIIGEDRDIPAPDVNTGQREMNWIKDTYETLENTTEPGVITGKAPESGGSAGRVEATGRSVMLTAREAFDYLGKDIEDATVAVQGYGNAGSVAAKLIEDLGANIVAVSDSSGAVYNPDGLGARDAKAFKSETGSLAGYEGATEELTNEELLTMDVDLLVPAALENAIDGDLARDVQADIVVEAANGPLTPNADDVFTERDVAVFPDILANAGGVTVSYFEWVQNRQRFYWSEERVNDELETIITNAFDDLVETYEETGAPNFRTAMYVVAIQRVVAAAEEGGIWP

SEQ ID NO: 21963 - protein, 322 aa, Vibrio vulnificus
MSMIKKIGVLTSGGDAPGMNAAIRGVVRTALGAGLEVYGIYDGYLGLYEGRIKQLDRSSVSDVINRGGTFLGSARFPEFKEVAVREKAIENLKAHGIDALVVIGGDGSYMGAKKLTEMGYPCIGLPGTIDNDIAGTDYTIGYLTALNTVIESIDRLRDTSSSHQRISIVEIMGRHCGDLTLMSAIAGGCEYIITPETGLDKEKLIGNIQDGISKGKKHAIIALTELMMDANELAKEIEAGTGRETRATVLGHIQRGGRPTAFDRVLASRMGNYAVHLLMEGHGGRCVGIVKEQLVHHDIIDAIENMKRPVRNDLFKVAEELF

SEQ ID NO: 21964 - protein, 936 aa, Triticum aestivum
  misc_feature (212)..(212): Xaa can be any naturally occurring amino acid
  misc_feature (229)..(229): Xaa can be any naturally occurring amino acid
  misc_feature (244)..(244): Xaa can be any naturally occurring amino acid
YNKFVQKSRLVPARNSRDIVDPRVRGGGGHDEPPQRPKQQLPRDSRGSLEVFNPSSAAAFRPAASPFRQDDDDNIDDVDRATQRAAEWGLVLQTNEHTGRPQGVSARSSGGGSARSSSDDKAVAGAGIPRVSEELRAALSAFQQTFVVSDASRPGHPIMYASAGFFNMTGYTSKEVVGRNCRFLQGSGTDPAEIAKIRQALADGSNYCGRVXLNYKKDGTAFWNLLTIXAPIKDEDGRVLKFIXGMQVEVSKYTEGNQDTGVRPNGLPESLIKYDARQKDQARSSVSELLLALKNPRSLSESSNSTFKRKSQESVGVLTGDGTGHASAESGSRRTSRTGARSSLQKISEVPEGGNKTRKSGLFSLMGLLGMGHGNVEKNMLKPRDEDPLLDSDDERPESFDDELRRKEIRRGIDLATTLERIEKNFVITDPRLPDNPIIFASDSFLQLTEYSREEILGRNCRFLQGPETDRATVRKIRDAIDNQTEVTVQLINYTKSGKKFWNLFHLQPMRDQKGDVQYFIGVQLDGTERPRDASEKEGVMLIKKTAENIDEAAKELPDANLRPEDLWANHSKVVLPKPHMKDSASWRAVQKVREGGENIDLKHFRPVKPLGSGDTGSVHLVELLNTGEYFAMKAMDKNVMLNRNKVHRATAERQILDMLDHPFLPTLYASFQTKTHICLITDYYPGGELFLLLDRQPQKVLREDAVRFYAAEVVIALEYLHCQGIIYRDLKPENILLHRDGHISLTDFDLSCLTSCRPQVFLPEEGNKKSRRKSRSSPIFFAEPMRASNSFVGTEEYIAPEIITGAGHTSAVDWWALGILLYEMLYGYTPFRGKTRQRTFANILHKDIRFPASISVSLPARQLIYRLLHRDPANRMGSYEGSNEIKQHPFFRGINWALVHGTAPPKMDAPLLSDDVDKGMGDAAAAAADNHTDMF

SEQ ID NO: 21965 - protein, 206 aa, Unknown
  Oceanobacter sp. RED65
MGKQDMISREQALPGREEKMPVVNKHQVFGRSMVGPWPTHAKKAYFAMGCFWGAERLFWQQEGVYCTAVGYMGGYTPNPTYQEVCSGDTGHTETVMVVYNQEVTDYWTLLESFWENHDPTQGMRQGNDTGTQYRSAIFWEDDMQKVLAERSRNLYQDELKKAGIGEITTEINKAREFYFAEDEHQQYLHKVPNGYCGLKGTGVTCV

SEQ ID NO: 21966 - protein, 329 aa, Unknown
  Pseudomonas sp. ATCC19151
MICNERMVIYRGAGQRVAALEDFCPHRGAPLSLGSIQDGKLVCGYHGLVMDCDGRTASMPAQRVQAFPCIRAFPAQERHGFIWVWPGDAALADPALIPHLEWAENPAWAYGGGLYHIACDYRLMIDNLMDLTHETYVHASSIGQKEIDEAPVSTRVEGDRLITGRFMEGILAPPFWRAALRGNGLADDVPVDRWQICRFTPPSHVLIEVGVAHAGRGGYDAPADCKASSIVVDFITPETDTSIWYFWGMARSFRPEDNELTARIREGQGTIFAEDLEMLEQQQRNLLAWPERPLLKLNIDAGGVQSRRIIERLVSAERAAEAQLIGRQA

SEQ ID NO: 21967 - protein, 338 aa, Pseudomonas syringae
MNLSKFKRYPLTFGPSPITPLKRLSEHLGGKVELYAKREDCNSGLAFGGNKTRKLEYLVPEAIDGGYDTLVSIGGIQSNQTRQVAAVAAHLGMKCVLVQENWVNYSDALYDRVGNIEMSRIMGADVRLDSAGFDIGIRPSWEKAMSDVEESGGKPFPIPAGCSEHPYGGLGFVRFADEVRQQEEELGFKFDYIVVCSVTGSTHAGMLVGFAADGRAQRVIGIDASAKPEKTRAQVLRIAQNTAKLVELGREITAEDVVLDTRYAYPEYGLPNEGTLEAIRLCARLEGVLTDPVYEGKSMHGMIDMVRNGEFPEGSKVLYAHLGGVPALNAYSFLFKDG

SEQ ID NO: 21968 - protein, 146 aa, Unknown
  Magnetococcus sp. MC-1
MRFLHTMVRVADLEASLHFYRDLLGLVETQRKESQAGRFTLVYLAAPEDLERAKGEQAPEIELTYNWESECYSGGRNFGHIALLVEDIYAVCARMQQGGVTILRPPRDGHMAFFRSPDGISIELLQKGEALPMQEPWASMVNSGSW

SEQ ID NO: 21969 - protein, 137 aa, Streptomyces coelicolor
MDGVNEIRRGTLQEQTFYEQVGGEETFRRLVHRFYEGVAEDPILRPMYPEEDLGPAEDRFALFLMQYWGGPTTYSDNRGHPRLRMRHAPFAVDRAAHDAWLKHMRVALDELGLSEEHEQTLWKYLTYAAASMINTPG

SEQ ID NO: 21970 - protein, 347 aa, Prosthecochloris aestuarii
MTISAMRDLSMTPATENGLRRKPILRKIGVFTSGGDAPGMNAAIRAVTRAAIANKLKVTGIRRGYQGMIEGDFIPLRSSDVSGIIQLGGTILRTARSKEFRTPEGREKAWQQLQNAGIDAVVVIGGDGSFTGALTMSQEYNISFVGIPGTIDNDIYGTDYTIGYETALNSVVCAVDKIRDTAVSHGRIFMVEVMGREAGLLALNSGIACGAEVILIPESKEQHDALKRFLDKGYKRKERSGIVIVAEGDEPGGALKLAENVRCEHPELDVRVSILGHIQRGGSPTANDRINATRMGVAAVDALLDDQKSIMIGIDNGRIVQVPFNKAVKLNHSFDRELLEIQKMLNI

SEQ ID NO: 21971 - protein, 163 aa, Unknown
  Chlamydomonas sp. W80
MASPFYALAATDIAGKEFPFAQLQGKVVLVVNVASQCGFTPQYKGLQELYDKYKDEGLVIIGFPCDQFGHQEPGQESEIASFCQKNFGVTFPMMAKIEVNGDNTHPVYQFLKSEKKQLFMERIKWNFEKFLINKQGEVVERFSSAGDPMRNIAPAVAKLLAEA

SEQ ID NO: 21972 - protein, 120 aa, Glycine max
  misc_feature (37)..(37): Xaa can be any naturally occurring amino acid
  misc_feature (63)..(63): Xaa can be any naturally occurring amino acid
  misc_feature (97)..(97): Xaa can be any naturally occurring amino acid
AISMIFTPAATTVNRAGAGMVAPFTGLKSMDGFPTKXTNNDITSIASNGGRVQCVHVWPSVGXKKSETLYYLPYLDDAQLAKEVEYLLTKGWIPCLXLQWEHGYLYRDHNRSPRYYRWTL

SEQ ID NO: 21973 - protein, 128 aa, Thermus thermophilus
MPMKALALIAHDAKKDEMVAFCLRHKDVLARYPLLATGTTGARIQEATGLAVERVLSGPLGGDLQIGARVAEGKVLAVVFLQDPLTAKPHEPDVQALMRVCNVHGVPLATNLVAAEALIAWIRKGTPQ

SEQ ID NO: 21974 - protein, 521 aa, Arabidopsis thaliana
MIKQSNKKKKNHKNSRIIIEVEDFPGGSDGFDLVLRFCYGGGISIDVSNVSILHCSSVFLEMTEKLCSSNLLLRTEKFLEGMFYWSWNDIVLCLKSCEQVFLHADSYGLVDKLVFGVLAKIPQNSDVSHVFSSSSPSSSASASASSQSPETAMIRSYSDKRSTSRSFSCRTSNEWWFDDMSILGPKIIEKLINTLGAHDKNNDSLVLTKFLLHYLKTKVPNKSTNKLEYSGLADTAVQGVVFAAKTAFSCRKMFWVLRVLSGFSISKESRIGLERVIGEMLDQATLDDLLIPAGGKGEKGVYDVDLVIRLLKVFVRIGNTEEGDQNLRMRRIGKLIDKYLREISPDQNLKVSKFLEVAESLPDSARDWFDGLYRAINIYLESHPKLSSEDRTKLCRCLNYKKLTLDTCKQLAKNPKIPPNIAVQALKSQQLSNETRPHSREDKNKVNKIWNSRKYLEEKPILVCLKGFDMSEKFEDDLMMNLERKQWNNSEKVSKEKKSEVMSRSVRHGHTHSSSSFPRLC

SEQ ID NO: 21975 - protein, 376 aa, Listeria innocua
MAKRDYYEVLGISKSASADEIKKAYRKLSKQYHPDINKEAGADEKFKEISEAYEALSDPQKRAQYDQYGHVDPNQGFGGGAGGGFGGGGFSGFEDIFDTFFGGGGRQQDPNAPRQGSDLQYTMRLKFKEAIFGKDAEIEIPREENCDTCHGSGAKPGTTPEKCSHCGGKGSINVEQNTPFGRVVNKRTCQYCNGTGKEIKEKCPTCHGKGRVTKTKKIKVKVPAGVNDGQQMRVSGEGEAGINGGPNGDLYVVFVVIPDEFFEREADDIYVEVPITFVQATLGDEIDVPTVHGKVRLKIPSGTQTGTTFRLRGKGVPHLRGNGTGDQHVIVKVIVPKKLDDKQKEILREFASTTGDKVDEQTSGFFDKMKRAFKGD

SEQ ID NO: 21976 - protein, 271 aa, Unknown
  uncultured bacterium
NSRLCMSSAVAGYARSLGSDGPPCCYDDLDHCSVAFLIGTNTAECHPVLFQRLLKRKKRNPGSLKIVVVDPRRTDTAKAADIHLPIAPGSNLALLHGIAHLILRENGQDPAFIDNHTENYEAFFDVVARWTPRRVARFCNLPEKRLREVAQLFHHRETVLSLWSMGVNQRREGTAVVSGLINLHLLTGQIGKEGAGPFSLTGQPNAMGGREAGGLSHLLPGYRLVTNDQHRQDVEQAWKFPAGSIAATPGLAAWQQIEAMERCEIDLWWVA

SEQ ID NO: 21977 - protein, 196 aa, Triticum aestivum
MAAKAVQWPVMVVVVMMGAAVASVGADMDADRSECAEQLVGLAPCLQYVQGQARSPAPDCCGGLSQVLDKSPKCLCVLVKDKDDPNLGIKINASLALALPSACGNTKANVSHCPQLLHLPPNSKDAAIFSPGGDKGTAAAPAKDNTASTANSRAQQAASAGTASSTATAGVALAALLAGYLALLLPADFLATAATF

SEQ ID NO: 21978 - protein, 443 aa, Coprinopsis cinerea
MRIIVEAFKDALETGLEKHDQELPMIPTYVFGWPSGNERGEFVAIDLGGTNLRVCLLNLQGDGKFEITQSKYRLSEEQKQDDGQKLFDFCAESLQTFIEGNSGEDGILQLAPGQKLPLGFTFSYPCKQEKIDHGVLMRWTKGFVAPNTEGHDVAEMFRKSLEKYNLPVELKALINDTTGTLIASRYVNPSTKIACIFGTGCNAAYMERVKDIGKIKYLGIDDDVEMVINCEWGAFDSHNHEHLPRTKYDISIDESSSKPGQQTFEKLISGRYLGEIVRLIICELIDEGVLFLGQNTYKLEVPWAFDTALLSLMESDPTDELLMIIGIFSHFFALETTLAERQFLRAIARLVGRRAARLSACGIAAIVSKMGYLDEGCSVGADGSLYNKYPGFAERIHEGLVDIFGERGRNIVTHHAEDGSGVGSAIIAAMTKQRKDAGIYPDL

SEQ ID NO: 21979 - protein, 239 aa, Unknown
  Malus x domestica
DWRDFLPYLRWVPNKTIENKIQRLYHRRKAVMNALIKEQKKRIASGEELNCYIDYLLSEAKTLTPEQIVMLLWETIIETADTTLVTTEWAMYELAKDQKRQDRLFEEIQNVCGTNKINEEHLSQMPYLGAVFHETLRKHSPAPIVPLRYVHEDTQLGGYYVPAGTEIAINIYGCNMDKNQWESPEEWKPERFLEPKYDPIDLYKTMAFGAGKRVCAGSLQAMLIACTTIGRLVQEFEWK

SEQ ID NO: 21980 - protein, 271 aa, Unknown
  uncultured bacterium
NSRLCMSSAVAGYTRSLGSDGPPCSYEDLDHCTVAFLIGTNTAECHPVLFQRLLKRKKKHPGSVTIVVVDPRQTDTAKAADTHLAVAPGSDLALLHGIAHLVMRENGQDPTFIDDCTDNYDSFFDVVARWTPRRVALFCGIPEKRLREVAQLFHRREKVLSLWSMGVNQRREGTAVVGGIINLHLLTGQIGKEGAGPFSLTGQPNAMGGREAGGLSHLLPGYRQVTNPAHRAEVEQTWGFPQGKIAPEPGLTAWQQVEAMERGELDLWWVA

SEQ ID NO: 21981 - protein, 271 aa, Unknown
  uncultured bacterium
NSRLCMSSAVAGYTQSLGSDGPPCCYDDLDHCKVAFLIGTNTAECHPVLFQRLLKRKKRNPGSLKIVVVDPRRTDTAKAADIHLPIAPGSDLALLHGIAHLILRENGQDPTFIDEHTENYEAFFDVVARWTPRRVARFCNLPEKRLREVAQLFHHRETVLSLWSMGVNQRREGTAVVSGLINLHLLTGQIGKEGAGPFSLTGQPNAMGGREAGGLSHLLPGYRLVANDQHRQVVEQAWNLPAGSIAAKPGLAAWQQIEAMERGELDLWWVA

SEQ ID NO: 21982 - protein, 459 aa, Rhodopseudomonas palustris
MSIQVADSSLVARLSPPKPSALAHVPGDEGWPIIGRTLAVLADPKGEVEKMARTYGPVYRSRVLGETSITLLGPEANELVLFDNTKLFSSTHGWGPILGRLFPRGLMMLDFDEHRLHRRTLSVAFKAGPMQSYLAELNAGIAHRVAEWRARPGEMLCYPAMKQLTLDLAATSFLGTAIGAETEEVNRAFIDMVAASVAPIRKPWPGTAMARGVKGRQRIVAYFAEQIPIRRAKGGDDLFSQLCRATHDDGALLSNQAIIDHMSFLMMAAHDTLTSSLTSFVAALAAHPEWQQKLREEIAGLGLKPGEPISFEQLDALPLTEMAFKEAMRLRPPVPSLPRRATRAFSFKGYTIPAGTMVAVNPLFTHHMPEIWPNPDQFDPLRFTDEASRGRHRFAWIPYGGGAHMCLGLNFAYMQAKCFAVHLLQHLDLSLPPNYQASWQMWPIPKPKDGLRVNVAPLN

SEQ ID NO: 21983 - protein, 271 aa, Unknown
  uncultured bacterium
NSRLCMSSAVAGYTQSLGSDGPPCCYDDLDHCKVAFLIGTNTAECHPVLFQRLLKRKKRNPGSVAIVVVDPRRTDTAKAADIHLPIAPGSDLALLHGIAHLVLRENGQDPTFIDDHTENYEAFFDVVARWTPRRVARFCNLPEKRLREVAQLFHRRENVLSLWSMGVNQRQEGTAVVCGLINLHLLTGQIGKEGAGPFSLTGQPNAMGGREAGGLSHLLPGYRLVANDQHRQDVEQAWKFPAGSIAATPGLAAWQQIEAMERGEIDLWWVA

SEQ ID NO: 21984 - protein, 503 aa, Burkholderia vietnamiensis
MKHVSERAPAKAGGAQPRDAERDAMFASHEAGYEQKLKPRHVQMIAMGGAIGTGLFLGAGGRLQSAGPALALVYLVCGAFAFLIMRALGELVMHRPTSGSFVSYAREFMGERASFVAGWMYYLNWATTGIVDITAVAIYMKYWAVFTDVPQWVFALGALGIVSVMNMIGVKVFGEMEFWFSIVKVGTLALFLAVGAVFLASGHPVAGQMPGLHLVADHGGIFPHGILPAVLIVQGVVFAYASIELVGVAAGETADARKVLPKAINSVMWRIALFYVGSVVLLTMLLPWTAYSAHESPFVTFFSKLGVPYVGTVMNVVVLTAALSSLNSGLYSTGRVLRSLAMGGSAPRFVSRMNARGVPYGGILVTVAVNALGVPLNYIVPAQAFEIVLNMASLGIITTWGFIVMCQILFRRAVDRGELSPVSFRMPGAPFTSWLTLGFLVSVLVLMAFDYPGGTWTVAMIPVVVLALVVGWKLAKRGAARDAAAAAAAQAASPIAADPAGSV

SEQ ID NO: 21985 - protein, 458 aa, Prochlorococcus marinus
MENKEKIPNVENVVIIGSGPAGYTAAIYAARANLQPLLVTGFNSGGIPGGQLMTTTFVENYPGFPDGVLGPELMDLMKAQAERWGTNLYESDVVSINTDSHPFELKTLEGTIKSNSIIIATGASANRLGVINEDKFWSKGISACAICDGATPQFRGEELAVIGGGDSACEEAAYLTKYGSKVHLIVRSEKLRASAAMVDRVKANPKIAIHWNTKVEKADGSEWLEKIETIHSQEGKGEINIKGLFYAIGHTPNTKFLGSKIDLDNKGYIACKSGRPETSIEGIFAAGDVVDSEWRQGVTAAGTGCMAALATERWLAEKNLAKTIVRETPEPEKKLNSSDFNEEEVNEDTFDSNSEWQKGSYALRKLYHESKKPILVIFSSPSCGPCHVLKPQLKRVIKELDGAVLGVEIDIDKDQDIAKQAGINGTPTVQLFKEKLLKKQWQGVKQRSEFKEAIKNII

SEQ ID NO: 21986 - protein, 340 aa, Solanum lycopersicum
MEVIMNNHNNGTINTNTKIIHKNGSICNGNGNVNGNSHTHNNENKLVEFTNSIKPGWFSEFSALWPGEAFSLKIEKLLFQGKSDYQDVMLFESATYGKVLTLDGAIQHTENGGFPYTEMIVHLPLGSIPSPKKVLIIGGGIGFTLFEVSRYPSIEKIDIVEIDDVVVDVSRKFFPYLAAGFDDPRVSLIIGDGAAFVKAAQPGYYDAIIVDSSDPIGPAKDLFERPFFEAVAKALRPGGVVCTQAESIWLHMHLIKKIIANCRQVFKGSVNYAWTTVPTYPTGVIGYMLCSTEGPEVNFKNPVNSIDKYVKSKGPLKFYNSDIHKSAFILPSFARDLFES

SEQ ID NO: 21987 - protein, 256 aa, Australopyrum velutinum
ELDNIMRLTGITGIVNGMDVSEWDPTKDKFLPVNYDVTTALEGKALNKEALQAEVGLPVDRKVPLVAFIGRLEEQKGPDVLIAAIPEIVKDEDVQIVLLGTGKKKYERLLKSVEEKFPGKVRAVVRFNAPLAHQMMAGADVLAVTSRFEPCGLIQLQGMRYGTPCACASTGGLVDTIVEGKTGFHMGRLSVDCNVVEPADVKKVATTLKRAVKVVGTPAYHEMVKNCMIQDLSWKGPAKNWEDVLLELGVEGSEPG

SEQ ID NO: 21988 - protein, 112 aa, Ralstonia metallidurans
MKQITAIIKPFKLDEVREAMADVGVTGLTVTEVKGFGRQKGHTELYRGAEYVVDFLPKIKIEVVVAENQLDTVLDAIVKAAHTGKIGDGKIFVTEIERVIRIRTGEQDEAAV

SEQ ID NO: 21989 - protein, 297 aa, Thermoanaerobacter tengcongensis
MILKLEVGVGLKNLNGKWGLDSSKEFYWEPDVEGGYRVYKVKSVIIEHQSLYQKIDIVELETWGKSLFLDGSLQSTESDEFIYHELLVHPAMRVHPSPKRVLICGVGEGKSVREVLKYPTVKEVIGVDIDKEVVALCQKHLGKTPIDDKRVRLVYQDVAEFIKNYRGEPFDVAIVDVTDDLDGPARSVHQLDFYKRLYEILGEKATVVVQGTSAFSKVKNVGFCHIYEILKEVFPFVIPYADYIPSFSDLWTFFVALKGIKDLTPRHEIPRDLKYYDEYTNERIFTLAKPLREKLGV

SEQ ID NO: 21990 - protein, 406 aa, Bradyrhizobium japonicum
MTGGPVIIVGAGHGGYQVAASLRQAGFSDRVCLINDEAHLPYQRPPLSKAYIKGSAGPESLMFRPEKFYADQKIELIAGRAVSIDRAGRRLHLASGEMLDYGHLVLATGARNRLLDLPNANLPDVKYLRILDDSEALRKIMPSRTRVVVIGAGFIGLEFAATARIKGLEVDVLELAPRVMARAVTSEVSAYFQARHREAGIRIHLGVQATSIEAEDGRVTGVSLSDGRHLPADLVVVGVGVLPNIELAAEAGLPVAAGIIVDEYLSTADPDISAIGDCALFASPRFGGSLRLESVQNATDHARCLAARLTGDRKPYDSHPWFWSDQGDDKLQIAGLTTGYDRVVLRGDPAKKAFSAFCYRGDKLVGIESINRAGDHMFGRRLQGMDRSITPEQAADESFDLKSALA

SEQ ID NO: 21991 - protein, 296 aa, Parvularcula bermudensis
MSGRFIIDVDGQRWFKEEVTPEIGHALRIDRTLYEGEIDHQHLIVFENQRFGRLFALEGFVQISTADEFIYHEMLVHVPFFAHGRAKRVLIIGGGDGGAIREVLRHRTVEQVTLVEIEKAVVDFSKEWFPSLSAGAFDDPRLDLRIADGAAFVKEDQEPYDVILVDSTDPVGPGKVLFTEEFYRDCYARLGDEGIMVTQCGLPFLQAPELKTAYENQSASFAAPRFYTIAVPAYSGGLMALGFARKGGEDPSPADLAARIEKADLGTFKVYSAKTHQGAFMGPAYIDTILKTGQFG

SEQ ID NO: 21992 - protein, 344 aa, Calystegia sepium
MEVMAAHNNGFTNHQNGTTTNHQNGTTTNHHNGTANHQNGNGTAHEDGGKDFGCIKPGWFSEFSQMWPGEAFSLKIEKLLFQGKSDYQDVMLFESATYGKVLTLDRAIQHTENGGFPYTEMIVHLPLGSIPNPKKVLIIGGGIGFTLMEVSRYPTIEKIDIVEIDKMVVDVSRQFFPYLGAGFEDPRVTLHIGDGAAFVKDAQKGYYDAVIVDSSDPIGPAKDLFEMPFFEAVAKALRPGGVVCTQAESIWLHMHFIKQIIASCRQVFKGSVNYAWTTVPTYPSGVIGYMLCSTEGPDVDFKNPVNPIDKDTSHVKSKGPLKFYNAEIHKAAFTLPSFVQKLLE

SEQ ID NO: 21993 - protein, 257 aa, Eremopyrum bonaepartis
CELDNIMRLTGITGIVNGMDVSEWDPTKDKFLTVNYDVTTALEGKALNKEALQAEVGLPVDKKVPLVAFIGRLEEQKGPDVMIAAIPEIVKDEDVQIVLLGTGKKKFERLLKSIEEKFPSKVRAVVRFNAPLAHQMMAGADVLAVTSRFEPCGLIQLQGMRYGTPCACASTGGLVDTIVEGKTGFHMGRLSVDCNVVEPADVKKVVTTLKRAVKVVGTPAYQEMVKNCMIQDLSWKGPAKNWEDVLLELGVEGSEPG

SEQ ID NO: 21994 - protein, 757 aa, Haloarcula marismortui
MRLTVKPLKQKDAGRGLAAIDRAAMDELELENGDYIVLEGKQDSRAVARVWPGYPEDEGNGIVRIDGQLRQEANVGIDDPVNIEKADVNPATSVTVALPQNLRVRGNVGPMIRNNLSGQAVTQGQTVPVSFGLGPLSSMSGQKIPLKIAETEPSGTVVVTDSTDIQVSEMPAEQVHSGEGAPEASDTPDVTYEDIGGLDRELEQVREMIELPMRHPELFQQLGIEPPKGVLLHGPPGTGKTLMAKAVANEIDAYFTTISGPEIMSKYYGESEEQLREVFDEASENAPAIVFIDEIDSIAPKRGETQGDVERRVVAQLLSLMDGLEERGQVIVIGATNRVDDIDPALRRGGRFDREIEIGVPDKKGRKEILQVHTRGMPLSEEINIENYAENTHGFVGADLATLTKESAMNALRRIRPELDLESDEIDAEVLERLEISDKDFREAMKGIEPSALREVFVEVPDVTWDSVGGLEDTKERLRETIQWPLEYEDVFESMDLEAAKGVLMYGPPGTGKTLLAKAVANEAQSNFISVKGPELLNKFVGESEKGVREVFSKARENAPTVVFFDEIDSIAGERGGGTTDSGVGERVVSQLLTELDGIEDMENVVVVATTNRPDLIDDALLRPGRLDRHVHVPVPDEEARRAIFQVHTRDKPLADGVDLDELASRTDGYVGADIEAVAREASMAATREFINSVDPEDIGDSVSNVRVTMDHFEHALSEVGPSVTEETRERYDEIEQRFDRAEPGVTDESTASRTFQ

SEQ ID NO: 21995 - protein, 317 aa, Ralstonia metallidurans
MSAKHAKVLILGSGPAGYTAAVYAARANLNPVLITGLAQGGQLMTTTDVENWPADPNGVQGPDLMQRFLAHAERFNTEIIFDHIHTAKLTEKPIRLIGDSGEYTCDALIIATGASAQYLGLPSEEAFMGRGVSACATCDGFFYKNQEVAVIGGGNTAVEEALYLSHIASKVTLIHRRDKFRAEPILVDRLMQRVEEGRIDLRYDSTLDEVLGDESGVTGLRIRDTKDAAKTEDLKLAGVFVAIGHKPNTDLFEGQLEMKNGYIVTKSGLSGDATATNIPGVFAAGDVQDHVYRQAITSAGTGCMAALDAQRYVEALK

SEQ ID NO: 21996 - protein, 340 aa, Datura innoxia
MEVISTQTNGSAIIMNYSHHNGNSDHRNGGATAHDHDNGRKLLGNSNSIKPGWFSEFSALWPGEAFSLKIEKLLFQGKSDYQDVMLFESATYGKVLTLDGAIQHTENGGFPYTEMIVHLPLGSIPKPKKVLIIGGGIGFTLFEVLRYSTVEKIDIVEIDDVVVDVSRKFFPYLAANFNDPRVTLVLGDGAAFVKAAQAGYYDAIIVDSSDPIGPAKDLFERPFFEAVAKALRPGGVVCTQAESIWLHMHIIKQIIANCRQVFKGSVNYAWTTVPTYPTGVIGYMLCSTEGPEVDFKNPVNPIDKDETHANSKLGPLKFYNTDIHKAAFILPSFARSMIES

SEQ ID NO: 21997 - protein, 257 aa, Eremopyrum distans
  misc_feature (247)..(247): Xaa can be any naturally occurring amino acid
  misc_feature (249)..(249): Xaa can be any naturally occurring amino acid
CELDNIMRLTGITGIVNGMDVSEWDPTKDKFLTVNYDVTTALEGKALNKEALQAEVGLPVDRKVPLVAFIGRLEEQKGPDVMIAAIPEIVKDEDVQIVLLGTGKKKFERLLKSIEEKFPSKVRAVVRFNAPLAHQMMAGADVLAVTSRFEPCGLIQLQGMRYGTPCACASTGGLVDTIVEGKTGFHMGRLSVDCNVVEPADVKKVVTTLKRAVKVVGTPAYQEMVKNCMIQDLSWKGPAKNWEDVLXEXGVEGSEPG

SEQ ID NO: 21998 - protein, 319 aa, Unknown
  Chlamydomonas sp. W80
MIGSKINAPRASMASRAAAPLRAAARPVRRLAVAPMAKASAATLAECQAECAALVKKASCAPILVRLAWHDSGNYDATTKTGGANGSIRFDPEMKHGGNAGLPLAVKLLEPIKKKFPDVGYADLFQMASATAIEVSGGPKIDMKYGRVDAADESAVPPEGRLPSAGAPFQEAQGPEPAKEAKDQSPQGHLRRVFGRMGLSDQDIVALSGAHTLGRAFKNRSGAAPLESTKFTKDGPGTKGGQSWTEEWLKFDNRYFTMLLEAEAGTCDPELLQLATDNALLTDPAFRPLVEKYAKDNAAFCADYAAAHKRLSELGSTFE

SEQ ID NO: 21999 - protein, 341 aa, Datura innoxia
MEVISTQTNGSAIIMNYSHHNGNSDHRNGGATAHDHDNGRKLLGNSNSIKPGWFSEFSALWPGEAFSLKIENLLFQGKSDYQDVMLFESATYGKVLTLDGAIQHTENGGFPYTEMIVHLPLGSIPKPKKVLIIGGGIGFTLFEVLRYPTVEKIDIVEIDDVVVDVSRKFFPYLAANFNDPRVTLVLGDGAAFVKAAQAGYYDAIIVDSSDPIGPAKDLFERPFFEAVAKALRPGGVVCTQAESIWLHMHIIKQIIANCRQVFKGSVNYAWTTVPTYPTGVIGYMLCSTEGPEVDFKNPVNAIDKLDETHVNSKLGPLKFYNTDIHKSAFILPSFAKNLTES

SEQ ID NO: 22000 - protein, 257 aa, Eremopyrum orientale
CELDNIMRLTGITGIVNGMDVSEWDPTKDKFLSVNYDITTALEGKALNKEALQAEVGLPVDRKVPLVAFIGRLEEQKGPDVMIAAIPEILKDEDVQIVLLGTGKKKFERLLKSIEEKFPSKVRAVVRFNAPLAHQMMAGADVLAVTSRFEPCGLIQLQGMRYGTPCACASTGGLVDTIVEGKTGFHMGRLSVDCNVVEPADVKKVVTTLKRAVKVVGTPAYQEMVKNCMIQDLSWKGPAKNWEDVLLELGVEGSEPG

SEQ ID NO: 22001 - protein, 541 aa, Phyllostachys pubescens
MTTVASLSLVPHLLIKPSFGCFSRKGVGRDGGIKVYAVLRDDKAEYSKNNNWEALFHVDDPGPRVPIAKGKFLDVNQALEVVRFDIQYCDWRARQDLLTIMVLHNKVVEVLNPLAREFKSVETLRKELAELQQELTKAHNQVHLSEARVSSALDKLAQMETLVNDRLLQDGSSSASTAECTSLTPSTSSTTHAGAKKQPRRNINVSGPVKPYNPKLQNFWYPVAFSSDLKDDTMVPIDCFEEQWVIFRGKDGRPGCVQNTCAHRACPLHLGSVNGGRIQCPYHGWEYSTDGKCEKMPSTKMLNVRIQSLPCFEQEGMVWIWPGDDPPKSTIPSLLPRSGFTIHAEIVMELPVRHGLLLDNLLDTAHAPFTLTFTFAKGWSVPSLVEFLAPSPLLPGYWDLSQMIVEFRPPCMVLSTIGISKPGKLEGKSTQQCSTHLHQLHVCLPSSRNKTRLLYRMSLDFAPWLKHIPFMHLLWSYFAEKVLNEDLRLVLGQQERMINGANVWNWPVSYDKLGIRYRQWRDAVERGADRLPFSNQIESGS

SEQ ID NO: 22002 - protein, 227 aa, Magnaporthe grisea
MASPRWAALARDTNETKVKLALSIDGGDLPPDTHPSLLEAAASGHASQSSSSQKISINTGIGFLDHMLHAFAKHAGFSLLLTCQGDLHIDDHHTAEDVCIALGDAFKTALGSAAGIARFGFAYCPLDEALSRAVVDVSNRPFAVVELGLRREKIGDLSCEMIPHCIMSFATAARLTIHVDCIRGENDHHRAESAFKALAVAVRTAVGKVAGREGEVPAQGYAERLGE

SEQ ID NO: 22003 - protein, 257 aa, Secale strictum
CELDNIMRLTGITGIVNGMDVSEWDPTKDKFLSVNYDVTTALEGKALNKEALQAEVGLPVDRKVPLVAFIGRLEEQKGPDVMIAAIPEIVKEEDVQIVLLGTGKKKFEKLLKSIEEKFPSKVRAVVRFNAPLAHQMMAGADVLAVTSRFEPCGLIQLQGMRYGTPCACASTGGLVDTIVEGKTGFHMGRLSVDCNVVEPADVKKVVTTLKRAVKVVGTPAYHEMVKNCMIQDLSWKGPAKNWEDVLLELGVEGSEPG

SEQ ID NO: 22004 - protein, 415 aa, Methanosarcina acetivorans
MYRILVHFILRVNDSEESWRKSMEIYNIPEIARNVFGVGSKDWNRRIFDSLIPLPEGTSYNSYLVKGEKKTALIDTVNPGFEEELEAKINMVSDLKKLDYLIMNHAEPDHANAIRFILEKAPEALFVTTKKGVKMAKLYHELPEARIKIVAEGDSLDLGGKTLRFIEAPWLHWPETMFTYLPEDKVLFSCDFFGAHTAQGVYDEEIEELVSLAKRYYGEIMMPFGKMGARALEKIKDLGIEIIAPSHGPIYKNPKRILDPYEKWTQGKTENKALIVYVSMWGSTREMIRTIAETLLKEGVDVRMYDLVASDIGDVARELVDSRSIVLGAPTVLGGMHPLALYGTYLVKALNPPAKYGVVLGSFGWGGGALKQAGELLAPSKIEIVGTLQVQGRASREKLKKVEEIGRELARKMKT

SEQ ID NO: 22005 - protein, 205 aa, Xanthophyllomyces dendrorhous
MSAGLPIRTATVTRNTNETQIVCSISLDHTPGVDQQIIDIQTGIGFLNHMLHAMAKHGNMSLTLHCKGDLEIDDHHTAEDCALALGEAFKLALGERRGIRRYGTGFAPLDEALSRAVLDISSRPYFCGDLPFTREKIGDLSTEMIPHVFESFATAAGVTLHVDCIRGVNNHHIAEASFKALALAIREAITRTGGNDVPSTKGVLL

SEQ ID NO: 22006 - protein, 580 aa, Aspergillus nidulans
METTTTTLAEYLFKRLHQLGVDSIFGLPGDYNLQLLDYVAPSRLHWIGSCNELNAGYAADAYSRVKGIGALVTTFGVGELSAVNAIAGAYAERAPVVHVVGTPVRESQESRALIHHTFNDGEYKRFDRMQEHITVAQAILTDHRSAPAEIDRVLQQCLLHSRPVRIAIPLDMVSLRVPKMALEHKICVPLPCRQPQLEDKALKAILDRMYSAKKPVILVDGEVRSAKIMEEVEHIVKSTEWPTFTSGFGKSLVDETLPNVYGVFTPRYKDFIDSSDLVLCFGPHFSNTNSYLYQTVPQQHKTIFFHPTSVQIDSEIIRDLPANHFLPQLIGHLEVAKLNRYTCNFDHPSSVAPPDVQASDLVTQAGGFWHRMSSFFQEGDIILAETGTASYGANEFRLPPKTRLFKAVTWLSIGYMLPATLGASLAQHDLIARSEYHDFLEARSILFIGDGSFQLTAQELATIIHRKLNVIIFLINNDGYTIERAIHGRNQGYNNITPWRYLKGLEFFGAPTEGEYAAHTWQVRTWGDLEKVLTDERMIKGKGVRMVEVFMDRLDVPPPLDRILEMQIERENGVQCDKPQ

SEQ ID NO: 22007 - protein, 296 aa, Saccharomyces cerevisiae
MITTPLVHVASVEKGRSYEDFQKVYNAIALKLREDDEYDNYIGYGPVLVRLAWHISGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDAGYVRTFFQRLNMNDREVVALMGAHALGKTHLKNSGYEGPWGAANNVFTNEFYLNLLNEDWKLEKNDANNEQWDSKSGYMMLPTDYSLIQDPKYLSIVKEYANDQDKFFKDFSKAFEKLLENGITFPKDAPSPFIFKTLEEQGL

SEQ ID NO: 22008 - protein, 434 aa, Desulfitobacterium hafniense
MIISIVAVGCSSKTSQPVAFRAEIAPGTLSVDEYAKYYPKQYDTFMKTAEMSNEGSKYGGSEEFDKLTQWPFLKEIFAGYGFAIEYNEDRGHNYTIEDVTKIKRINEKSIASCWTCKSANVAGVVEEMGDAYYGANFHDLKGKMTEGITCANCHDPQTMNLVITQPPLRDTLTRLGKDPDKLTTQELRTMVCAQCHVEYYFAGDKKIVTFPWDKGLTPTDVLEYYEEKDFSDWTHAKAGVREIKAQHPEYETFMGSTHAEAGLSCADCHMPYTMNGGEKISSHWWTSPLKHMNESCLTCHREGEEALKERVFYTQDKVADMMAKVGNVTVEALEAIAEADAKGGNQDALKEARALQRKGQFLVDWVGAENSMGFHNPQLIMETLNTSMDYAYQAINKATESITGVAAPKWDVEAPKTNTETMKVLHDKENAPKS

SEQ ID NO: 22009 - protein, 212 aa, Saccharum officinarum
HEGQPLESEPNEPLRVNVLFKHVQKMLTGDSAVIAETGDSWFNCQKLKLPEGCGYEFQMQYGSIGWSVGALLGYAQGANNKRVIACIGDGSFQVTAQDVSTMLRCEQNSIIFLINNGGYTIEVEIHDGPYNVIKNWNYTGLVDAIHNGEGKCWTSKVKCEEELTAAIETALGEKKDCLCFIEVIAHKDDTSKELLEWGSRVSAANSRPPNPQ

SEQ ID NO: 22010 - protein, 317 aa, Arabidopsis thaliana
MVHGRLCNRDGWILTAMVVTEFSNVGVNTLVKAATSKGLSPFVVLVYSYTFGSLLLLPLTFFSFRSAFQILGYNGIKYSSPTLSSAMSNVNPAFTFILAVVFRMENISLGKKSSVAKVLGTILSIIGALVVTLYHGPMLMSSHSDWIIGGGLLALQYILVSVSYLVMAHTMGRYPSAVVVTLVHNVCIAVVCAFVSLLAEKDNPKAWVIRFDITLITVVATGILNSGYYVIHTWAVSHKGPVYLSMFKPLSILIAAVSTFIFLGESLYLGSVMGGILISIGFYMVLWGKAKEDKVDIIGAIESSPSHNAPLLDNFKS

SEQ ID NO: 22011 - protein, 353 aa, Streptomyces ambofaciens
MEHIDVAVIGGGQSGLAAAHALLRRGLRPVVLEASDRTAGSWPHYYDSLTLFSPARYSSLPGMPFPGADSDRYPHRDEVAAYLTAYADRLDADIRTGERVTSVRRDGSAFDVVLEGGGRLGARAVVAASGTFGRPHRPELPGLVEFTGQVLHAADYRSPAPFTGGRLVVVGAGNSAVQIAAELATTARATLATRGPVKFAAQRILGRDLHFWTARTGLDTAPLGRFLSRPPAQPVLDDGRYRAALAAGRPERRPLFTGADGTKLVWPDGQREEVDAVVLATGYRPDLPYLAGLGGAMDTEGKPRHREGLAADVPGLAFVGLEWQRSLSSNSLRGVGRDAERIARRLVAHLARR

SEQ ID NO: 22012 - protein, 171 aa, Solanum demissum
MTCTNYEMAFFPTNFMLQTPHHEDEHQPSTSLNPILPSCSPQDFHGIASFLGKRSMSFSGMDGNNACEENHGEDDLSDDGSQAGEKKRRLNMEQVKTLEKNFELGNKLEPERKMQLARALGLQPRQIAIWFQNRRARWKTKQLEKDYEVLKRQFDAIKAENDALQTQNQKL

SEQ ID NO: 22013 - protein, 701 aa, Solibacter usitatus
MHHIVEVDLGDRKITLETGKMAKQANGAVVVRSGDAVVLVTACMADQPKPSAGFFPLTVDYREYTYAAGKIPGGFIKREGRLSEKEVLTCRLIDRPIRPLFPEGFMNETQIIAMVLSADPEQDPNSLAIVGTAAALAISDIPFQYVMAGVRVGMRDGQYTANPTYTEGRASKLNIVVAGTEEGIVMVEAGAQEVSEAEVLGAIEFGHECCKKIAAGIRQLMKLCGKTKREFVSPVLDETIYAEVEKQARVDLTDALNTEKHEKLASYALVASVKKRTIEALPDEQKEQGAKCFDALKERIFRDDMLKKHRRPDGREFDQIRQITIETGVLPRVHGSTLFTRGETQALVTVTLGTKDDEQRIELLEPGEASKRFMLHYNFPPFSVGEVGFMRGAGRREIGHGALAERALTALIPGEDKFPYTMRVVSDTLESNGSSSMAAICGGSLALMQAGVPMTAHVGGVAMGLVMEGKDYAILTDIAGAEDHYGDMDFKVAGTRDGITGMQMDIKVPNITTAIMKEALEQARRGRLFILDKMYEAMPQANTAISQYAPRIYTLHIPTDKIRDVIGPGGKVIRGIIEQTGVKIDVEDDGTIHVASADEASANKAIQIISDLTATAEIGKTYLGKVVRLVDFGAFVEIFPGTDGLLHISEIAENRIKDVRDELKEGDQILVKCLALEGNKIKLSRKAVLKEQREKMKQGKE

SEQ ID NO: 22014 - protein, 360 aa, Medicago truncatula
MPHLIRENLFISNIVDAAEILQTTTTTTVPHNITHILSVLSSASISFFSEWRSSFSVSVKEISKLHVSDVPTAAKSALSPDKLLYSLEYAGEDFKLVRMAVPLRDTESENLLDYLQVCVDFIERSRKEGSVLVHCFAGVSRSAAVITAYLMKSENLSLEDALASLKQSCEFVCPNDGFLEQLKMFEEMGFKVDQSSLVYKRFRLKILGENHFSGSRIDSSKLGADPGMPVETSSEVGEATKVENNRSPAYRCKKCRRIVALQEHVVDHIPGEGETSFGWHKRKSGNPFNKSNESECSSIFIEPLRWMKDVEEGALEGKLSCAHCDARLGYFNWAGIQCSCGSWITPAFQLHKSRVDISPV

SEQ ID NO: 22015 - protein, 746 aa, Coccidioides immitis
MATGSTYRPMVAWVYDTMLWLFSVLVDLFFREVHPRGSWKVPKRGAVILVAAPHANQFVDSLILMRVMRRELQRRVAFLIAEKSFRRKFIGLLARASGAVPVSRAMDNMKPGKGAIYLPDPVNNPTLLRGIDTNFESPEFQVGGTITLPTVNGQAASTDIGEIRGPEEIILRKPFKTKDSLYQLTGRTDITADGNFTMKSLSGPNPDFKGTKFKVAPHIDQTQVYRAVFDTLNNGGCIGIFPEGGSHDRPDLLPLKAGVALMALGALAENPDCPVKIVPCGMNYFHAHKFRSRAVIEFGNPIEVPPELVKMYRDGHRREAVGSLLNTIYQGLVSVTVTSTDYETLMLIQAARRLYNSTGRKLPLPVVVELNRRLVKGYEHYKNDPRIIGVKKSVMEYNKQLWLLGVRDHQVEYAKFSFIKVITTLIYRLVKLAVMAIGTLPGLILFAPVFVATKTISRKKSKEALAASSVKIQGRDVMATWKLLVALAFAPILYLFYTVVLTYWTYYNRVQGYVPGWVPLWVVVLFGFGFFPSITFAALRIGEVGMDIIKSLRPLVLSLNPTSANTLHRLRIRRAELSEQVTTLINTFGPELYPDFDSTRIVADPLKEAFFTDESTAKSRPQLDGESMDLRRMQHGEPAHPGVEGQLPRNESFHDLANFGFFSTRPPSRDSHSRSSSSGGLVGSAGFPVKSFTTLDSKESFDEVTRRIRGAMRERGRQRRKSEDSGFSVESSGSLSPIRVDSRKYK

SEQ ID NO: 22016 - protein, 439 aa, Oryza sativa
  misc_feature (192)..(192): Xaa can be any naturally occurring amino acid
MAAAAAATFLPHTPTPRRRLAVAVHSPTRRRLSLVFSGPPDGALSVAAAEEKADAGEEAAAAVSAPRGSGGGGGKERRRVVRKAWEKLVRWSRSWRRRNRSDVVETTRKVVVLGGGSFGTAMAAQVAAKKADLEVSMLLRDDLVCRSINHSHINCKYLRDHRLPENITATTSASDALAGADFCFHAVPVQFXSFLEGISTHVDPKLPFISLSKGLELNTLRTMSQIIPQALGNPRQPFIVLSGPSFAIELMNKLPTAMVVASKDKKLAAAVQQLLASPNLRISTSNDVTGVEIAGALKNVLQEFGTRVEGMHLGNNCMAALLLKAVGEIRWLATKMGAKPTTLSGLSGSGDIMLTCFVNLSRNRNVGLRLGSGEKLDEIMNSMNQVAEGVSTAGAVIALAQKYHVKMPVLTAVARIIDNELTPKKAVMELMNLPQVEEV

SEQ ID NO: 22017 - protein, 144 aa, Triticum aestivum
MGANGALDDVPAGVVGKEERPLAEGQQEEEEQEEGGATVFRGTNYSLPRTIAALALWLGGIHFNVLLILASLFLFPLRLAALVVALQLVFMFIPLNDEDKLGRKIGRFICKYAMGYFPIRLHVEDYNAFDSKNARGTHPPRNNF

SEQ ID NO: 22018 - protein, 118 aa, Bacteroides thetaiotaomicron
MKKIEAIIRKTKFEDVKDALLEADIEWFSYYDVRGIGKARQGRIYRGVVYDTSTIERILVSIVVRDKNAEKTVQAIIKAAQTGEIGDGRIFVIPIEDAIRIRTAERGDIALYNAEQER

SEQ ID NO: 22019 - protein, 894 aa, Oryza sativa
MPPWWGKSFSKDAKKTTKENLIDTFHRLISPNDQKGSTKSKRSCRRGNDSSVEKSCRSTTVSRPTSPSKEVSRCQSFSADRPHAHPLPIPGVRPPVTRTVSDITESKPILEKRGKPPLLLPLPKPNRPPRRHGNSEVVSEIVVASPSSNCSDSDDHGDSQLQSPVGNDAENATLVTLKNKSSNARKECPGPITAKNMKEIHRPANQVHGSHILSTSPRGVAADSYQSNLQNPRPLVLDSAPNSLMSSPSRSPRRICPDHIPTSAFWAVKPHTDVTFVGSGQCSSPGSGQTSGHNSVGGDMLAQLFWQPSRSSPECSPIPSPRMTSPGPSSRVHSGSVSPLHPRSGGMAPESPTNRHDDGKKKQTHKLPLPPLSISHSSFHPNNSTPTSPISVPRSPGRTENPPSPGSRWKKGKLIGRGTFGHVYVGFNSDSGEMCAMKEVTLFLDDPKSKESAKQLGQEISLLSRLQHPNIVQYYGSETVDDKLYIYLEYVSGGSIHKLLQEYGQLGEQAIRSYTQQILSGLAYLHAKNTVHRDIKGANILVDPSGRVKLADFGMAKHINGQQCPFSFKGSPYWMAPEVIKNSNGCNLAVDIWSLGCTVLEMATSKPPWSQYEGIAAMFKIGNSKELPPIPDHLSEPGKDFIRKCLQRDPSQRPTAMELLQHPFVQKAVSLEKSVLSEPLEHLAVISCRSSAKMAAHTRNISSLGLEGQTIYQRRGAKFSSKHSDIRIRSNISCPVSPCGSPLLKSRSPQHSNGRMSPSPISSPRTTSGTSTPLSGGNGAIPFNHLKQSTYSNEGFAIPSRSPDDLFASRPTDPDLGQFIRVHQVSQGLQERVVSEADILSPQFGKRLGNVFDLRDKLSPSERFTHHAFVDHVKLNPSLDLTSGSPHLGLKHGN

SEQ ID NO: 22020 - protein, 294 aa, Fusobacterium nucleatum
MEKIYGVIDVTSGYANGKTKNPKYQDLHSSGHAETVHVRYDASKVNLSTLLKYYFKIIDPTSVNKQGNDRGSQYRTGIYYVNQNDKSVIQDEIKEQQKKYSQKIVVEVLPLKEYYLAEEYHQDYLKKNPNGYCHIDLSKADDIIVDEKKYPKLSEKELKMKLNSKQYEVTQNGDTERAFQNDYWDFFDKGIYVDITTGEPLFSSTDKYASQCGWPSFVKPIVPEVVTYHKDTSFNMIRTEVRSRSGKAHLGHVFDDGPRDRGGKRYCINSAAIQFIPYAEMEAKGYGYLLPLVK

SEQ ID NO: 22021 - protein, 227 aa, Plantago major
QSAEVDEFIYHECLIHPPLLSHPNPKSVFIMGGGEGSAAREALRHKSIEKVVMCDIDQEVVDFCRKHLVANHEAFRNGKLDLVINDAKAELENRQEKFDIIVGDLADPVEGGPCYQLYTKTFYETILKPKLNENGIFVTQAGPAGVFTHKEVFSSIYNTIKQVFKYVRAYTAHVPSFADTWGWVIASDQPLSIEAGNMDKKIAERIDGELMYLNGASFVASTILNKT

SEQ ID NO: 22022 - protein, 461 aa, Burkholderia pseudomallei
MATDQDNDGLKRGLKNRHIQLIALGGAIGTGLFLGIAQTIRMAGPSVLLGYALAGVVAFFIMRQLGEMVVDEPVAGSFSYFASKYCGHFTGFLSGWNYWVLYVLVSMAELSAVGIYVQYWWPGVPTWISALVFFVVINAVNLASVKSYGETEFWFSIVKVAAIIGMIGFGGYLLLSGHAGPDAGVANLWRHGGFFPNGIGGLAMAMAVIMFSFGGLELVGITAAEADDPSHSIPRATNQVIYRILIFYIGALGVLLSLYPWQKVVTGGSPFVLIFHALSSDIAASVLNVVVLTAALSVYNSCVYCNSRMLYGLAQQGNAPQALARVNRRGIPIAALGVSAFATALCVVINYFMPGKAFELLMGLVVSAIIINWAMISVIHLRFRQAKRAAGETTRFRSLGYPLTNYFCLAFMAAILVVMFRTPELRLSVYLIPVWLVVLALGYRFRQRGAGYALGGGVSAR

SEQ ID NO: 22023 - protein, 414 aa, Unknown
  Erythrobacter sp. NAP1
MNATGSTSADVVIVGTGHGGAQAAIALRQQGHESSILMIGRDAEPPYERPPLSKEYLAGDKSFERMMIRPEKFWADKGVQLRLGCAVIEIDWMRHEVTLSDGSKVGYRKLIWAGGGDPRRIDVPGAGLKGIFCVRDKRDADAMMGALEAGAKRAVVIGGGYIGLEAAAVLRKLGCEVTLLEVQDRVLARVAGEELSRFYEEEHRRQGVDVRLSQGISEILGEDGKVTSVQLDNGEMLACDMVVVGIGIVPAVAPLIAAGAAGANGVDVDVYCRTTLDDIYAIGDCAAHVNPFAESAVIRLESVQNANDMANTVARAIMGDKQPYHALPWFWSNQYDLKLQTAGLSLGYDATVVRGDPAERKFSVVYLKEGRPIAFDCVNAMKDYVQGRKLLERGIEKVDPALLADTEIQLKELI

SEQ ID NO: 22024 - protein, 320 aa, Parvularcula bermudensis
MADRLHTKLLIIGSGPAGYTAAIYAARAMLEPVIVHGLQPGGQLTITTDVENYPGFADPIQGPWLMEQMQKQAENVGTKMVSDIITEVDTASRPFSFKGDSGTIYTADAVIVATGAQAKWLGLPSEKKFQGFGVSACATCDGFFYRGRTVGVVGGGNTAVEEALFLTNFADKVYLIHRRDSLRCEAILRQRALDHPKIELLWNRQVDEVLGSDNPLGVEGVRLASTVGEDSMELAIHGLFIAIGHAPATQIFEGHLEMKPNGYIVTAPDSTATSVPGVYAAGDVTDETYRQAVTAAGMGCMAALEAEKFLAGMAIAEAAE

SEQ ID NO: 22025 - protein, 198 aa, Plantago major
MGDISISNGSGHGVQRKSCWYEEEIEENLRWCFALKSILHTGASQYQDIQLLDTKPFGKALVIDGKLQSAEIDEFIYHESLVHPPLLNHPNPKTIFIMGGGEGSTAREILRHRDVQKVIMCDIDEEVVDFCKSHLLVNKEAFYDPRMELVINDARAELERREELYDVIIGDLADPLEGGPCYQLYTKSFYEFIVKPKL

SEQ ID NO: 22026 - protein, 257 aa, Secale cereale
CELDNIMRLTGITGIVNGMDVSEWDPTKDKFLAVNYDVTTALEGKALNKEALQAEVGLPVDRKVPLVAFIGRLEEQKGPDVMIAAIPEIVKEEDVQIVLLGTGKKKFEKLLKSIEEKFPSKVRAVVRFNAPLAHQMMAGADVLAVTSRFESCGLIQLQGMRYGTPCACASTGGLVDTIVEGKTGFHMGRLSVDCNVVEPADVKKVVTTLKRAVKVVGTPAYHEMVKNCMIQDLSWKGPAKNWEDVLLELGVEGSEPG

SEQ ID NO: 22027 - protein, 331 aa, Bacillus cereus
MNLAKFPRKKYTESYTPIEKLNNFSEALGGPTIYFKRDDLLGLTAGGNKTRKLEFLVADAQVKGADTLITAGGIQSNHCRLTLAAAVKEKMKCILVLEEGLEPEEKPDFNGNYFLYHLLGAENVIVVRNGADLMEEMHKVAKEVSEKGSTPYVIPVGGSNPTGAMGYVACAQEIMAQSFDQGIDFSSVVCVSGSGGMHAGLITGFAGTQSNIPVIGINVSRGKAEQEEKVAKLVDETSAHVGIPNFIPREAVTCFDEYVGPGYALPTPEMVEAVQLLAKTEGILLDPVYTGKAVAGLIDLIRKGTFKKEDNILFVHSGGSPALYANTSLFV

SEQ ID NO: 22028 - protein, 215 aa, Plantago major
KRVLVVGGGDGGVLREICRHSSVELIDICEIDEMVIDVSKKFFPELAIGYEDPRVHLHVGDAIDYLKRAPQGKYDAVIVDSSDPVGPAQELVEKPFFETIARALRPGGVLCNMAESMWLHTHLIQDMMSACQDIFKGSVRYAWANVPTYPSGVIGFLLCSTEGPAVDFLHPVNPIEKLEDALKYRRELMYYNSEMHEAAFALPSFVKREVEALRD

SEQ ID NO: 22029 - protein, 257 aa, Thinopyrum scirpeum
CELDNIMRLTGITGIVNGMDVSEWDPTKDKFLAVNYDVTTALEGKALNKEALQAEVGLPVDRKVPMVAFIGRLEEQKGPDVMIAAIPEIVKEEDVQIVLLGTGKKKFEKLLKSIEEKFPSKVRAVVRFNAPLAHQMMAGADVLAVTSRFEPCGLIQLQGMRYGTPCACASTGGLVDTIVEGKTGFHMGRLSVDCNVVEPADVKKVVTTLKRAVKVVGTPAYHEMVKNCMIQDLSWKGPAKNWEDVLLELGVEGSEPG

SEQ ID NO: 22030 - protein, 267 aa, Pseudomonas aeruginosa
  misc_feature (1)..(1): Xaa can be any naturally occurring amino acid
XPKLEEGVEGLVHVSEMDWTNKNIHPSKVVQVGDEVEVQVLDIDEERRRISLGIKQCKSNPWEDFSSQFNKGDRISGSIKSITDFGIFIGLDGGIDGLVHLSDISWNEVGEEAVRRFKKGDELETVILSVDPERERISLGIKQLEDDPFSNYASLHEKGSIVRGTVKEVDAKGAVISLGDDIEGILKASEISRDRVEDARNVLKEGEEVEAKIISIDRKSRVISLSVKSKDVDDEKDAMKELRKQEVESAGPTTIGDLIRAQMENQG

SEQ ID NO: 22031 - protein, 308 aa, Methanosarcina acetivorans
MGQIYSDITWTIGNTPLVRLNHITKGLHTDVLVKVESFNPMGSVKDRIGLAMLEEAEREGKIKEGTTIVEATSGNTGIALAGVCAARGYKLILVMPETMSIERRKLLKALGAELVLTPGPEGMKGAVNKAEQMASADPTLYYMPQQFQNPANPEAHRRTTAEEIWRDTDGKADVLVAGVGTGGTITGIAGVLKKRKTGFRAIAVEPTESPVLSGGSPGPHRIQGIGAGFIPDVLQLGLVDEIIKVSADEAISTGRRLAREEGILAGISSGAATCAALQVASRKEMSGKTIVVILPDTGERYLSTDLFS

SEQ ID NO: 22032 - protein, 257 aa, Elymus californicus
CELDNIMRLTGITGIVNGMDVSEWEPIKDKFLAVNYDATTALEGKALNKEALQAEVGLPVDRKVPLVAFIGMLEEQKGPDVMIAAIPEIVEEEDVQIVLLGTGKKKFERLLKSVEERLPGKVRAVVRFNAPLAHQMMAGADVLAVTSRFEPWGLIQLQGMRYGTPCACASTGGLVDTIVEGKTGFHMGRLSVDCNVVEPADVKMVATTLKRAVKVVGTPAYQEMVKNCMIQDLSWKGPAKNWEDVLLELGVAGSEPG

SEQ ID NO: 22033 - protein, 311 aa, Unknown
  Magnetococcus sp. MC-1
MGRIYNDITETIGNTPLVRLNRISQGLDAEILVKLEYFNPMASLKDRIGLAMIQEAEAKGLITKDTLIIEPTSGNTGIALAFVCAARGYQLVLTMPESMSMERRKLFELLGAQVVLTSAMDGMKGAIDKAQELLAETDKGFMPNQFDNGANPAVHETTTAEEIWRDTDGQLDLFLAGVGTGGCLTGVARTLKKRIPQLRVVAVEPESSPVLSGGMPGPHKIQGIGAGFVPRVLDTQLMDEVVRVGDQEAFEVARRMAREEGIACGISSGAVVAAALQLARTPRYAGKRFVLVLASFAERYLSTELFPSQLP

SEQ ID NO: 22034 - protein, 451 aa, Zea mays
MAERLAASLLPAASPSPSARRATVAAAAAASFPSPCSARAGLRLRSRPPLFSQKAAGRGCGLRVVRCMAASDAAQLKAAREDIKELLKSTYCHPIMVRLGWHDSGTYDKNIKDWPQRGGANGSLRFDAELSHGANAGLINALKFIQPIKDKYPGTTYADLFQLASATAIEEAGGPKIPMKYGRVDVTAAEQCPPEGRLPDAGPRDPAEHLREVFYRMGLDDKEIVALSGAHTLGRARPDRSGWGKLETKYTKDGPGEPGGQSWTVEWLKFDNSYFKDMKFLSQLPWKEQKEQDLLVLPTDAALFEDPSFKVYAEKYAEDQEAFFKDYGEAHAKLSDLGAKFDPPEGFSLDDDTSSSPSDEKTEEPTLVAVGAAVATATADDNNGAAPQPEPFVAAKYSYGKRELSDAMKQKIRAEYEGFGGSPDKPMQSNYFLNIMILIAGLAFLTSLLGN

SEQ ID NO: 22035 - protein, 705 aa, Haloarcula marismortui
MSGSTEAGVELTVEGANKRDAGRGIARLPESARTELGVLSGSPVIIDGDDMTVVKVWPADDDGSFVRIDSDTRANAGVNIGDTVTVTSGSVSEATEIAVQPVEPMPGSEDYESLVRKRLVDQIIQADERTHIDGLGTFLVRKTSPSGPVRVTDATAVTVLPGLDGGSGAGQSSSDEATTTNTPTAETESGVSYEDIGGLDEELDRIREMIEMPLSEPEEFRRLGIDPPSGVLLHGPPGTGKTLIARAVANEVDAYFDTISGPEIVSKYKGESEERLREAFEKAEANAPAILFVDEIDSIAGSRDEDADMENRVVAQLLTLMDGLEDRGRVVVIGATNRVDAIDPALRRGGRFDREIEIGVPGEHGRREIMDVHTRDMPLHDDVDLDRIAAQTHGFVGADLASLTTEAAMAALRTDRDDGDVHQDDFETALATVDPSAMREYVAESPTATFDDVGGLAEVKQTLTETIEWPLSYGELFTATNTDPPSGILLYGPPGTGKTLLARAVAGESDVNFIHVAGPEIMDRYVGESEEAVRELFERARQTAPSIIFLDEIDAIASHRGQGNEVTERVVSQLLAELDGITENPNLVVLAATNRRDMIDDALLRPGRLEQHVEVPNPDRDAREEILAVHTAGKPLAADTDIEDLAEKTDGFSGAELEAVVREASMLAIREVASAYGPEEATENAEEVEITPAHFSEALERERTR

SEQ ID NO: 22036 - protein, 382 aa, Pseudomonas syringae
MSAPVVIIGTGLAGYNLAREFRKLDVDTPLLLITADDGRSYSKPMLSTGFGKNKEADGLSMAEAGAMADQLKAEIRTHTRISGIDAGHKRLWIGEEAVYYRDLVLAWGAETIRVPVEGDAGDAVFPINDLQDYARFRAAAAGKRRVLILGAGLIGCEFANDLILGGYEVDLVAPCEQVMPTLLPPEAAAAVKSGLESLGARFHLGPVLTRLNRNGDGLQAHLSDGQVMDCDLVVSAIGLRPRIELAAAAGLQTGRGILVDRLLQTSHANIHALGDCAEVDGLNLLYVMPLMSCARALAQTLAGNPTSVKYGPMPITVKTPACPLVVSPPPRGSDGHWSVEGQGADIKALCHDADGHLLGYALTGAAVMEKLALNKALPALLA

SEQ ID NO: 22037 - protein, 291 aa, Anabaena variabilis
MSLRALLLVNRHARQGQARLLEAINHLKKFNFQLIEESTEHPKHLSQVIHKYKYQVDLVIVGGGDGTLNAVVDALVETQLPLGILPLGTANDLARTLGISNSLPEACRTIAEGELRRIDLGWVNGKHFFNVASLGLSVKITRRLTKEFKRRWGIFAYAVTAMQVIWESRPFSAEIHSKDRVFRIKTVQIAVGNGRYYGGGMAIVPDASIDDQRLDLYSLEISHWWEIIPLLPAMRNGRHIHRQNVRALNGQEFEVYTRKPRAINTDGEITTYTPATFRVIPKAVAVLVPPV

SEQ ID NO: 22038 - protein, 509 aa, Medicago truncatula
MALFLTIPLSFIAIFLFYTLFQRLRFKLPPGPRPWPVVGNLYDIKPVRFRCFAEWAQSYGPIISVWFGSTLNVIVSNSKLAKEVLKENDQQLADRHRSRSAAKFSRDGQDLIWADYGPHYVKVRKVCTLELFSPKRIEALRPIREDEVTAMVESIFNDSTNSENLGKGILMRKYIGAVAFNNITRLAFGKRFVNSEGVMDEQGVEFKAIVANGLKLGASLAMAEHIPWLRWMFPLEEEAFAKHGARRDRLNRAIMEEHTQARQKSGGAKQHFVDALLTLQEKYDLSEDTIIGLLWDMITAGMDTTAISVEWAMAELIKNPRVQQKAQEELDKVIGFERVMTETDFSSLPYLQCVAKEALRLHPPTPLMLPHRANTNVKIGGYDIPKGSNVHVNVWAVARDPAVWKDATEFRPERFLEEDVDMKGHDFRLLPFGAGRRVCPGAQLGINMVTSMLGHLLHHFCWAPPEGVNPAEIDMAENPGMVTYMRTPLQVVASPRLPSELYKRVTADI

SEQ ID NO: 22039 - protein, 435 aa, Oryza sativa
MALPCAFLSAAAAANATSFSSSPESRRCRSVHRVPSRPRPPLAPPARVMGKGNSKRKAANTRLWMRLDRRGGCEMILCDKSFVARRSGLPARDLRVLGPLLSRSPSILAREKAMVINLEFVRAIVTADEVLVLEPLAQEVLPFVEKLRKHFPLKSLDVDDVSTHMHTENQDGELAQDVSCYEVEGANHELPFEFQVLDFALEAVCLSYNSTISDLNRSAIAVLDDLMKSVSTRNLERVRSLKSSLTRLLASVQKVRDEVEHILDDNEAMAHLCTARKTKGQKDLLNTILFPETRLCRTHSSIENSTGIRTCVPSDSDAHILDMLLEAYFKQLDGIRNRIFLVRQYIVDTEDYISIQLDNKRNELLGLQLTLIIASFGIAINTFIAAAFAMNIPHRGYHFVIGVPFGQFVGATSFLCMSIVILLFTYAWRNRLLCT

SEQ ID NO: 22040 - protein, 221 aa, Arabidopsis thaliana
MSLVIYNYRKTFWRIFKKKSVEEFSYVPYVATVMNCMLWVFYGLPVVHKDSILVSTINGVGLVIELFYVGVYLMYCGHKKNHRRNILGFLALEVILVVAIILITLFALKGDFVKQTFVGVICDVFNIAMYGAPSLAIIKVVKTKSVEYMPFLLSLVCFVNAGIWTTYSLIFKIDYYVLASNGIGTFLALSQLIVYFMYYKSTPKEKTVKPSEVEISATERV

SEQ ID NO: 22041 - protein, 132 aa, Bacillus licheniformis
MGQSFNAPYEAIGEELLSQLVDTFYERVKRHPLLYPIFPDDLTETARKQKQFLTQYLGGPPLYTEEHGHPILRARHLPFPITPERADAWLSCMKEAMDHVGLKGEIREFLFERLTLTARHMVNQPKMEDGSH

SEQ ID NO: 22042 - protein, 473 aa, Unknown
  Synechocystis sp. PCC 6803
MEHKPNEFVKRAMKIDIIIVYIQRYRKGHEVHFVPPLTGIHLAALTPAKHTVRVIHQQVETVNLDSEADVIVLSFFSGFAPEAYRLATEYRKRGKITIAGGPHVTFAPEEALRFVDSIVIGEGESVWEQIFQDIEQNTLQQRYIGEAIPLTNIPTPRYDLLPPQYFIRRVVQATRGCPFTCSFCTVPVLNPGFRTRPVEAVLNDIRYNKFKWWWQRKTVWFWDDNLTANRPYIKELLRQMIPLRKWWLTQASMDITKDDELLDLMRDSGCIGIFFGIESFGQESLEDAGKRQNKVAEYQGKIKKLHDRGIGVMAGFISGLDGDTPESIRDMANQLEEIGVDVPFLSILTPFKGTRSYSKMMDTDRLRSDLGWEFYNGYNVTFVPSKMTPAELLKAHRDLWRSAFSLQAIFRRIGRSLFTLRGGAMMMCSIMNLFYGLKALTNNEPISFEGTDEYKSIRETIDLIPYSRQNSLS

SEQ ID NO: 22043 - protein, 128 aa, Zea mays
  misc_feature (70)..(70): Xaa can be any naturally occurring amino acid
MEAEAAAKRAREGGEDATAPVAGAEAVVAGAGEQAGISAVIPGWFSEISPMWPGEAHSLKVEKVLFQGQXDYQNVMVFSPLHAPGRGFVLDGVYSSGQKGNEGAAPKTRLLPLPLWIPKRTPKKVFGY

SEQ ID NO: 22044 - protein, 371 aa, Streptomyces ambofaciens
MTQHTDVVVVGGGQAGLAAGYHLRRQGLDFVVLDADAAPGGSWQHMWDSLHLFSPADHSSLPGRLMPAQPGETYPDAGHVVDYLTDYEKRYDLPVQHGARVDAVRRDAGHLLVEADTGTWRAKAVISVTGTWSRPFLPAVPGRSVFPGRQLHTVNYRSPADFAGQRVLVVGGGKSGAQIAADLALDGQADVTWVTQRPTRFLADDIDGRALFDVATARRRALDAGRTDTGGVASLGDIVAVPAVRAARDAGLLHVKPMFARLTATGVRWSDGSQSDADAIVWCTGFRPALSHLAPLNLRGSRGGIPTDGTRAVGEPRLHLLGYGDWTGPASATLIRVGRPAGDAVRHIAGQLSTGRILGAGEGRSGSRTVR

SEQ ID NO: 22045 - protein, 538 aa, Zea mays
MGYQVVAAQLKLASSADHASVVIITLFVALLCACIVLGHLLEENRWLNESITALIIGLGTGVVILLISRGKNSRLLVFSEDLFFIYLLPPIIFNAGFQVKKKQFFRNFMTITLFGAVGTMISFFTISLGAIATFSRMSIGTLDVGDFLAIGAIFSATDSVCTLQVLHQDETPFLYSLVFGEGVVNDATSVVLFNAVQKIQFTHINAWTALQLIGNFLYLFSTSTLLGIGTGLITAFVLKKLYFGRHSTTRELAIMILMAYLSYMLAELFSLSGLLTVFFCGVLMSHVTWHNVTESSRTTSRHVFATLSFISETFIFLYVGMDALDFEKWKTSSLSFGGTLGVSGVLMGLVMLGRAAFVFPLSFLSNLAKKHQSEKISFRMQVVIWWAGLMRGAVSMALALNKFTRSGHTQLHGNAIMITSTITVVLFSTMVFGMITKPLIRLLLPASGHPRELSEPSSPKSFHSPLLTSQQGSDLESTTNIVRPSSLRGLLTKPTHTVHYYWRKFDDALMRPVFGGRGFVPFVPGSPTERNPPDLSKA

SEQ ID NO: 22046 - protein, 525 aa, Spinacia oleracea
MAGRNIKNGENNKIAGSSLHLEKNPTTPPEAEATLKKLGLVASVAAGVQFGWALQLSLLTPYVQLLGIPHTWAAYIWLCGPISGMIVQPLVGYYSDRCTSRFGRRRPFIAAGAALVAVAVGLIGFAADIGAASGDPTGNVAKPRAIAVFVVGFWILDVANNTLQGPCRALLADMAAGSQTKTRYANAFFSFFMALGNIGGYAAGSYSRLYTVFPFTKTAACDVYCANLKSCFFISITLLIVLTILALSVVKERQITIDEIQEEEDLKNRNNSSGCARLPFFGQLIGALKDLPKPMLILLLVTALNWIAWFPFLLFDTDWMGKEVYGGTVGEGKLYDQGVHAGALGLMINSVVLGVMSLSIEGLARMVGGAKRLWGIVNIILAVCLAMTVLVTKSAEHFRDSHHIMGSAVPPPPPAGVKGGALAIFAVLGIPLAITFSIPFALASIFSASSGSGQGLSLGVLNLAIVVPQMFVSVTSGPWDAMFGGGNLPAFVVGAVAATASAVLSFTLLPSPPPEAKIGGSMGGH

SEQ ID NO: 22047 - protein, 450 aa, Ipomoea batatas
LTVEAPILERRRANPKNVAAIILGGGAGTQLFPLTNRAATPAVPLGGCYRLIDIPMSNCINSGVNKIFVLTQFNSASLNRHISRTYFGNGVSFGDGFVEVLAATQTQGETGMKWFQGTADAVRQFTWVFEDAKNKDIDNIVILSGDQLYRMDYMDLVQNHIERNSDITLSCATVGDSRASDFGLVKIDRRGRVVQFCEKPKGTDLKAMQVDTTLLGLPPQDARLNPYIASMGVYVFKTDVLLRLLRWRYPTSNDFGSEILPAAVMEHNVQAYIFRDYWEDIGTIKSFYDANLALTEEFPKFEFYDPKTPFYTSPRFLPPTKIDNCKIKDAIISHGCFLRECSVEHSIIGERSRLDCGVELKDTLMMGADTYETESEIASLLADGKVPIGVGENTKIRNAIIDKNVRIGKDVVIMNKDGVQDSDRPDEGFYIRSGITIIMEKATIPDGTVI

SEQ ID NO: 22048 - protein, 446 aa, Unknown
  Rhodococcus sp. RHA1
MDTALVWFRRDLRLGDLPTLHTVSESGARALGLFVLDDRLLTTSGGARRDFLFRSLAALDDQLDGRLLVVKGDPVDVVPRVAKKVSAEEVHVSADYGPYGRERDAAVAEHVDLVATGSPYAVAPGRVTKTDGEPYRVFTPYFRQWLEHGWRAPIDTGSATVEWLDPNDVKARRVAIPEPESDGCPAGEAAALQRWAEFCDDDLAGYEDARDRPGLDATSRMSVYLKYGNIHPRTMLRDLARRRSTSAEQYRRQLAWRDFYADILFQRPDSARGNYDRRFDHIRYDSGSDAEEAYTAWCEGRTGFPIVDAGMRQLKAEAWMHNRVRMIVASFFVKDLHLPWWRGARYFMNQLVDGDLANNQHGWQWTAGSGTDASPYFRVFNPTTQGEKFDPDGEYVRRWVPELRGIPGKAVHALKDGRPEDYPPPIVDHAHERQEALARYGEIKAL

SEQ ID NO: 22049 - protein, 321 aa, Streptomyces ambofaciens
MSEIREVVIIGSGPAGYTAALYTARAQLRPLLFGSSIFVGGSLTTTTEVENFPGFPEGVDGPVLMENMRAQAEKFGAEMIDDDIVEVDLTGDIKLLTDSSGTVHRAKTVIIATGSGYRKLGLPNEDELSGRGVSWCATCDGFFFRDRDIVVVGGGDTAMEEATFLTRFARSVTVVHRRSTLRASQVMQNRAFADDKISFAFDSEIAEIKDQDGRLAAVVLRDVLTGATRDLDVTGLFIAIGHAPRTELFKGQLDLDEQGYLAVDAPSTRTNLPGVFAAGDVVDHTYRQAITAAASGCQAALDAERHLAALNDEHALAAVPA

SEQ ID NO: 22050 - protein, 554 aa, Shewanella oneidensis
MFCIQCEQTIRTPAGNGCSYAQGMCGKLAATSDLQDLLIYMLQGVSVYAVKARELGVVDTEVDTFVPKAFFSTLTNVNFDDERIIAYAKQAAQYRESLKNAYEATCEQSGKTAEQMPPVAQLVLGTSKLEMLSQAPISLLNKDKNNIHEDILGLRLLCLYGLKGAAAYMEHARVLGKTDVDIAADFHRIMAFLGEPSVDADKLFSTAMEIGQLNYRIMALLDAGETEAFGHPEPTVVNTKPVKGKAILVSGHDMKDLELILEQTAGKGINVYTHGEMLPALAYPAFKKYPHLVGNYGSAWQNQQKEFANFPGAVVMTSNCIIDPNVGQYSDRIFTRSIVGWPGVVHVTGDDFSVVIEKALSNDGFHYDEIPHNITIGFARNALMAAAPTVVENVKNGSIKHFFLVGGCDGDKSERSYFTDLAKSAPKDSIILTLGCGKYKFNKLEFGDINGIPRLLDIGQCNDAYSAIQLAIALSQIFECDINELPLNLVLSWFEQKAIVVLLTLLSLGVKNIRTGPTPPAFLTANLAKILEDKFGLRNTTTVEADLKTMLNVA

SEQ ID NO: 22051 - protein, 811 aa, Oryza sativa
MASLPHCLSARPLVVAAAPGRPGPGPGPWLPGGARRRNSAFSAGNPGRRVGFRRSVASAVEVGVGEDEEEGVEEEEEEVEAVVMPERYALGGACRVLAGMPAPLGATALDGGVNFAVYSAGASAASLCLFTPDDLEADEVTEEVPLDPLFNRTGNVWHVFIEGELHNMLYGYRFDGMFAPHCGQYFDVSNVVVDPYAKAVISRGEYGVPGPGGDCWPQMAGMIPLPYSTFDWQGDLPLRYPQKDLVIYEMHLRGFTKHSSSNVEHPGTYIGAISKLDYLKELGVNCVELMPCHEFNELEYFSCSSKMNFWGCSTINFFSPMIRYSSGGIRNCGRDAINEFKTFVREAHKRGIEVIMDVVFNHTAEGNEKGPILSFRGIDYSTYYMLAPKGEFYNYSGCGNTFNCNHPVVREFIVDCLRYWVTEMHVDGFRFDLASIMTRGCSLWDPVNVYGSPVEGDMTTTGTPLATPPLIDMISNDPILGDVKLIAEAWDAGGLYQVGQFPHWKIWSEWNGKYRDIVRQFIKGTDGFAGGFAECLCGSPHLYQAGGRKPWHSINFVCAHDGFTLADLVTYNKKYNSSNGEDNRDGENHNLSWNCGEEGEFAGLSVKRLRKRQMRNFFVSLMVSQGVPMFYMGDEYGHTKGGNNNTYCHDHYVNYFRWDKKEESSDLQRFCSLMTKFRKQCESLGLADFPTAQRLHWHGHQPGKPDWSETSRFVAFSTKDETKGEIYVAFNASHLPAVVGLPERPGYRWEPLVDTGKPAPYDFLTDDLPDRATPSTCSLISSTPISTPCSATPPSSLNCSLMIERTKYSIV

SEQ ID NO: 22052 - protein, 513 aa, Populus trichocarpa
MDSLLQSLQTLPMSFFLIIISSIFFLGLISRLRRRSPYPPGPKGFPLIGSMHLMDQLTDRGLAKLAKQYGGLFHMRMGYLHMVAGSSPEVARQVLQVQDNMFSNRPANIAISYLTYDRADMAFAHYGPFWRQMRKLCVMKLFSRKRAESWESVRDEVDSMVKTVESNIGKPVNVGELIFTLTMNITYRAAFGAKNEGQDEFIKILQEFSKLFGAFNISDFIPWLGWIDPQGLTARLVKARKALDKFIDHIIDDHIQKRKQNNYSEEAETDMVDDMLTFYSEETKVNESDDLQNAIKLTRDNIKAIIMDVMFGGTETVASAIEWAMAELLKSPEDIKRVQQELADVVGLERRVEESDFDKLTFFKCTLKETLRLHPPIPLLLHETSEDAEVAGYYVPKKTRVMINAYAIGRDKNSWEDPDSFKPSRFLEPGVPDFKGNHFEFIPFGSGRRSCPGMQLGLYALDLAVAHLLHCFTWELPDGMKPSELDMTDMFGLTAPRATRLVAVPRKRVVCPL

SEQ ID NO: 22053 - protein, 559 aa, Bacteroides thetaiotaomicron
MCGIAGILNIKTQTKELRDKALKMAQKIRHRGPDWSGIYVGGSAILAHERLSIVDPQSGGQPLYSPDRKQALAVNGEIYNHRDIRARYAGQYDFQTGSDCEVILALYKDKGIHFLEEISGIFAFVLYDEEKDEFLIARDPIGVIPLYIGKDKDGKIYFGSELKALEGFCNEYEPFLPGHYFYSKEGKMKRWYTREWTDYESVKDNDAKVSDVKEALEDAVHRQLMSDVPYGVLLSGGLDSSVISAIAKKYAAKRIETDGASDAWWPQLHSFAIGLKGAPDLIKAREVAEYIGTVHHEINYTVQEGLDAIRDVIYFIETYDVTTVRASTPMYLLARVIKSMGIKMVLSGEGADEVFGGYLYFHKAPTPKDFHEETVRKLSKLHMYDCLRANKSLSAWGVEGRVPFLDKEFLDVAMALNPKAKMCPGKEIEKRIVREAFADMLPESVAWRQKEQFSDGVGYSWIDTLREITAAAVSDEQMEHAAERFPINTPLNKEEYYYRSIFEEHFPSESAARSVPSVPSVACSTAEALAWDVAFRNLNEPSGRAVRGVHEEAYAEEVK

SEQ ID NO: 22054 - protein, 613 aa, Unknown
  Rhodococcus sp. RHA1
MCGIAGWISFERDLRVEQSTVDAMAETMNCRGPDDRGTWVVERAALGHRRLAIIDLPGGHQPMSVDTPGGTVAMVYSGEVYNFGELHEELYRRGHRFATDSDTEVVLHGYLEWGEAVAERLNGMYAFAIWDSRTDTLVMIRDRMGIKPFYYYETRDGVLFGSEPKAILANPIAESTVTMDGIRELFAFVKTPGHAVWDGMREVEPGTVVTVSRTGLRTHRYWTLQTRPHTDDRDTSVAHVRELLDDIVRRQLVADVPRCTLLSGGLDSSAMTGIAAEQLAEVGETVRTFAVDFVGQTEHFVADELRGTPDTPYVHDVARRSRTAHQDIVLDSDALADPAVRAKVIRARDIPMGLGDMDASLYLLFKAIRQHSTVALSGESADEVFGGYKQFFDPKAQQANTFPWLVQFAEHFGDESNIFTPEVTAGLNMDDYVQDSYDAAVSGIDRLDGESDFEWRMRKICYLHLTRFVRVLLDRKDRASMAVGLEVRVPFCDHRLVEYVYNTPWSLKTFDGKEKSLLRAATRDVLPQSVIDRVKSPYPSTQDPKYAVALQQHGKDLLSDPSHPVFGLVSADWLSRAVSVDTPQISQVSRRGLERTLDLALWMDMYNPTIKLS

SEQ ID NO: 22055 - protein, 381 aa, Bartonella henselae
MKVDYYEILGVTRECDDKKLKSAFRKLAMQYHPDRNAGDKEAERKFKEIGEAYEVLKDPQKRAAYDRFGHAAFENNNNGGGSPFSGFSAGGFADIFEDFFGEIMGGGHRKRSDGRERGADLSYNMEVTLEEAFSGKTAQINIPSSVVCDACEGSGAKKGSKPQTCGTCHGAGRVRAAQGFFSIERTCPVCHGRGETIKDPCPKCQGTRRVEKNRSLSVNIPAGIEDSTRIRLSGEGDAGIRGGPSGDLYIFLSVKPHEFFQREGADLHCRVPISMVTAALGGEFEVSDLDGIKARVKIPEGTQNGRQFRLKGKGMPMLRRQQVRGDLYIHITIETPQKLTQEQRELLQKFEKLSNHENSPQSHGFFSRMKEFFENISGKNE

SEQ ID NO: 22056 - protein, 141 aa, Triticum aestivum
MRLPSPYTGVFRGGSTARTGPHALPLARIKKIMKRSARDGSGGDGAGARMISCEAPVLFSRACELFVAELTRAAWDATLEGRRRTVHAEDVAAAVRDTNVFDFLVDVVKARPSDDGVNAGDGEGGVAPAVGVHGGMQGRRL

SEQ ID NO: 22057 - protein, 272 aa, Haloarcula marismortui
MRLTLAQTDVSSDSVTENVSRATTAIRDAAAEGADLVVLPELFSIGYFAFDRYAREAEGLNGETLSQVRSVAADHDVAVLAGSVVEDLAASADSGFDVPADEGLANTAVFFDRDGERRAVYRKHHLFGYDSAESQLLEPGETVPTVDFEEFTIGVTTCYDLRFPELYRHLVDEGVTLTLVPSAWPYPRVEHWKLFGRARAVENQLYVAAANGVGQFEEAELLGRSTVYDPWGTTLASADDHPALVTATLDPARVEQVREEFPALADRRTDWP

SEQ ID NO: 22058 - protein, 173 aa, Triticum aestivum
  misc_feature (107)..(107): Xaa can be any naturally occurring amino acid
  misc_feature (115)..(115): Xaa can be any naturally occurring amino acid
  misc_feature (124)..(124): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGXYYDGRYWXTMWKLPMFXGCTDATQVINEVEESKKEYLTRIPHHRIDNMRKCSASLIANNGLQDPEG

SEQ ID NO: 22059 - protein, 846 aa, Unknown
  Frankia sp. EAN1pec
MPGTPRQHIVVVGNGMVGQRFVETLRQRDTGGRFSITVVGEEPRRAYDRVALSSYFDGVSADELDLVAAGIYDSPHATLHLDESVTAIDRAASTVTTSRGRTLGYDVLVLATGSYPFVPPVPGRDLEGCFVYRTLDDLDAIRAAATAAAEHTRGRRAGLVVGGGLLGLEAARALRLLGMSPHVVELAPRLMPLQVDEPGGAVLRRLIERLGVTVHTATSVAAVEPSGGRLLATLANGTELDLDVVVFSAGIRPRDQLARECGLAVGPRGGVAVDARCRTTDESIYAIGECAVVDGHVYGLVAPGYDMASVVAEQLLGRDATFTGADLSTKLKLLGVDVASFGDALAATAGALEVRVENAVENTYAKIVVSDDASTLLGGILVGDASRYAALRPLVGRRLPADPVAMIAPTGGVDLDAGALPREAQICSCNDVSKGAILDSIVEHGLTDVAGIKACTRAGTTCGSCVALLKPLLAEAGVEVGTGLCEHFDVTRAELFEIARSQRIGTFTELVQRHGRGRGCDTCKPAVASILASLGHGYVLDGEQAALQDTNDHFLANLQKNGTYSVVPRIPGGEITPEKLIVIGEVARDFGLYVKITGGQRVDLFGARVEQLPLIWRRLVDAGMESGHAYGKAMRTVKSCVGSTWCRYGVQDSVGLAIDLELRYRGIRGPHKIKAGVSGCARECAEAQSKDIGVIATDTGWNLYVGGNGGARPRHADLFLTSVDTETLVRTIDRFIMFYARTADRLQRTSTWVESLSADGQDGLAYLRGVLVDDSLGICAELDAAMESHVAHYSDEWADTLADPERLRRFVSFVNAPEVPDPSIQWAPERGQIKPLIAGPTLEVVS

SEQ ID NO: 22060 - protein, 402 aa, Bradyrhizobium japonicum
MPIREVDMARKRIGILTGGGDVAGLNAVIKSVTYRGSEDDIEVVGLRRGWEALTHLNLDDPNSRSHYVIPLNRENTRTIDRRGGTVLHSSRVNPSKIQKLPGHLVGNEVPVSLSTNGGIATKTWDLTSRVLANLSGLGIEHLIAIGGDDTLSYAAKLNELGVKIIAIPKTMDNDVRNTEYCIGFSTAITRASDAIQRQRTTVGSHERIGIFRVFGRDAGFTALYTAYATSIRCLIPEHKVDLDKLIQLLIEDKRANPSNYALIVLSEGAQWEGYKLREYGEPDAYGHRKKANVAESLADEIKQRTGEETITSDLTYDLRSGDPDFIDKLVALTFGNMAYDAMLESKTGLMSALVEGRYDLVPIPDAKLGPRKLDVASSYNTERYRPIYANKQGLPIFLNRAS

SEQ ID NO: 22061 - protein, 1370 aa, Unknown
  Frankia sp. EAN1pec
MTTKVALDRVRTVCAYCGVGCGIVLEVDRSGDSPRVVRSTGDPDHPANRGRLCTKGATTAELLNAPGRLTTALARAGHDEEPAPIDVDTALDLAAARLAALRDEHGPDAIGIYTSGQLSIEAQYLITKLAKGFLRTQYQECNSRLCMASAASGYKLSLGADAPPGSYDDFDHADVFLVIGANMADCHPILFLRMMDRVKAGAKLIVVDPRRTATADKADLFLQLRPGTDIALLNGLLHLLHASGAVDESFVAAHTEGWAAMPDLLAGYDPATVADITGVPEDDLRAAAALIAAAGSWMSCWTMGLNQSTHGTWNTNALINLHLATGAICRTGSGPFSLTGQPNAMGGREMGYMGPGLPGQRSLLDPADRAHIEQLWGLPADTIRADHGNGTIGMFEQMSAGAIKAAWIICTNPVATVANRRTVIEGLETAEFVLVHEAFTETETTGYADVVLPAAVWAETDGVMVNSERNLTLTRPAADPPGQARADWQLIAGIATRLGYADHFTYNSAQEVFDELRQAWNPVTGWDLRGITHGRLRDGPMQWPAPPGAGARNPIRYMTDDGPRFPTPSGRAKFWPRPHVDPQEIPDEKYPYLLNTGRLQHQWHTLTKTGRVGRLNKLNPAPFIEIHPDDAAALGISEGDQVEVSSRRGRAVLPAAVTDRVQPGNCFAPFHWNDMFGEYLAVNATTSDAVDPVSLQPGFKASAVALTRVHTPTPAQPPPTLVDDVLHADAVASAAPIASLLGLGGTAAPPALNDDESVYLAGFVAGLGLDLARGALTSVPTLPPSAPVTARTALWVNGALAGLWSRLPAEGREILPGRGVSPREDPPGTGGRRVLLGWASQTGNAERVAEQAEARLTESGTVVTTLPLNEIDHIAPHTDLVVVTSTFGDGESPDNGSEFLARLRARSMPLDDVRFSVIALGDSSYSDFCGHGRRIDELLAELGGLRLADRVDCEPDFDEAARAWLDRVLAARAGASPTRPEPVPVPVPPVSRLPGASSGPRVSETHRVILAGNRLLSGVGSAKEVREFLIDLEDSDLTYETGDVLVVRPSNRAELVDEWLSTTGLRGDTIVELLQFGRTELAVALRDHLEIAKPSRAFLAFVAERSGSRHLQRLLRGDRADLDGWLWGRQTVDVITETGTHASAQEWCELLKPLRERRYSISSSAEVSPRQIRTLVSVVRYNAPSGAARTGVASAFLADAPAGTPLKVAVARSSGFAPPSDPETPTIMIGPGTGLAPFLAFLDTRRARGHTGRNWLFFGEQRRATDFYYSDELAEFARSGLLTRLDTAFSRDQRAKIYVQDRMRERGAPLWQWLREGAAVYVCGDAARMARDVDTALRDVVAKHGDLNAAQAGDYVRQLITDGRYLRDVY

SEQ ID NO: 22062 - protein, 465 aa, Yersinia pseudotuberculosis
MSDQQEGAELKRGLKNRHIQLIALGGAIGTGLFLGIAQTIKMAGPSVLLGYAIGGFIAFLIMRQLGEMVVEEPVAGSFSHFAYKYWGHFAGFASGWNYWVLYVLVAMAELTAVGIYVQYWWPEIPTWVSAAVFFLAINAINLANVKVYGEMEFWFAIIKVIAIIAMILFGGYLLISGRGGPEATVTNLWAQGGFFPNGIMGLVMAMAVIMFSFGGLELVGITAAEAEDPAKSIPKATNQVIYRILLFYIGSLAILLSLYPWGKVVEGGSPFVLIFDALDSNSVATVLNIVVLTAALSVYNSCVYCNSRMLFGLAKQGNGPKILLKVDGRGVPVIAIAVSAFATAFCVLINYLLPGRAFELLMALVVSALVINWAMISLAHLKFRAAKNRQGVIPKFKAFWYPFGNCLCLLFLTGILVIMFLTPSIRISVILIPVWVVVLAIGYILKNQSQRQNQQLSASSRKATK

SEQ ID NO: 22063 - protein, 825 aa, Hordeum vulgare
MAFSPRSPWSRSKKPDIYSTVVVHDDEDDAHGGGAARAEDDDDDDPSALPPLLQRLPKDFGGASFDDDDDPYSSDLDDASLSATVVIKRGAPASTSSSSRSPFLDLRRSSPRAAEADPYSTFVVHGTARSGGASSPRESVSGTFIRHSGGPPSPRESVSGTFIRHTRGSSSPRESYSGTFIHHTSGASSPRDPASGAGAGFGSSFMTPSTGQAEEDRQPSLLMQQQQSRRQASMSSVPDSVTREDPSTKYELLHELGKGSYGAVYKARDLRTQELVAVKIISLTEGEEGYEDIRGEIEMLQQCSHPNVVRYFGSYQGEEYLWIVMEYCGGGSVADLIGITEEPLDEPQIAYICRETLKGLAYLHTIFKVHRDIKGGNILLTEQGEVKLGDFGVAAQLTRTMSKRNTFIGTPHWMAPEVIQESRYDGKVDVWALGVSAIEMAEGMPPRSTVHPMRVIFMISSEPAPMLEDKEKWSLLFHDFIAKCLTKDARLRPAAIEMLKHKFIEKCNTGASKMLAKIKEAKIIRETAVQNQLPDSDDAMDATVRINEDYGETVPTNSQSTHETKNDGSGGDFGTMIVHPEDGDEAVESSIFPRAEFIPGLGSINSFTHDPKRAELISKFWAENTADSDATKGRDLDGLPDTQEPKAMPRSIGTFKHHKGVEGTVLRHDNTASPGVASTMTKLSSSPSRKAFSVQDKLWSIYAAGNTVPIPFLKAIDISPLALVSDSVAGNGPAGSSTTDALEAVRELFSGDGQAKKGRKGQNEVPLPPGVHDRLTTSPTLMNLAQALAYHKTCYEDMPLQDSQATEEQQTIQNLCDTLRTILRL

SEQ ID NO: 22064 - protein, 529 aa, Arabidopsis thaliana
MAASPKIGIGIASVSSPHRVSAASSALSPPPHLFFLTTTTTTRHGGSYLLRQPTRTRSSDSLRLRVSATANSPSSSSSGGEIIENVVIIGSGPAGYTAAIYAARANLKPVVFEGYQMGGVPGGQLMTTTEVENFPGFPDGITGPDLMEKMRKQAERWGAELYPEDVESLSVTTAPFTVQTSERKVKCHSIIYATGATARRLRLPREEEFWSRGISACAICDGASPLFKGQVLAVVGGGDTATEEALYLTKYARHVHLLVRRDQLRASKAMQDRVINNPNITVHYNTETVDVLSNTKGQMSGILLRRLDTGEETELEAKGLFYGIGHSPNSQLLEGQVELDSSGYVLVREGTSNTSVEGVFAAGDVQDHEWRQAVTAAGSGCIAALSAERYLTSNNLLVKFHQPQTEEAKKEFTQRDVQEKFDITLTKHKGQYALRKLYHESPRVILVLYTSPTCGPCRTLKPILNKVVDEYNHDVHFVEIDIEEDQEIAEAAGIMGTPCVQFFKNKEMLRTISGVKMKKEYREFIEANK

SEQ ID NO: 22065 - protein, 1820 aa, Anabaena variabilis
MNRQHKHHRCNPVNFLSKQNLLPFLLGIVILLVVVMLWLRLQAEEEIKIQQLIKQQAIATQTELVTQLKTRILALKRIGKHWEMHGSIPQAQWELEARAYLEDYGGYQAIKLVDPSWQVLRSVSVAKNKAAENLEIMPKFPQCKGATAQPSHETTLTHTVNLNQGDRVFFACVPLWMGDKFGGAVLGIFQVKQFFESVLHIAPGYKIRVFDGQELIYGQDRQSSTLPSWQQSVNINFDGMTWQLQIYPTPELLKDLYSPLPTVVLVAGIFNAGAVTLLIYFAQATKLSNHQIGRINQELADRIEKQTQVEIALRASENRLRELLETVRVIPWEVDLKTQHFTYVGPQAETLLAYPIAQWYEENFWDNHLHPHDRDWAVRFCQEAANKGQNHELEYRMLAADGRVVWLRDVVNVVEVDGTPVMLRGFMFDITDLKRVEETLRLRERALAASSNGIVISDAKLPNYPVIYVNSAFEQITGYKATEIVGRNCRFLQGNDTTQPAIEELRSALKAGKNCKVILRNYRKDGSLFWNQLSVSPIYNDNGQLSHFIGIQTDISDRQQAEASLRRQALTFENIYDGVIITNLQGQILDWNPAAERMFGYSKDHICGQSISILHKVEEDAALNSAIIAEITKQGRWSGEINFVRQDGSQGICETTIVALQDDQGQTVATISVNRDITERKHAELLLRRSEERFQAFMNHSPTPAWITDIDGTIVYLSETYRRTFQLPTQELIGTNIFDIYPPELIQTFRETIQIVARTHQVMETVESVPCSDGTVRDFLVYKFPISSKPDECLIGGIAIDITERKQAEAALRKSEERWQLVIEGNQDAIWDWNIITNETFRSARWAELIKEQNYQPIADHADCISRIHPDDYERVMAVRQDCLSRKIPNYVVEYRLRCNDDSYKWVLVHATGQWDERGNPVRMVGSIKDITERIEAQEALQRQLHRTLLLEKITQKIRQSLDSKEIFETAATQIGQALAVDRCLIHSYISHHDPHIPLVAEYNNVLDYCSMQKWEFTTTGNRHILQMMSQDKAIASANVYTDPLLQTAVPSCCEIGVKSMLAVRTSYQGEPNGAICLHQCKYFRQWTPEEIELLEAVAAQLGIALAQAQLLEQETRQREELTIKNFALEQAKRAAEAANRAKSEFLAMMSHEIRTPMNAVIGMTGLLLDTELTSQQRDFVETVLTSGDALLSIINDILDFSKIESGKLELEEQPFEVRTCVEQVIDLLAAKAAQKDIELAYLIHPQVPMQIAGDLTRLRQILTNLLNNAIKFTPEGEVVVSVRSQPSPNQKTKNCCEIIFTIKDTGIGIAPETMDLLFQPFVQADASMTRKYGGTGLGLVISKRLGEMMGGYLWVESRGCVGGNPPPGWQRKNSISSASVATGSTFYFSMTVPVVAHADLETSITSPVQLSGKRLLIVDDNPTNRQILRLQAEPWQMETYTAPSGAEALALIDQGMAFDIAILDVQMPEMDGLTLARQIRQRPSYQHLPLVILTSWGQPDTDLSDIEFAACLNKPIKQSQLFDVLAASLGNQPIRASVVPDRSAQVNSCLAQQIPLRILLAEDIVVNQKVALLILKKLGYRADVVANGLEVLEALQRQSYDVVLMDVNMPEMDGLKASQIICQTWSPRSRPYIIAMTANAMRGDREACLAAGMDHYISKPLQLEELAKALGKCHPSTSSTEKALEKTSSQNQTFTDISDLKFATIDTKILQALRDMLGGDKVAFAELINCYLTESPKLIENLNVAINTEDTQGIWKTAHKFKSSSGSVGAVFLAQLCKLLEAKGRNNNLEGCIELGSQLCQEYELVKTALYREVNKETP

SEQ ID NO: 22066 - protein, 699 aa, Unknown
  Shewanella sp. ANA-3
MNPIVKSFEYGQHTVTLETGVIARQADAAVLASMGDTTVLVTVVGKKEAEAGRDFFPLTVNYQEKTYAAGKIPGGFFKREGRPSEDETLIARLIDRPIRPLFPNGFTNEVQVIITVVSVDPQIEPDIISMIGTSAALAISGIPFSGPLGAARVGYINGEYVLNPTVTQLESSQLNLVVAGTESAVLMVESEAQALPEEVMLGSVVYGHDQQQVVIKAIAEFKAEAGKPAWNWTAPVANEALVAQVKELAEDGLAQAYQIQVKQDRYAQVAVVKAAAKEALLAANPDVDLREVDGLLGSLEKKVVRGRIIRGEPRIDGREPDMVRALSVLAGVLPRTHGSALFTRGETQALVTCTLGTERDAQKIDSIMGERTNRFMLHYNFPPYSVGETGMVGSPKRREIGHGKLAWRGINAVMPTAEEFPYSVRVVSEITESNGSSSMASVCGTSLALMDAGVPIKTSVAGIAMGLVKEGDNFVVLSDILGDEDHLGDMDFKVAGTRDGVTALQMDIKIEGITKEIMEIALQQAYGARVHILNVMDQAIGSHRDDISDHAPRITTIKINPEKIRDVIGKGGAVIRALTEETGTTIELEDDGTVKIASSNGDATREAIRRIEEITSEVEVGRIYNGKVIRIVDFGAFVNILPGKDGLVHISQISDERVANVSDHLELNQEVTVKVMEVDRQGRVRLSIKEAQTKEAAAE

SEQ ID NO: 22067 - protein, 382 aa, Ashbya gossypii
MQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGAL

SEQ ID NO: 22068 - protein, 234 aa, Arabidopsis thaliana
MDPDTVKSTLSNLAFGNVLAAAARDYKKEVLANEKAQGSRPVNEEVDLDELMDDPELEKLHADRIAALRREVEKREAFKRQGHGEYREVSEGDFLGEVTRSEKVICHFYHKEFYRCKIMDKHLKTLAPRHVDTKFIKMDAENAPFFVTKLAIKTLPCVILFSKGIAMDRLVGFQDLGAKDDFSTTKLENLLVKKGFFTGMLSEKRKEEDEEDYEYQESIRRSVRSSANVDSDSD

SEQ ID NO: 22069 - protein, 962 aa, Idiomarina baltica
MTSTTLTQLEHHDEFIGRHIGPSHDEQQAMLKELGVDTLEALTKDTVPGSILRDPFLKVGEPKTEREALAELKAIAKKNQIFTSYIGMGYYDTVTPNVILRNVLENPGWYTAYTPYQPEIAQGRLEALLNFQQMTMDLTGLDLASASLLDEATAAAEAMAMAKRVSKNKKSNAFYIADNVYTQTIDVVKTRAEYFGFDIIVGPAREASDHDVFGALLQYPDKTGELHNIEQLIGELQEKKAIVSVASDLMSLLMLKSPGEMGADIVFGNAQRFGVPMGYGGPHAAFFATRDKFKRSLPGRIIGVSKDSRGRPALRMAMQTREQHIRREKANSNICTAQVLLANMASFYAVYHGPQGLRRIANRIHRLTDIVALGMQDKGVQISNAHWFDTLTFEMKENATDVLARAKAAGINLRNDGEAVFGISMDEAKTRADVEVLFNVLFGDDHGLDVEVLDSRVASKEVESIPAQLVRESDYLTHPVFNEYHSETEMLRYIKKLENKDLALNHSMISLGSCTMKLNATAEMIPVTWPEFAQLHPFCPVEQAQGYAEMISSLSEWLVDITGYDALSMQPNSGAQGEYAGLLAIQKYHESRGEGHRNICLIPSSAHGTNPASAQMMNMKVVVVDCDKNGNVDMADLKAKAEEAGDHLSCIMVTYPSTHGVYEEGIREICELVHEFGGQVYMDGANMNAQVGVTSPGYIGSDVSHLNLHKTFCIPHGGGGPGMGPIGVKEHLKPFLPNHSIINLKTTELGNGAVSAAPYGSASILPISWMYIAMMGGRGLREASETAILNANYVAEKLSKHFKILYRGRNNRVAHECIIDLRQMKEDAGIAEIDVAKRLQDYGFHSPTMSFPVAGTIMVEPTESESKAELDRFIEALVCIKQEADKIAAGEWPQDNNPLVNAPHTLADITDAEWDRPYDRHTATYPVEAVSYDKFWPTVNRIDDVYGDRNLMCSCPSIEEYR

SEQ ID NO: 22070 - protein, 858 aa, Arabidopsis thaliana
MSRKRTENGSESGPATSHVPVDRFGFLKQEHANSPERFSKSKTTSSTDHDREERKVRKWRKMIGVGGSDWKHYVRRKPNVVRRRIRKGIPDCLRGLVWQLISGSRDLLLMNPGVYEQLVIYETSASELDIIRDISRTFPSHVFFQKRHGPGQRSLYNVLKAYSVYDRDVGYVQGMGFIAGLLLLYMSEEDAFWLLVALLKGAVHAPMEGLYHAGLPLVQQYLFQLESLVKELIPKLGEHFTQEMINPSMYASQWFITVFSYSFPFPLALRIWDVFLSEGVKIVFKVGLALLKYCQDELVSEVYLRAVKLPFEKLIHALKTFPEDAMNPDTLLPLAYSIKVLFRFRKVNVLVSKRLEELTLEYQKTNAKPAPRLRYRDSSPRVIRFNGTRMEMLAPTDSNKSVNEIMMESKGGKKKSSSSSSLFYEAPLGYSIEDVRPNGGIKKFKSSVYSNVSFLYNAISDFFNLYAPFLLVPGSNRSLLLLQVLSLTQQGEMALSAIGFEGYEKRLEVTFFEPSIFQDSKGLGLRALTKSQLDEILTPAACTIVSSLSNDQLDSYVLSESSFFVYPYKVIIKTCGTTKLLLSIPPLLKLAGELSLSVKSVKYTRGSFLCPGGQPFPHRSFSEEVSVLDGHFTQLGLNSVAYLMGNDDETKKWHVYAASAQDSSNCNNNVYTLEMCMTGLDREKAAVFYKDEADKTGSMTDNSGIRKILPKSEICDFEFEPCGYSMNSIEGDAISTIHVTPEDGFSYASFEAVGYDFNTLDLSQLVTRVLSCFEPKQFSVAVHSSVGANSYKPEITVDLEDYGCRERTFESLGEESGTVMYQTFEKLGKYCGSPRSTLKCEWSSNNSCSSEDEKDEGI

SEQ ID NO: 22071 - protein, 105 aa, Arabidopsis thaliana
  misc_feature (34)..(34): Xaa can be any naturally occurring amino acid
RGRVFFNFHRKDVAMQGLQEQSGTTHFEAGDARXAKEYVSLLKSTDPIGFDTVNVLGWGSIGHSVAYYIWATSSNEAAQACLHDSFQCRSLVHANEYACLVEQAI

SEQ ID NO: 22072 - protein, 479 aa, Leuconostoc mesenteroides
MSEHKGHIQRNLKTRHVSMIALGGSIGTGLFVASGATVAQAGPLGAIVAYLAIGVMVYFLMTSLGEMATYSPTSGSFSDYAGKYVDPALGFAMGWNYWFNWAITLAVDIVAVGLVAEFWFPNTPGWIFSAIALLLIFLINIFSVGTFGEAEFWLSMIKVVTIIAFLIVGLATIFGVIHSDINVMKNLSVGNHGFVGGPQAILSVFVVAGFSFQGTELIGITAGEAEDPDKSVPKAINQVFWRILLFYILAIFVISALVYYKDPRLLSSSTQNIAVSPFTIVFKNAGIAFAASLMNAVILTSIVSSANSGSYASTRMLYAMARKGDAPKIFAKLSTRGVPVAALVLTTAIGLLAFIANTKGGSVAYTWLVNASGLTGFIAWVGIAISHYRFRRAYVAQGKSLSDLKYKAKWFPFGPLFALVISIGVIIGQDPDSFAHLNWEKIFVTYLSVPLFVILYFWYKVSHKTKLIALKDVDLKQYK

SEQ ID NO: 22073 - protein, 394 aa, Arabidopsis thaliana
MPTFSAAALGRSLNSGTSLSSKFPSTLQSKPSILNDESKQPKEKTFTRPQMSPSLYATTKEIPHPNSPSSYPPSPYIINHKARGPVLFNRDSEVDGPSHPITSGEEKISGNVDVEATASLSKSTSLSFPITEAIAVDHTNGVHTQGIHERPVWDCSPPLGTFLNEKSGRDISNGGIGSNNATSNLEWQSYLLEPVRIKADKELEPENFYNPGELVSFTSNTEVEDFERAESSHSLATHVGEFYDACDELSTDSGMQSSANNIESEVREMRLGLLMEIERRRQAEATLEQMQVHWRRLRDQLADVGMFLPLDPTRSQYSMNLADELRCQLEVTRFVSDTLGSDLAKTEVEMEMEAELEAKNFEITRLSDRLHYYETVNQEMSQRNQEAIGRRNSS

SEQ ID NO: 22074 - protein, 175 aa, Glycine max
MAVSVSASSAIASLNSELSTRLPPSLASASSSAKQSFLQFPSCTRLLRISTPRAPAPSRPRFLPLVQAKKQTYNSFDDLLANSEKPVLVDFYATWCGPCQFMVPILNEVSTRLKDKIQVVKIDTEKYPSIADKYRIEALPTFIMFKDGEPYDRFEGALTADQLIERIEAGLKVKQ

SEQ ID NO: 22075 - protein, 628 aa, Lactobacillus reuteri
MQANIKWLDEPETFRVNQLPAHSDHYYYGNYDEWRHNNSRFAQNLDGQWQFNFAENPRKRENDFYKVDYDSSSFGTIEVPSEIELNNYAQNNYINTLIPWEGKIYRRPAYALSPDDAQEGSFSDGDDNTVGEYLKHFDLEPSLRGKQIRIRFDGVERAMYVWLNGHFIGYAEDSFTPSEFDLTPYIQDEGNVLAVEVFKHSTASWIEDQDMFRFSGIFRSVNLLAQPLVHVEDLHIRPIVTDNYQDGIFNVDLQLHGEKTGNVNVRVIDNDGNTLVNETHPVDSTVKVQDQFLENVHLWDDHDPYLYQLLIEIRDDEGNLVELVPYRFGFRRIEINKDHVVLLNGQRLIINGVNRHEWNAKRGRAITMDDMTSDIHTFKENNINAVRTCHYPDQIPWYYLCDDNGIYMMAENNLESHATWQKMGAIEPSYNVPGSVPQWRDVVVDRARTNYETFKNHPSILFWSLGNESYAGDNIVKMNEFYKKHDDSRLVHYEGVCHTPEYRYRISDVESWMYLPPKEVEEYLKNNPDKPFMECEYMHDMGNSDGGMGSYISLLDKYPQYFGGFIWDFIDQALLVKDPVSGQEVMRYGGDFDDRHSDYEFSGDGLMFADRTPKPAMQEVRYYYGLHK

SEQ ID NO: 22076 - protein, 277 aa, Chlamydophila pneumoniae
MESQSCKLTIKDLMSAGAHFGHQTRRWNPKMKLYIFEEKNGLYIINLAKTLQQLRNALPHIRKVIQDNKTVLFVGTKKQAKCVIREAAIEAGEFFIAERWLGGMLTNMTTIRNSIKTLDKIEKDLSRNQAYLTKKEAALLAKRHQKLLRNLEGIRYMKKAPGLLVVVDPSYEKIAVAEAKKLGIPVLALVDTNCDPTPIDHVIPCNDDSLKSIRLIINVIKENIIEAKHKLGIEIVSPVKSLEVPDLSAFESSQDDESDEENREEDLLAKKFDGEAN

SEQ ID NO: 22077 - protein, 295 aa, Staphylococcus pasteuri
VLGVSKSASKDEIKKAYRKLSKKYHPDINKEEGADEKFKEISEAYEVLSDDNKRANYDQFGHDGPQGGFGSQGFGGGDFGGFSGGGFEDIFSSFFGGASRQRDPNAPRKGDDLQYTMTITFDEAVFGGKKEISIRKDVTCHTCDGEGAKPGTKKKTCSYCNGAGSVSVEQNTILGRVRTEQVCPKCEGSGQEFEEPCPTCHGKGTENKTVKLEVTIPEGVDNEQQIRLAGEGSPGVNGGPSGDLYVVFRVKPSEVFKRDGDDIYYDLNISFPQAALGDEVKIPTLNSNVVLTIPS

SEQ ID NO: 22078 - protein, 349 aa, Zea mays
MGGLTMDQAFVQAPEHRPKPIVTEATGIPLIDLSPLAASGGAVDALAAEVGAASRDWGFFVVVGHGVPAETVARATEAQRAFFALPAERKAAVRRNEAEPLGYYESEHTKNVRDWKEVYDLVPREPPPPAAVADGELVFDNKWPQDLPGFREALEEYAKAMEELAFKLLELIARSLKLRPDRLHGFFKDQTTFIRLNHYPPCPSPDLALGVGRHKDAGALTILYQDDVGGLDVRRRSDGEWVRVRPVPDSFIINVGDLIQVWSNDRYESAEHRVSVNSARERFSMPYFFNPATYTMVEPVEELVSKDDPPRYDAYNWGDFFSTRKNSNFKKLNVENIQIAHFKKSLVLA

SEQ ID NO: 22079 - protein, 293 aa, Staphylococcus vitulinus
VLVFQDASKDEIKKAYRKLSKKYHPDINQEEGADAKFKELSEAYEVLSDENKRAQYDRFGHNGPQQGSGGSQGFGGQDFSGFGGFEDIFGSFFGGGGARRDPNAPRQGDDLQYSMTLTFEEAVFGTEKDITVRKDVECDTCHGNGAKPGTKKKTCTYCSGQGHVTVEQNTILGRMQTQKVCPECEGSGQVFEEKCSDCHGKGTQNKKVTITVKVPEGVDNDQQIRLAGKGGPGINGGPAGDLYVVFRVKPHSNFRREGDDIFYDLNLSFPQAALGDEITVPTLTGNVSLSVPA

SEQ ID NO: 22080 - protein, 432 aa, Nicotiana sylvestris
MAQILAPSGEWQMRMTKSSTDANPLTSKMWSSVVLKIIKELAVKSSAKFRFFALESDSGTVNQSEQLLNLDVTPYTDKIIAEYIWIGGSGIDMRSKSRTISKPVKHASELPKWNYDGSSTGQAPGEDSEVILYPQAIFKDPFRGGNNILVICDAYTPAGEPIPSNKRHKAAQIFSDSKVVSEVPWFEIEQEYTLLQQNVKWPLGWPVGGYPGTQGPYYLCAGADKSFGLDISDAHYKACLYAGINISGTNGEVMPGQWEFQVGPSVGIEAGDHIWCARYILERITGQAGVVLSLDPKPIEGDWNGAGCHTNYSTLSMREDGGFEVIKKANLNLSLRHKEHINAYGEGILEKLTGNHETASIDKFSWGVAFRGASIRVGADTEKQGKGYLEDRRPASNMDPYVVTGLLAETTILWEPTNEAEALAAQKLALKV

SEQ ID NO: 22081 - protein, 290 aa, Staphylococcus saccharolyticus
VLGVSKSASKDEIKKAYRKLSKKYHPDINKEEGADEKFKEISEAYEVLSDDNKRANYDQFGHEGPQGGFGNQGFGGGDFGGFEDIFSSFFGGGSRQRDPNVPRKGDDLQYTMTVNFEEAVFGTKKGISIRKDVTCHTCNGEGAKPGTSKKTCSYCNGSGRVSVEQNTILGRVRTEQVCPKCEGSGQEFEEPCPTCHGKGTENKTVKLEVTVPEGVDNEQQIRLAGEGSPGTNGGPHGDLYVVFRVQPSDTFERDGDDIYYNLNISFSQAALGDEIKIPTLNSNVVLTIPA

SEQ ID NO: 22082 - protein, 542 aa, Oryza sativa
MGNQCQNGTLGSDYHNRFPREHAVGYVQGDSYLDLKKFDDTWPEVNNFKPTAASILRRGLDPTSINVLGRKTADLREHYIIGRKLGQGQFGTTYLCTEINTGCEYACKTIPKRKLITKEDVEDVRREIQIMHHLSGHKNVVAIKDVYEDGQAVHIVMELCAGGELFDRIQEKGHYSERKAAELIRIIVSIVAMCHSLGVMHRDLKPENFLLLDKDDDLSIKAIDFGLSVFFKPGQVFTELVGSPYYVAPEVLHKRYGPESDVWSAGVILYVLLSGVPPFWAETQQGIFDAVLKGHIDFQSDPWPKISDSAKDLIRKMLSHCPSERLKAHEVLRHPWICENGVATDQALDPSVISRLKQFSAMNKLKKLALRVIAERLSEEEIAGLREMFKAVDTKNRGVITFGELREGLRRFGAEFKDTEIGDIMEAAHNDNNVTIHYEEFIAATLPLNKIEREEHLLAAFTYFDKDGSGYITVDKLQRACGEHNMEDSLLEEIISEVDQNNDGQIDYAEFVAMMQGSNVGLGWQTMESSLNVALRDAPQVH

SEQ ID NO: 22083 - protein, 296 aa, Staphylococcus saprophyticus
VLGVAKSASKDEIKKAYRKLSKQYHPDINKEEGADEKFKEISEAYEVLSDENKRANYDQFGHDGPQGGFGGQGFGGQDFSGFGGGGFEDIFSSFFGGGRQQRDPNAPRKGDDLQYTMTVTFDEAVFGSEKEISIRKDVACHTCDGEGAKPGTKKKTCHYCNGSGHVSVEQNTILGRVRTEKVCPVCSGSGQEFEEPCPTCHGKGTENKNVKISVTIPEGVDNEQQIRLAGEGAPGENGGPQGDLYIVFRVKPSEKFERDGDDIYYSLDISIAQATLGDEVKVPTLKGSVMLTIPAG

SEQ ID NO: 22084 - protein, 296 aa, Yersinia pseudotuberculosis
MSQKELWYETLHANFGQYFSVENVLYREKTEHQDLVIFENPELGRVMALDGVVQTTERDEFIYHEMMTHVPLLAHGQAKKVLIIGGGDGAMLREVSRHKNIEQITMVEIDAGVVEFCRQYLPNHSAGAYDDPRFKLVIDDGVNFVNQTTEKFDVIISDCTDPIGPGESLFTSVFYEGCARSLNEGGIFVAQNGVCFLQQDEAVNSHNKLSHYFSDVSFYQAAIPTYYGGIMTFAWATQNPALRQLDLATLQNRFAQAGLACRYYNPAIHVGSFALPQYLLDALTTIPKVIGVDSSE

SEQ ID NO: 22085 - protein, 148 aa, Brassica napus
  misc_feature (106)..(106): Xaa can be any naturally occurring amino acid
MASSMLSSAAVVTSPAQATMVAPFTGLKSSAAFPVTRKANNDITSIASNGGRVSCMKVWPPVGKKKFETLSYLPDLTEVELGKEVDYLLRNKWIPCVEFELEHGVXYREHGKHPPGYYRWPVTGTMGKLPLVRDAPDSAPGVERNPQP

SEQ ID NO: 22086 - protein, 278 aa, Bacteroides fragilis
MSRTNFDTLLEAGCHFGHLKRKWNPAMAPYIFMERNGIHIIDLHKTVAKVDEAAEALKQIAKSGKKVLFVATKKQAKQVVAEKAASVNMPYVIERWPGGMLTNFPTIRKAVKKMTTIDKLTADGTYSNLSKREILQISRQRAKLDKTLGSIADLTRLPSALFVIDVMKENIAVREANRLGIPVFGIVDTNSDPTNIDFVIPANDDATKSVEVILDACCAAMIEGLEERKAEKIDMEAAGEAPANKGKKKSAKARLDKSDEEAINAAKAAAFLKEDEEA

SEQ ID NO: 22087 - protein, 202 aa, Zea mays
MNILNRFGLGSGGQTSTDPSPIAQGSDDDSPAPGNHFAQFAAGCFWGVELAFQRLPGVTQTEVGYTQGITHNPSYEDVCSETTRHAEVVRVQYDPKGCTFESLLDLFWSRHDPTTLNRQGNDVGTRYRSGIYFYTPEQEKLARESLERHQQRMERKIMTEILPAKKFYRAEEQQQQYLSKGGRYGMGQSCAKGCTDPIRCYG

SEQ ID NO: 22088 - protein, 92 aa, Arabidopsis thaliana
MAFFMLSSDPVDTWADQATMVAPFTGLKSSAAFPVTRKTNMDMTSIVSNWGRVSCMNVWPPIVKKNVETLYYLPDRRDGELANEVDYSFLNK

SEQ ID NO: 22089 - protein, 376 aa, Anabaena variabilis
MARDYYEILGVARDADKEEIKQAYRRLARKYHPDVNKEPGAEERFKEINRAYEVLSEPETRARYDRFGPEGVSGAGVGFQDMSDMGGFADIFESIFSGFAGGGMGGPTQQRRRGGPARGDDLRLDLKLDFREAVFGGEKEIRISHLETCETCSGSGAKPGTRPRTCSTCSGSGQVRRVTRTPFGSFTQVSTCPTCNGTGMVIEDKCDACDGKGTNQVTKKLKITIPAGVDNGTRLRIQQEGDAGQRGGPPGDLYVYLFVNEDEEFQRDGINVISEIKVSYLQAILGCRLEVNTVDGPVELIIPAGTQPNTVMKLENRGVPRLGNPVSRGDHLLTVLIDIPTKVIPEERELLEKLAKIKGDRTGKGGLEGFLGNLFK

SEQ ID NO: 22090 - protein, 178 aa, Yersinia pseudotuberculosis
MKHTVEVMISEQEVKTRIAELGRQISEHYRDSGSDMVLVGLLRGSFMFMADLCRTIDVSHEVDFMTASSYGNGMSTTRDVKILKDLDEDIRGKDVLIVEDIIDSGNTLSKVREILQLRGPKSLAICTLLDKPERREVHVPVEWVGFTIPDEFVVGYGIDYAQRYRHLPYVGKVVTLDE

SEQ ID NO: 22091 - protein, 286 aa, Unknown
  Frankia sp. EAN1pec
MTGPRTVLITGATDGHGRALAHRLAAEGTTLILHGRDPDKLARTADDIQTTHRVSRPRTMQADLAELAQVRRLASDVQAVADRLDVLVSNAGIGAGHPDGHTRRTSVDGYELRFAVNYLAGFLLTLDLLPLLRRSAPARIVNVASIGQHPLDLGDLMIERGYSGTRAYGQSKLAQIMSGFELAQRLPGAEVAVNSLHPATYMPTKIVLAEIGHHIDSIDDGVSATHRLVTDAAFAGVTGRFFDRTSDTRPNIQAYDEQARAELWRRSLELVDRSGVHGRGVRGVMI

SEQ ID NO: 22092 - protein, 642 aa, Solanum lycopersicum
MSSQKNYKNKHVLFLVMIMCSLAFVTEANLSEPEVLLKFRESLKYDGDPFSTWDANVPPCVKDNNKPKWNNLFCESGKVYGLNLENLGLSGTIDLDILKELPNLRTISVFKNKFEGPLPILNKLPTLKSAYFSNNKFSGPIDQNIFEGMNSLKKLHLANNEFTGPLPPIFGDMPNLRELNIQNNKFEGPIPPSYSHLYLPAYDGNDGLCGPPLAKSCNKEDEKKKEESSSSSSSGWKIALIVVIVVVVIGIIVFVLINRRNKNHQQEVVLGGSSLTSSSPTSQDQKLIPQSHDHLNKMEQGQSSAASTPDRACNDGGKRAEVAGQKLLFLKDDIEKFDLPDLLKASAEVLGSGVFGSTYKAALSTGPVMVVKRFRHMNKVGKEDFHEHMRRLGRLSHKNLLPVIAFYYRKEEKLLVFEYVNNVSLAVYLHGNSKSRGNQSLDWPTRLKIVKGVSKGILYLYNELPSLTSPHGHLKSSNVLLTENFEAVLTDYALLPVVNAEHAHEHMISYKAPELKQSGKVNRKTDVWTLGMLILEILTGKFPSNLLGKGTQDSDDLATWVNTTLGGESSEKEVFDKEMKGTKDCESEMMKLLKIGLSCCEADVEKRCDIKEAVERIDEVKGKGDFSSNVASNEVDNMHTSR

SEQ ID NO: 22093 - protein, 137 aa, Glycine max
  misc_feature (28)..(28): Xaa can be any naturally occurring amino acid
  misc_feature (101)..(101): Xaa can be any naturally occurring amino acid
  misc_feature (110)..(110): Xaa can be any naturally occurring amino acid
  misc_feature (121)..(121): Xaa can be any naturally occurring amino acid
GSRIKPSISMFLTSCNIKSTGHKMGISXKGSDQILERYLYLHNVPNNEDFDPDTRLKNHALHKYDSVPAIQLTFASGTHTRVLYLDKTTVTTSMNIDPDCXKRSRSDTGXILKCTPRRASXDEQHSYLPQPILYSQK

SEQ ID NO: 22094 - protein, 109 aa, Glycine max
AGNADCPVKIKLVAPPLYVLTTQTLDKDQGIAVLTNATKVCAEAIEKHKGKLVVKEAARAVSERDDKLFADTIEKLKLAGEEVDGDDDSEEEDNGMGDVDFTKAGAGTD

SEQ ID NO: 22095 - protein, 669 aa, Solanum lycopersicum
MSVAYRYSNHNRHHHHHHLLILFVLLLQVIVPIKSDNNEAEILLRFSKSLQKNDATANWNTKVSPCDKKTDRPNWDNVICENGFVFGLQLENKGLSGTIDVDALKDLPNFRTISVMNNNFEGPIPNLSKLAGLKTAYFTNNKFSGQIDNSFFEGMHWLKKLHLGNNQISGKIPSVFGQLPKLTELRLENNKFEGQIPDFNQERLIDMNFANNSLQGPIPHGLASLKPSAFEGNNLCDGPFSKCTSEPKVALWTIILVVIAVAAAVAAIVVVIIILRRGKQTPETETRPIPTPSGAAAGGATNQTGAPSAAELNKMEQGSNQAIAARDQSPEGTAVLNTNKRPEVQAVQQKLLFLKDDIEKFDLPDLLKASAEILGSGVFGSTYKAALSRGRVMVVKRFRQMNNVGKEDFHEHMRRIGRLSHKNLLPVVAYYYRKEEKLLVSEYVNNVSLAVHLHGNKSRGQPSLDWPTRLKIVKGVAKGLLYLYNELPSLTAPHGHLKSSNVLLNESYEPLLTDYALLPVVNLEHAQEHMIAYKSPEFKHNGRITRKNDVWTLGILILEMLTGKFPSNFLQQGKGSDTDLATWVRSVVNEDMTEVDVFEKEMRGTTNSEGEMMKLLKIALGCCDLDMKKRFDIKEAMERIEEVKERDGDDDFYSTRGLSDDYTQVSMNI

SEQ ID NO: 22096 - protein, 299 aa, Lactobacillus sakei
MKLAMVGLGKMGINLVANLRRNGHEVVAFDLNQAAVEEAVNLGATAATDLDDVLAQLTSPRIVWVMLPAGKPTDATIQTLSEKMNAGDMVIDGGNSFFEDSERHNALLKEQGIHFFDAGTSGGMSGANANGNFMIGGDSPEAFKTIEPIFKSIAQEDGYLYTGKAGSGHYLKMVHNGIEYGMMQSIAEGFDVLEHGRFEYDNEAVAKVWSNGSVIRGWLMELAQSAFSKDPELESLKGVMHSSGEGQWTLDEALKLQVPTPVIGLSLMMRYRSLEDDTFTGKVVAALRNEFGGHAVDKK

SEQ ID NO: 22097 - protein, 591 aa, Oryza sativa
MCGILAVLGVADVSLAKRSRIIELSRRLRHRGPDWSGIHCYQDCYLAHQRLAIVDPTSGDQPLYNEDKSVVVTVNGEIYNHEELKANLKSHKFQTASDCEVIAHLYEEYGEEFVDMLDGMFAFVLLDTRDKSFIAARDAIGICPLYMGWGLDGSVWFSSEMKALSDDCERFISFPPGHLYSSKTGGLRRWYNPPWFSESIPSTPYNPLLLRQSFEKAIIKRLMTDVPFGVLLSGGLDSSLVASVVSRHLAEAKVAAQWGNKLHTFCIGLKGSPDLRAAKEVADYLGTVHHELHFTVQEGIDALEEVIYHVETYDVTTIRASTPMFLMSRKIKSLGVKMVLSGEGSDEIFGGYLYFHKAPNKKEFHEETCRKIKALHLYDCLRANKSTSAWGVEARVPFLDKNFINVAMDIDPEWKMIKRDLGRIEKWVLRNAFDDEEKPYLPKHILYRQKEQFSDGVGYSWIDGLKDHANEHVSDSMMMNASFVYPENTPVTKEAYYYRTIFEKFFPKNAARLTVPGGPSVACSTAKAVEWDAAWSKNLDPSGRAALGVHDAAYEDTLQKSPASANPVLDNGFGPALGESMVKTVASATAV

SEQ ID NO: 22098 - protein, 336 aa, Arabidopsis thaliana
MGNCLKPLKEQPPSASPKPLTIPSSSVEPVKENLKEFRFAELNKATKRFRKYMVIKGNDNGFTRTFYEGCINETTFAPSRTGITVSVMECYQDNSQTLQDWKEEVKSLGRISHPNLVKLLGYCCEENKSFLVFEYLHKGSLNRYIFGKEEEALPWETRVKIAIGAAQSIAFLHWVKNSALYRELRMYNILLDEHYNTKLFYLGSKKLCLLEESVTTAFIGRTVYIPPEYVISGHLGTKSDVYTFGVILLEILTGLKASDGKKNENMQSLHVWTKPFLSDQSKIREIIDPRLGNDYPVNAATQMGKLIKRCIKLDTRKRPSMQQVFDGLNDIAEIKD

SEQ ID NO: 22099 - protein, 443 aa, Thermus thermophilus
MGKRMVVVGGVAGGASAAAKAKRENPELEVVVYEKSGWVSYGACGLPYVLSGEIPRLERLVARTPEEFRKQGVLVHTRHEVVDVDYELRTLTVHDHAEGRTFQDRFDHLVLATGARPSLPPIPGTEQEGVYTLRTMEDGERLLKALPQARRAAILGAGYIGLEAAEAFRKRGLQVTLLEAKDRPLPHWDPEVGALLKEELERHGVEVWTGVKVEAFRGMGRVEAVETSEGVVPADLVLLATGIRPNTELAQAMGVALGPTGAIATDERMRTNLEGVYAAGDVAESFHRVLKRPYWLPLGDVANKHGRTAGSVIAGREARFLGVVGTAIFKAFDLAVATTGLSLEGALKEGFWAKKVFIQSRDGAHYYPGSGPLWVELVYEEGTGRLLGGAVVARGHGALRIDVLAALLHREGSVEDLLALDLAYAPPFSPVWDPLLIAAQQAR

SEQ ID NO: 22100 - protein, 249 aa, Medicago truncatula
MGVVGSGSQMPYGSNPYQSNQMTGAPGSVVTSVGGMQSTGQPAGAQLGQHQLAYQHIHQQQQQQLQQQLQSFWSNQYQEIEKVTDFKNHSLPLARIKKIMKADEDVRMISAEAPVIFARACEMFILELTLRSWNHTEENKRRTLQKNDIAAAITRTDIFDFLVDIVPREDLKDEVLASIPRGTMPVAGPADALPYCYMPPQHASQVGTAGVIMGKPVMDPNMYAQQPHPYMAPQMWPQPPEQRPPSPDH

SEQ ID NO: 22101 - protein, 485 aa, Kluyveromyces lactis
MVRLGPKKPPARKGSMADVPANLMEQIHGLETLFTVSSEKMRSIVKHFISELDKGLSKKGGNIPMIPGWVVEYPTGKETGDFLALDLGGTNLRVVLVKLGGNHDFDTTQNKYRLPDHLRTGTSEQLWSFIAKCLKEFVDEWYPDGVSEPLPLGFTFSYPASQKKINSGVLQRWTKGFDIEGVEGHDVVPMLQEQIEKLNIPINVVALINDTTGTLVASLYTDPQTKMGIIIGTGVNGAYYDVVSGIEKLEGLLPEDIGPDSPMAINCEYGSFDNEHLVLPRTKYDVIIDEESPRPGQQAFEKMTSGYYLGEIMRLVLLDLYDSGFIFKDQDISKLKEAYVMDTSYPSKIEDDPFENLEDTDDLFKTNLNIETTVVERKLIRKLAELVGTRAARLTVCGVSAICDKRGYKTAHIAADGSVFNRYPGYKEKAAQALKDIYNWDVEKMEDHPIQLVAAEDGSGVGAAIIACLTQKRLAAGKSVGIKGE

SEQ ID NO: 22102 - protein, 322 aa, Coccidioides immitis
MTTDPSTYKLNHTMIRVKDPQKSLEFYKFLGFSQINKLDFEEAKFSLYFLAYDGPESLSGERHWTDRNGVLELTHNYGTENDPNYTVNNGNTEPHRGYGHIAISVDNIELACKRLEDAGYPFQKKLTEGRMRNIAFVKDPDGYWVELIRQTEDEKVSGAVTQTNPKLYRFNHTMLRVKDAEVSLKYYREVMGMELMRELKNEDAKFNLYFLGYPKSNPPARTDALNPVTEWEGVLELTWNYGTEKQEGKVYHDGNSEPQGFGHICVSVDDLDAACARFESLNVNWKKRLSDGRMKNVAFVLDPDGYWIEVIQNEKLKSRSKW

SEQ ID NO: 22103 - protein, 296 aa, Staphylococcus saprophyticus
VLGVSKSASKDEIKKAYRKLSKQYHPDINKEEGADEKFKEISEAYEVLSDENKRANYDQFGHDGPQGGFGGQGFGGQDFSGFGGGGFEDIFSSFFGGGRQQRDPNAPRKGDDLQYTMTVTFDEAVFGSEKEISIRKDVACHTCDGEGAKPGTKKKTCHYCNGSGHVSVEQNTILGRVRTEKVCPVCSGSGQEFEEPCPTCHGKGTENKNVKISVTIPEGVDNEQQIRLAGEGAPGENGGPQGDLYIVFRVKPSEKFERDGDDIYYSLDISIAQATLGDEVKVPTLKGSVMLTIPAG

SEQ ID NO: 22104 - protein, 375 aa, Xylella fastidiosa
MTPIVFIDRDGTLIEEPPDFQIDAYEKLRLVNGVIPALLKLRDAGYHFVIVTNQDGLGSPTYPQASFDGPNALMLQIFSSQGIVFRDVLIDRSWPADNAPTRKPGIGLMVAYLQDRDIDWARSAMVGDRPTDLQFAENLNIRGFQLRTPQFGGDWDWDGIAHTLADAPRRAVVQRHTKETNIRVEIDLDGVPQARITTGLPFFDHMLEQIAKHAGISLHISAVGDLHIDEHHTIEDTGLALGQAVRQALGDKRGIGRYGFDPPQLPWQVSGAAAHGGFTLPMDETQASAVLDFSGRPYFVFEGTFVRERVGDMPTELVPHFFRSLCDASGMNLHLSVHGDNDHHKVEACFKALARALRQALQRHGHVLPSTKGAL

SEQ ID NO: 22105 - protein, 294 aa, Staphylococcus delphini
VLGVSKSASKDEIKKAYRKLSKKYHPDINKEEGSDEKFKEISEAYEVLSDENKRAQYDQFGHSGPQGGFGQGFGGQDFSGFGGGGFEDIFSQFFGGAQRQRDPNAPRRGDDLQYTMTVTFDEAVFGTKKEISIRKEVTCHTCDGEGAKPGTKKKTCSYCHGAGHVSVEQNTILGRVRTEKVCPECNGTGEEFEEPCPTCHGKGTELKNVKLEVTVPEGVDNDQQIRLAGQGGPGENGGPAGDLFVIFRVQPSDKFTREGDDILYNHNISFAQAALGDEVKIPTLKGHVMLTVPE

SEQ ID NO: 22106 - protein, 284 aa, Coxiella burnetii
MDKRSSLPPIVRHITCDQMTEPAFQGEYTDLKETGRYLCRQCGIALFRSQDKFHSGCGWPSFDATIAGTIKRLPDPDGQRIEIRCERCGAHLGHVFEGEALTPKNTRYCVNSLSLDFVTDSQIRDTEEAIFAGGCFWGVEYYFKRLPGVVKTEVGYTGGHKNNPTYKEVCSRTTGHVEAIRVLYDPQQINYEKILHYFFEIHDPTQTDGQGPDLGDQYHSVIFYYDNQQKRMAEMAIKVLTEKGYRIATRLAPVSIFWRAEDYHQDYYQKTGKQPYCHHYVKRF

SEQ ID NO: 22107 - protein, 293 aa, Staphylococcus schleiferi
VLGVSKSASKDEIKKAYRKLSKKYHPDINKEEGADAKFKEISEAYEVLSDDNKRANYDQFGHSGPQGGFGQGFGGQDFSGFGGGFEDIFSSFFGGAQRQRDPNAPRKGDDLQYTMTISFEEAVFGTKKEISIRKEVTCHTCGGEGAKPGTKKKTCSYCKGKGHITVEQNTILGRVRTEKVCPECNGTGEEFEEPCPTCKGKGTEIKNVKLEVTVPEGVDNDQQIRLAGQGSPGENGGPAGDLFVVFRVKPSDKFQREGDDILYHHDIGFAQAALGDEVKIPTLNGHVMLTIPE

SEQ ID NO: 22108 - protein, 73 aa, Propionibacterium acnes
MAKKEGALELEGTVVEALPNAMFRVELKNGHRVLATISGKMRQHYIRILPSDRVVVELSPYDLTRGRIVYRHK

SEQ ID NO: 22109 - protein, 247 aa, Triticum aestivum
MVSTDAARNIVGIVGNVISFGLFLSPVPTFWRIIKAKDVEEFKPDPYLATLLNCMLWVFYGLPIVHPNSILVVTINGIGLVIESAYLIIFFIYATRNTRLKMLGVLTAEALFMVAVVAGVLLGAHTHEKRSMIVGILCVIFGSVMYASPLTIMGKVIKTRSVEYMPFVLSLVNFLNGCCWTGYALIKFDLYITIPNGLGAIFGLAQLILYGCYYRSTPKKGKNVELPTVKVTKNSVGGGRVSVTVEK

SEQ ID NO: 22110 - protein, 294 aa, Staphylococcus sciuri
VLGVSKDASKDEIKKAYRKLSKKYHPDINQEEGADAKFKEISEAYEVLSDENKRAQYDRFGHSGPQQGFGGSQGFGGQDFSGFGGFEDIFGSFFGGGGARRDPNAPRQGDDLQYSMTLTFEEAVFGTEKDITVRKDVECDTCHGNGAKPGTKKKTCTYCNGQGHVTVEQNTILGRMQTQKVCPECEGSGQVFEEKCSDCHGKGTQNKKVTIKVKVPEGVDNDQQIRLAGKGGPGINGGPAGDLYVVFRVKPHSKFRRDGDNIFYDLNLSFPQAALGDEITVPTLTGNVSLTVPA

SEQ ID NO: 22111 - protein, 968 aa, Oryza sativa
MDRRNNQVVSWGTGFVAAFELYDKYPEIETAMKIQDYLTASPADFFSTISMGIDNVMRYKKETALQQMRRSHGKKRGAKGETGTVHIHSHKQSIIKPCLRLLADNFYSRRSPAQLSCSVPEQKNKNKISRQCIDEGARLEIARQSYRAGDYKAALEHCNAVYRANPRLLENLLLLGAVYYQLREFDMCIAKNEEAVAIQPNCPECFNSIANAWREKGDVDNAIQFYVHAVQLRPTFADAWTNLANAYTRKGNLSQAAECCHQALALNPHLADAYCNLGDVLKAQGLYREAYSHYLDALNIKPTFANAWNNIAGLLMQWGDFNKAALYYKEAIKCNPAFYDAHLNLGNLYKVTGMRQDAIVCFQNAARAKPENAVAYVFSGNLGNAYHEQGQLDLAILSYRQAIHCNSSYVEAYNNLGNALKDAGRNEEAISCYQTCLALQPSHPQALTNLGNVYMERVSFWSTCRNMMDIAASLYMATLTVTTGLSAPYNNLAMIYKQQGNCNHAITCFNEVLRIDPMAADCLVNRGNTFKEAGRITEAIQDYFHAVTIRPTMAEAHANLAAAYKDTGLLEASIISYKQALQLRQDFPEATCNLLHTLQMSSLPSVQPFHAIAYPIDSTLALEISRTYAAHYSLVASRFGLPTFTHSYPVPISNDGRTSRLRIGYVSSDFGNHPLSHLMGSIFGMHNQDTIEVFCYALSQDDGTEWRQRIRSEAEHFIDVSSMSSDMIAKVINEDKIQILINLNGYTKGARNEIFALQPAPIQVSYMGFPGTTGADYIDYLVTDEFVSPLKFSHIYSEKLVHLPHCYFVNDYKQKNRDVLGPVCPHKRADYGLPEDKFIFACFNQLYKMDPDIFNTCPLCNGHTTGTDILWAGLPMITLPLEKMATRVAGSLCLATGIGEEMVVNRVSFFTSVNKNGRLLVWSVIVISGPEDWWQFRSWMVVVLFSEIVGLDSFKLQYPPCPVFVIHG

SEQ ID NO: 22112 - protein, 169 aa, Glycine max
MQSLQQKASEWSGVSIDDAFGIDDTNLFQKLGLQTFINLSTNFYNRVYDDEEEWFRSIFANSEKENAIQNQYEFFVQRMGGPPLFSQRRGHPALIARHRPFPVTHQAAERWLHHMQHALDSTTDIDDDSKTKMMNFFRHTAYFLVAGDELKNQNQHIPCKHAAAKKDDS

SEQ ID NO: 22113 - protein, 450 aa, Unknown
  Mycobacterium sp. KMS
MTPTPGEADLTNTPAPRARRSVLSRGSWSETARIAGILRKETVGGAVLLVASAVALVWANSPWAESYFALRDLKIGAEPFGLHLNLTLGTWAADGLLAVFFLVVGLELKREFVAGDLRDPARAALPMAAAVGGMVVPALIFVAVTAPVGDGATRGWAIPTATDIAFAVAVLAVISTHLPAALRTFLLTLAVVDDLLAVTVIAVFYTDEINLTALGLSIVPLALFALCVQRRIRSWWLLLPLGVATWVLMHESGVHATVAGVLLGFTVPVLRSVAAGGPEAGPGLAEHFEHRLRPLSAGVAVPVFAFFAAGVAIGGVSGLTRALSDPITLGIILGLVVGKPVGIFLTTRVLTAVTRANLDDALRWIDVFGVALLAGIGFTVSLLIGDLAYGLGSDRDDFVKVGVLTGSLVAALIAAVLLRVRNRHYRAVWLQETADTDRDGVPDVYQSQRD

SEQ ID NO: 22114 - protein, 174 aa, Glycine max
  misc_feature (140)..(140): Xaa can be any naturally occurring amino acid
  misc_feature (154)..(154): Xaa can be any naturally occurring amino acid
MICSLAVTTANRAGAGMVAPFTGLNSMAGLPTTKTNTDITFIACIGGIEQCMQVWPPLGKKKLETLSYLPYLDDAQLAKEVKYLLRKGWIPCLEFNLDHSSVYREHNTSPRYYDRRYCTMSNLTMLGCTDASHVLNELHXAKTAYPNGSVRIIXFDNATQVQCITFIVYNTPAY

SEQ ID NO: 22115 - protein, 465 aa, Haloarcula marismortui
MRLHWHRRDLRATDNAGLAAATPSDPVVPVFIFDTAVLDHAGPPRVAFMLDALDSLREWYRDKGSDLVVAEGDPTSVLPELAAQHGAEKVTWGKDYSGLARERDAAVRQALDDADVAREAVQNAVLHEPGEITTNDGDPYSVFTYFGRKWHDREKAAPYDPPSADTLADVDGDALPTLADLGFEEPEADVPAAGTEEARALLDDFLDENVYEYEERRDFPADECTSRLSAHLKFGTIGIREVYDRTQAAKEGTGGDRRDSVREFQSQLAWREFYTQVLFAHPHVVSSNYKSYENPIEWENDEELLQAWKDGDTGYPIVDAGMRQLRDEAYMHNRVRMIVASFLTKDLLIDWRHGYEWFREKLVDHDTANDNGGWQWAASTGTDAQPYFRIFNPMTQGEDYDPNAEYIKEYVPELRDAAPEIIHDWNDCSLTQRRSAAPEYPDPVVDHSERREEALAMFERARGDD

SEQ ID NO: 22116 - protein, 433 aa, Ralstonia solanacearum
MSNVASPSTLQHAIPSYLPADNLGPWGIYLQQVDRVTPYLGSLARWVETLKRPKRALIVDVPIQMDDGRIAHFEGYRVQHNTSRGPGKGGVRFHQDVTLSEVMALSAWMSVKNAAVNVPYGGAKGGVRVDPRKLSSGELERLTRRYTSEIGIIIGPNKDIPAPDVNTNAQIMAWMMDTYSMNEGATATGVVTGKPIALGGSLGRREATGRGVFVVGSEAARNLGIDVKGARIVVQGFGNVGSVAAKLFQDAGAKVIAVQDHKGIVFNGAGLDVDALIQHVDHNGSVDGFKAETLSADDFWALECEFLIPAALEGQITGKNAPQIKAKIVVEGANGPTTPEADDILRDRGILVCPDVIANAGGVTVSYFEWVQDFSSFFWTEDEINQRLVRIMQDAFRAIWQVAQDNKVTLRTAAFIIACTRILQARQERGLYP

SEQ ID NO: 22117 - protein, 564 aa, Ralstonia metallidurans
MSDLQTNESFAALFEESIARSNMKAGEVISAEVVRIDHNFVVVNAGLKSEAFVPVEEFLNDQGELEVQAGDYVSVAIDALENGYGDTILSRDKAKRLASWLNLEKALEDGEIISGTVTGKVKGGLTVMVNGIRAFLPGSLVDVRPIKDTTPYEGKTLEFKVIKLDRKRNNVVLSRRAVVEATLGEERQKLMETLKEGAIVNGIVKNITDYGAFVDLGGIDGLLHITDLAWRRVRHPSEVLSVGQEITAKILKFDQEKNRVSLGVKQLGEDPWVGISRRYPQGTRLFGKVTNLTDYGAFVEIEAGIEGLVHVSEMDWTNKNVAPSKVVQLGDEVEVMVLDIDEDKRRISLGMKQCKANPWDDFSRNHKKGDKLTGQIKSITDFGVFIGLPGGIDGLVHLSDLSWQESGEEAVRKYKKGDEVEAVVLGIDVDKERISLGIKQLSGDPFNNFISANDKGSLVNGTIKAVDAKGAVVQLADDVEGYLRASEISADRVEDARNVLKEGEQITALVVNVDRKSRNINLSIKAKDSAEQQEAMQKFQADTGTAGTTNLGALLKAKLGQDNQ

SEQ ID NO: 22118 - protein, 599 aa, Pisum sativum
MITLIDFYHVMTAMVPLYVAMILAYGSVKWWKIFSPDQCSGINRFVALFAVPLLSFHFIASNNPYKMNLRFLAADTLQKIMILTLLFIWSNFSKRGSLEWTITLFSLSTLPNTLVMGIPLLKGMYGDFSGSLMVQIVVLQCIIWYTMMLFMFEFRGARLLISEQFPDTAGSIVSIHVDSDVMSLDGRTPLETDAEIKQDGKLHVTVRKSNASRSDIYSRRSQGLSSNTPRPSNLTNAEIYSLQSSRNPTPRGSSFNHTDFYSMMGGGRNSNFNASDVNNYGLSASRGVTPRPSNYEEDASNAKKLKHYPAPNPGMFSPTNKNLGSNVNVKRSNGQNQDQNQNQQKQDDLHMFVWSSSASPVSDVFGGHEFGSHDQKEVKLNVSPGKVDGHRETQEDYLEKDEFSFGNRGMEREMNNQQHEGEKIGDGKSKVMPPASVMTRLILIMVWRKLIRNPNTYSSLIGLVWSLVSFRWNIEMPAIIAKSISILSDAGLGMAMFSLGLFMALQPKIIACGNSIAAFAMAVRFLTGPAVMAAASFAVGLKGVLFHVAIVQAALPQGIVPFVFAKEYNVHPDILSTGVIFGMLIALPITLVYYILMGL

SEQ ID NO: 22119 - protein, 449 aa, Clostridium symbiosum
SKYVDRVIAEVEKKYADEPEFVQTVEEVLSSLGPVVDAHPEYEEVALLERMVIPERVIEFRVPWEDDNGKVHVNTGYRVQFNGAIGPYKGGLRFAPSVNLSIMKFLGFEQAFKDSLTTLPMGGAKGGSDFDPNGKSDREVMRFCQAFMTELYRHIGPDIDVPAGDLGVGAREIGYMYGQYRKIVGGFYNGVLTGKARSFGGSLVRPEATGYGSVYYVEAVMKHENDTLVGKTVALAGFGNVAWGAAKKLAELGAKAVTLSGPDGYIYDPEGITTEEKINYMLEMRASGRNKVQDYADKFGVQFFPGEKPWGQKVDIIMPCATQNDVDLEQAKKIVANNVKYYIEVANMPTTNEALRFLMQQPNMVVAPSKAVNAGGVLVSGFEMSQNSERLSWTAEEVDSKLHQVMTDIHDGSAAAAERYGLGYNLVAGANIVGFQKIADAMMAQGIAW

SEQ ID NO: 22120 - protein, 1040 aa, Prosthecochloris aestuarii
MTNSSTSATAEFRTLVVLEALKERRPEHEVAAAFNISRQELSEWKEQFLSKADSLFRPELTENKPEKCPDDIDWQKVFHAISHPTIILDENQIILSANPATAKAFGLDTPDLIGRKCTELFHATWCTPDRCPMQEVKMTRNPAEGIMISETLGRYFLVSCTPVLNTTGDVEKIIHIATDITQQIKAEQTLQRSDSILSTLQFVTTELQNSHRFEETINRVLSMLGTVLEVNRAYIVECQAVDTKTPFTNLRYLWQDPYALSKKQKPLFQEPLSDRGERASLLKTLEKNLVLQRITNDTSGAERAILQAAHITSILAIPINIEKKWWGFIGFDDCRNDRSWTRTEIEALRSAAETLGAAIIHQRTTLKLKESEARNGAMLNALPDMLFVLDKEGVCLDFHARNNNEPHPPAKQFIGKSLKEIFPEAHSSALQHLIHEVSESGAPKIHEYQMKRSGKTSHYEIRVVPLGTDKTLNIVRNMTDQKETENKLLRTNRKLENASRKAKKLAEQAQEASKAKSEFLANISHEIRTPMNGVIGMTGLLLETDLTPQQHRYAGTIASSAQSLLDLINDILDVSKIEAGKLTLEILDFDLQELMDDFAASFAIQAEQKNLEFLCSIEPGIPTRLTGDPGRLRQILMNIAGNAVKFTSKGEIAIYVTLDSDCDDQVVLRFCIRDTGIGIAKEKIDTLFEKFTQIDASATRQYGGTGLGLSIAKDLVELMQGSIGVESTVNQGSLFWFTAKLNRQTHATLQAQESKNRSLFGQKALIVDDNATNREILSKRLLSWGMRPEESDNGQDALDMLIRASTSTDAFTIAVIDMQMPEMDGVMLGKAIREHEALMSLQMIMMTSLGNNGESSLAEKAGFSAWLQKPVQIKKLKNALIALSATQEPEADEQPSQKKPNNLLNRFAECKARILLVEDNIVNQQVAMLMLKKFGLHVDGVANGKEALSALMSLPYDVVLMDIQMPVMDGLEATRRIRNGECGTSAIPIIAMTAHAKQSDRELCLATGMNDYVSKPVNQQALADTLEKWLPKHSDTQNAT

SEQ ID NO: 22121 - protein, 111 aa, Lactobacillus sakei
MTQTITANNIEAFVAEKPLVILDFWADWCMPCKIMTPMIQELHAASNDAFKLGMVDVEDQPELAERYDIQSVPTLLIFKKGKAAEKVTGAFPKEKLKRYLDKKIAESNHEG

SEQ ID NO: 22122 - protein, 762 aa, Unknown
  Erythrobacter sp. NAP1
MFDTKTVSLEWGGKTLTLETGRIARQADGAVLATYGETVVLCAVTAAKSVKEGQDFFPLTVHYQEKFSAAGRIPGGFFKREGRATEKETLTSRLIDRPCRPLFPEGFYNEINVIAQVLSYDGETEPDIVAMIAASAALTISGVPFMGPIGAARVGFTNDGEYVLNPTVADALGEDGRLDLVVAATQDAVMMVESEAKELTEEEMLGAVMFAHEESRKVIGAIIELAEQAAKAPWELDPVEDKSAKMDKLRAAIGSDLEAAYKITDKSARQDAVNAAREKAREAFADLAESDPAEYLGTLKLVKKLESEIVRGSILKDGTRIDGRKLDQVRPIEAMVGLLPRTHGSALFTRGETQAICTTTLGTKDAEQMIDGLEGLSYSNFMLHYNFPPYSVGEVGRFGFTSRRETGHGKLAFRALRPVLPDAEEFPYTIRVLSDITESNGSSSMATVCGGALSMMDAGVPLARPVSGIAMGLILEGEDFAVLSDILGDEDHLGDMDFKVAGSEEGITSLQMDIKVAGITQEIMTQALEQAKAGRAHILGEMAKALTGARTEVSKHAPRIETMQIDKSKIRDVIGTGGKVIREIVAETGAKVDIDDEGTIKISSSNADEIEAAKKWIEGIVEEAEVGKIYNGKVVNIVDFGAFVNFMGGKDGLVHVSEMKNERVEKPTDVVSEGQEVKVKVLEIDNRGKVRLSMRVVDQETGEELEDTRPPREPRGDRGGKGGRGGDRRGGRGGRGPRRDGGGNRDGGGNDGPAAMPDFLKD

SEQ ID NO: 22123 - protein, 714 aa, Pasteurella multocida
MNPIVKQFKYGQHTVTLETGAIARQATAAVMASMDDTTVFVTVVAKKDVKEGQDFFPLTVNYQERTYAAGRIPGGFFKREGRPSEGETLIARLIDRPIRPLFPEGFYNEIQIVATVVSVNPQICPDLVAMIGASAALSLSGVPFNGPIGAARVGFIDDQFVLNPTMNEQKQSRLDLVVAGTDKAVLMVESEADVLTEEQMLAAVVFGHQQQQVVIDAIKEFTAEAGKPRWDWVAPEPNTALIEKVKAIAEARLGEAYRITEKQARYEQIDAIKADVIAQITAEVAEGEDISEGKIVDIFTALESQIVRSRIIAGEPRIDGRTVDTVRALDICTGVLPRTHGSAIFTRGETQALAVATLGTERDAQIIDELTGERSDHFLFHYNFPPYSVGETGMIGSPKRREIGHGRLAKRGVAAVMPTLAEFPYVVRVVSEITESNGSSSMASVCGASLALMDAGVPIKAAVAGIAMGLVKEDEKFVVLSDILGDEDHLGDMDFKVAGTRTGVTALQMDIKIEGITAEIMQIALNQAKSARLHILGVMEQAIPAPRADISDFAPRIYTMKIDPKKIKDVIGKGGATIRALTEETGTSIDIDDDGTVKIAAVDGNSAKEVMARIEDITAEVEAGAVYKGKVTRLADFGAFVSIVGNKEGLVHISQIAEERVEKVSDYLAVGQEVTVKVVEIDRQGRIRLTMKEVAPKQEHVDSVVADVAAEENA

SEQ ID NO: 22124 - protein, 639 aa, Streptomyces ambofaciens
MRVLLVNMPWSPIDLPSLALGILKRSVDEHVPGASAEVLHANLMFTDWITERTEFTGDDYEYYALSSYFMGCGDWVFSSALYDDPAWREDEFVATMSGKLKSARMKMTRELHRIAPEFVETIARQIVASEPDVVGFTSTFQQNTAALAAARRVKQLAPHIVTVMGGANCDGEQGATVHRNFPFVDHVVRGEGEAAFPELLGALTEDGPLDSIPGLCHRDADGASVANPMATRPLPPAAILPPDYSGYFERLAASVARNWVEPKLVVEGARGCWWGEKHHCTFCGLNGSFMEFRSKSPDTFYEEIMELARRHRVLDMYVVDNILDMRYLTTVLPRIIESGYDLRLHIEIKANMRRNQLRTLADAGLIYVQPGIESLNSRVLDLMDKGVSGCQNVRMLRDGAETGLSVAWNYLHGFPGESAEDYDPVIAQIPALEHLDPPVDLSARIAIERFSPYFERPELGFTGLRPEAHYRFTYDLPEEELYGMAYVFEAPARGIGEPTVSALNNALADWKKHHTDARLTHDDHGDRIVLVSRRRAFHWRVKELTDPFELALFRLLDQPHSVQALTRKAAARVPEAARDEDGVRRLLDTWLALGIVFADAGQYVHIAPAAVNEDLLRLDFMRHIHTEDTPDGAAVPEPA

SEQ ID NO: 22125 - protein, 745 aa, Zea mays
MSVLNSLGILLLLTAPAFAAALSADGLSLLAFKSAVTDDPSMALSSWSDADADPCRWLGVTCVNSSSSDGLRVVGVAVAGKNLSGYIPAELGSLAFLRRLNLHGNRLSGTVPAALANATALHSLFLYDNRLTGPFPAALCGIPKLQNLDLSQNALTGALPLELGRCKQLERLLLAENALSGNIPAAVWQDMVGLQMLDLSSNNLTGAIPAELGKLAALAGTLNLSHNHLSGGVPLELGRLPATVTLDLRFNNLSGEIPQSGSLASQGPTAFLNNPGICGFPLQVPCRVAPPSSSSSLPPPPPSSSATTNGGAGGARLPIKTSLIVLISVADAVAVALVGVIVVCVYWKVCDRRRAAKDKGDDSEYEEGCGLFPCPCCMRADACGDSSSECSEVDGKCNGGGGTGEGGYLVAIDKGFRMELDELLRSSAYVLGKGGKGIVYKVVVGNGTTPVAVRRLGGGTAAPERYREFAAEAGAIGRVRHPNIVRLRAYYWSADEKLVITDFVNNGNLATALRGRSGQPSLSWTLRLRIAKGAARGLAHLHECSPRRFVHGEVKPSNILLDADYNALVADFGLARLLTIVGCTDVYSVAGSGGIMGSGLPYARPAALTDRSCSAYRAPEARAPGGAQPPSQKSDVYSFGVLLLELLTGKPPEHASPSASSSSMPGHNGQRELEQQAPELVRWVRQGFEGSRPLSELADAALLRDAAARKEVVAAFHLSLRCVEADPERRPRMKAVSDSLDKIGA

SEQ ID NO: 22126 - protein, 638 aa, Medicago truncatula
MFHYPIVFKFIQFFLVLYTLDFLSYLALADPPYEICSTRNIYANGSSFDNNLSNLLLSLPFNDSNSISKFGNTSSGIGLDRVYGLYMCLDFVSNETCLKCVTNAIADTVKLCPQSKEAVVYEEFCQVRYSNKNFIGSLNVNGNIGKDNVQNISEPVKFETSVNKLLNGLTKIASFNVSANMYATGEVPFEDKTIYALVQCTRDLAANDCSRCLLSAIGDIPGCCYASIGARVMSRSCYLRYEFYPFYLGEKEQTKSSTNLGGKNNSSKIWMITVIAVGVGLVIIIFICYLCFLRNRQSNKGNGKISKDFPFIDLASLRVATRNFTDSNKLGEGGFGPVYKGILSDGQEVAIKRLSICSEQGSEEFINEVMLILKLQHKNLVKLLGFCVDGEEKLLVYEYLPNGSLDVVLFEQHAQLDWTKRLDIINGIARGILYLHEDSRLQIIHRDLKASNVLLDNDMNPKISDFGMARIFAGSEGEANTTTIVGTYGYMAPEYAMEGLYSIKSDVFGFGVLLLEIITGIRNAGFCYSKTTPSLLAYAWHLWNDGKGLELRDPLLLCPGDQFLRYMNIGLLCVQEDAFDRPTMSSVVLMLMNESVMLGQPGKPPFSVGRLNFIDQNELDLEEEYSVNFLTVSDILPL

SEQ ID NO: 22127 - protein, 164 aa, Pseudomonas putida
MSLNDLNTLPALLPKRTLPLRNSFQPHHRARQGHREVADSIPACLVSNWWTSDFVEAKFSLYFLALVDPATIPADDDARHQWMKSIPGVLELTHNHGTERDADFAYHDGNTDPRGFGHICVSVPDVVAACERFEALQVPFQKRLSDGRMNHLAFIKDPMVTGSK

SEQ ID NO: 22128 - protein, 476 aa, Methanothermobacter thermautotrophicus
MGDPRSGIEPGTPFEELPDDWLCPVCNVGKDQFEPLRGEIKRVRPEDIDMFCYQCSQTVRGRACTIRGVCGKEPTVARLQDNLLFAIKGISAYLYHARELGYTDEEVDAFLERGFYSTLTNVNFDAGEFIDLALEAGEMNIRTMKLLKKAHIDTYGEPEPTEVRVGALEGPAIIATGHSLRALEELLKQTEGTGINVYTHSELLPAHGYPGLRKYPHLAGQLGGPWFDQKDTFSRYTAAILGTSNCVLLPRDDYRDRMFTCGVAALPGVEHLEGYDFSPLIDKALELPPLSEEDATTLTTGFGLSTILSLADKIRELVEDGKIRRFFLVGGCDSPLPRAKYYTEFVRKLPEDTVVLTLACGKYRFNSMDLGDIEGVPRLIDLGQCNDAIVAVELVEALSNLFQMDINELPLSIILSWMEQKAAAILWSLLSLDLKGMYIGPILPGWANEDIVKFLVDNYDLTPIGDPEEDIRKILG

SEQ ID NO: 22129 - protein, 183 aa, Escherichia coli
MQDSILTTVVKDIDGEVTTLEKYAGNVLLIVNVASKCGLTPQYEQLENIQKAWADRGFVVLGFPCNQFLEQEPGSDEEIKTYCTTTWGVTFPMFSKIEVNGEGRHPLYQKLISAAPTAVAPEESGFYARMVSKGRAPLYPDDILWNFEKFLVGRDGLVIQRFSPDMTPEDPIVMESIKLALAK

SEQ ID NO: 22130 - protein, 471 aa, Pyrococcus furiosus
MCLITGGINLTKEEIVKMIITGKHRGPDSFGVWSDGLVIKSEDFSEIKEIRGGNVVLAQCRLAMTGSKNYTQPFYNDIVLVHNGEIYNHESLRKWLIERGASFESDVDSEVILRLLEYFIFDKKMKVEEAVKKAMLMLRGDYAVAFALNGKIYLFRDPIGVRPLYYSPRGRFGSEKKVLWSVGEEAIPVNPGELVKLPEEEKMKLLSPWDIKGSGKGYYDGLKNLLQDAVRIRTAKKVGVLFSGGLDSSLIALLASKYSKVVLYTAGTEDSKDVEWARKVSDELRLELREYIFTREEVEREIKNVMFAIEEPNPMNLAIAIPLYFATKLARKDDVKVLLSGQGADELFGGYAKYLENPSLMRKDIEEIAERNLGRDDKVGMLNGVEVRYPYLDLPFVSLALRVPLEEKIREGVRKAILRRIALDFGLPEEVAFREKKAAQYGSNAQKILSKIAKKSLREFAQKLFSEVFST

SEQ ID NO: 22131 - protein, 644 aa, Medicago truncatula
MSSTMIMLIIILMLHVVSCTDHLIIDTYCPDNFPFYTSNTSFHKNLKLLMETLSSNIAASNTSYFNNTSIGQGLDKVYGQALCRGDITNSTVCKECIEKASKDLMNRCKSEDAMVWYELCQVRYSFQMFFSDAVYTGKYPKQNDLEKRVSDPTSFQQVLTYLMNNLSNEAAFNPAKNMFATAEIEFSAKKERIYGLVECTKDVSETDCGSCLSSAVTELNACCSYREGGIIVSRNCNVRFDLFQFFNASSAASLLIFPTSKVLIGLCTACRRQKNDRDKDEERSERMLFQELSSPKNVAITQEGELISSDQLLFMTLATIKAGTDDFSNTNKLGQGGFGAVYKGVLPDGNEIAVKRLSKKSWQGIEEFKNEIILIAKLQHKNLVKLLGCVLEGEEKILVYEFMSNRSLDQFIFDPNKRPKLDWKTCYGIIGGIARGLLYLHEESRLKIIHRDLKPNNVLLDHELVAKISDFGMARMFSENQNTANTKRVVGTHGYMAPEYAMEGLFSVKSDVFSFGVIMLEIISGKRNGGFYLTELAPTLLAYAWKLWNEGKGLEFADPILLESCLDYESEVLRCIHIGLLCVQEDPQHRPTMSNVVVLLGSESMVLPQPRQPAFSSGKMIRVDPSASTNCSLNDSIWSNISPR

SEQ ID NO: 22132 - protein, 1287 aa, Streptococcus pneumoniae
MRKTPSHTEKKMVYSIRSLKNGTGSVLIGASLVLLAMATPTISSDESTPTTNEPNNRNTTTLAQPLTDTAAGSGKNESDISSPGNANASLEKTEEKPATEPTTPAASPADPAPQTGQDRSSEPTTSTSPVTTETKAEEPIEDNYFRIHVKKLPEENKDAQGLWTWDDVEKPSENWPNGALSFKDAKKDDYGYYLDVKLKGEQAKKISFLINNTAGKNLTGDKSVEKLVPKMNEAWLDQDYKVFSYEPQPAGTVRVNYYRTDGNYDKKSLWYWGDVKNPSSAQWPDGTDFTATGKYGRYIDIPLNEAAREFGFLLLDESKQGDDVKIRKENYKFTDLKNHSQIFLKDDDESIYTNPYYVHDIRMTGAQHVGTSSIESSFSTLVGAKKEDILKHSNITNHLGNKVTITDVAIDEAGKKVTYSGDFSDTKHPYTVSYNSDQFTTKTSWRLKDETYSYDGKLGADLKEEGKQVDLTLWSPSADKVSVVVYDKNDPDKVVGTVALEKGERGTWKQTLDSTNKLGITDFTGYYYQYQIERQGKTVLALDPYAKSLAAWNSDDAKIDDAHKVAKAAFVDPAKLGPQDLTYGKIHNFKTREDAVIYEAHVRDFTSDPAIAKDLTKPFGTFEAFIEKLDYLKDLGVTHIQLLPVLSYYFVNELKNHEHLSDYASSNSNYNWGYDPQNYFSLTGMYSSDPKNPEKRIAEFKNLINEIHKRGMGAILDVVYNHTAKVDIFEDLEPNYYHFMDADGTPRTSFGGGRLGTTHHMTKRLLVDSIKYLVDTYKVDGFRFDMMGDHDAASIEEAYKAARALNPNLIMLGEGWRTYAGDENMPTKAADQDWMKHTDTVAVFSDDIRNNLKSGYPNEGQPAFITGGKRDVNTIFKNLIAQPTNFEADSPGDVIQYIAAHDNLTLFDIIAQSIKKDPSKAENYAEIHRRLRLGNLMVLTAQGTPFIHSGQEYGRTKQFRNPAYRTPVAEDKVPNKSHLLRDKDGNPFDYPYFIHDSYDSSDAVNKFDWTKATDGKAYPENVKSRDYMKGLIALRQSTDAFRLKSLQDIKDRVHLITVPGQNGVEKEDVVIGYQITAPNGDIYAVFVNADEKAREFNLGTAFAHLRNAEVLADENQAGSVGIANPKGLEWTEKGLKLNALTATVLRVSQNGTSHESTAEEKPDSTPSKPEHQNEASHPAHQDPAPEARPDSTKPDAKVADAENKPSQATADSQAEQPAQEAQASSVKEAVRKESVENSSKENISATPDRQAELPNTGIKNENKLLFAGISLLALLGLGFLLKNKKEN

SEQ ID NO: 22133 - protein, 206 aa, Propionibacterium acnes
MTHRRAHIYRETSESTVDVAIDLDGAGESTISTGVGFYDHMLTTLSKHSGIDMTITTTGDVEIDGHHSIEDTAIALGQALAQALGDKCGITRFGDAVVPLDEALAQCVVDVAGRPWVACSGEPEGQAYVRIGGSGVSYQGSMTYHVMHSLAFNAGLCVHLRLLAGRDPHHICEAEFKALARALRIAIAPDPRNAGRVPSTKGALNV

SEQ ID NO: 22134 - protein, 177 aa, Glycine max
  misc_feature (58)..(58): Xaa can be any naturally occurring amino acid
VSSMISSPAVTTVNRAGAGMVAPFTGLKSMVGFPTRKTNNDITSIASNGGRVQCMQVXGQPIGKKKFETLSYLPDLDDAQLAKEVEYLLRKGWIPCLEFELEHGFVYREHNRSPGYYDGRYWTMWKLPMVGCSEALQVMNELLAVKTVYPTGFILLIVSDNVRQVLCIIFIYYNSAS

SEQ ID NO: 22135 - protein, 557 aa, Oryza sativa
MLMRPVWWVLGLITADKNATRIHYLPNPETPPPPPPPAARRSPTMAMATALRKLSSDALRRQPLSRITPLYYMASLPATEERSGVTWPKQLNAPLEEVDPEIADIIEHEKARQWKGLELIPSENFTSVSVMQAVGSVMTNKYSEGYPGARYYGGNEYIDMAESLCQKRALEAFRLDPAKWGVNVQPLSGSPANFHVYTALLKPHERIMALDLPHGGHLSHGYQTDTKKISAVSIFFETMPYRLDESTGLIDYDQMEKSAVLFRPKLIVAGASAYARLYDYDRMRKVCDKQKAILLADMAHISGLVAAGVVPSPFDYADVVTTTTHKSLRGPRGAMIFYRKGVKGVNKQGKEVMYDFEDKINAAVFPGLQGGPHNHTITGLAVALKQATTPEYRAYQEQVMSNCAKFAQSLTAKGYELVSGGTDNHLVLVNLKSKGIDGSRVEKVLENVHIAANKNTVPGDVSAMVPGGIRMGTPALTSRGFVEEDFAKVADFFDAAVNLALKVKAAAGGTKLKDFVATLQSDSNIQSEIAKLRHDVEEYAKQFPTIGFEKETMKYKN

SEQ ID NO: 22136 - protein, 657 aa, Medicago truncatula
MITTSSKQIWSYVVSILYLTLLATEASPTYLGSYCNDNTTYTPNSTLSTNLNVLLNSLSTNSSQQQDGYYMTIMGFGTTNAVNGIFLCRGDVNTTTCQNCVTDAATQIKRRCTNQTEAIIWYEECLLRYTNKFFRYYSIEPRLNPKNGKNVSGVDFERFNETVFGLLNELVVTAANSRTAKKFGTGEVEVTRSMKVYGSGQCSTDLTSSQCEICLRNAIGTLPKCCSGREGASALLASCIVRYQLYPFYNLYGSSSSSSGRNGVGTKAIVIIISLAIVPVLLFFIGCYYKRRRSRQRRRTMLRENFGDELKTLDSLQFKFSTIEAATNKFSSENEIGKGGFGIVYKGVLSDGQQIAVKKLSRSSGQGSIEFQNEILLIAKLQHRNLVTLLGFCLEEREKMLIYEYVPNKSLDYFLFDSKKHRVLHWFERYKIIGGIARGILYLHEYSRLKVIHRDLKPSNVLLDDKMNPKISDFGLARIVAIDQEQGSSTNRIVGTYGYMSPEYAMHGQFSEKSDVFSFGVIILEIVSGKRNSRPIQSHDFEDILRTAWRLWRNQTPLEMLDPILKDMFSHSEVIKCIQLGLLCVQENPDDRPTMAQAVSYLSSLLVELPLPLEPAFSMDRDMKLNIPTTESSSGQFISNSTASSINDLTKSQFFPR

SEQ ID NO: 22137 - protein, 186 aa, Nicotiana tabacum
IYVISKDVMLNLLRDKFPGANDFGSEVIPGATSLGMRVQAYLYDGYWEDIGTIEAFYNANLGITKKPVPDFSFYDRSAPIYTQPRYLPPSKMLDADVTDSVIGEGCVIKNRKIHHSVVGLRSCISEGAIIEDSLLMGADYYETDADRRFLAAKGSVPIGIGKNSHIKRAIIDKNARIGDNVKIINS

SEQ ID NO: 22138 - protein, 304 aa, Solanum demissum
MAFFPTNFMLQTPHHEDEHQPSTSLNPILPSCSPQDFHGIASFLGKRSMSFSGMDGNNACEENHGEDDLSDDGSQAGEKKRRLNMEQVKTLEKNFELGNKLEPERKMQLARALGLQPRQIAIWFQNRRARWKTKQLEKDYEVLKRQFDAIKAENDALQTQNQKLHAEIMSLKNREQPTESINLNKETEGSCSNRSENSSEIKLDISRTPAIDSPLSNHHPNISSRPFFPPSMIRSNNNNNGVVVSHQLFHINSSSSRQDLKLMDQNTTTTNNNSSVKEESLSNMFCGIDDQTSFWPWLEQQHFN

SEQ ID NO: 22139 - protein, 603 aa, Solanum demissum
MDAVSIRVPYKNLKQEVELTNVDESRFTQLEIRSDSSSPRASNGEMNDSHLPLPPPPVRNSLLTLILSCTVAAGVQFGWALQLSLLTPYIQTLGIEHAFSSFIWLCGPITGLVVQPCVGIWSDKCHSKYGRRRPFIFIGAVMISIAVIIIGFSADIGYLLGDTKEHCSTFKGTRSRAAIVFVVGFWMLDLANNTVQGPARALLADLSGPDQRNTANAVFCSWMAVGNILGFSAGASGGWHRWFPFLTNRACCEPCGNLKAAFLVAVVFLTLCTLVTLYFANEVPLSPKQYKRLSDSAPLLDSPQNTGFDLSQSKRELQSVNSVANNESEMGRVADNSPKNEEQRPDKDQGDSFADSPGAVLVNLLTSLRHLPPAMHSVLIVMALTWLSWFPFFLFDTDWMGREVYHGDPKGEADEVNAYNQGVREGAFGLLLNSVVLGVSSFLIEPMCKWIGSRLVWAVSNFIVFVCMACTAIISVVSISAHTEGVQHVIGATRSTQIAALVVFSLLGIPLAVTYSVPFSITAELTADAGGGQGLAIGVLNLAIVVPQMVVSLGAGPWDALFGGGNIPAFVLASLAALAAGIFAMLRLPNLSSNFKSTGFHFG

SEQ ID NO: 22140 - protein, 153 aa, Capsicum chinense
MQIFVKTLTGKTITLEVESSDTIDNVKAKIQDKEGIPPDQQRLIFAGKQLEDGRTLADYNIQKESTLHLVLRFRGGMQIFVKTLTGKTITLEVESSDTIDNVKAKIQDKEGIPPDQQRLIFAGKQLEDGRTLADYNIQKESTLHLVLRLRGGF

SEQ ID NO: 22141 - protein, 159 aa, Exiguobacterium sibiricum
MNTSLYEIEVQDATGQTVSLNDYAGEVLVIVNTASKCGLVKQLGDLQQLHDKYADQGVKVLGFPCDQFNNQEFADQQETMQFCQRNYGVTFPMFQKIDVNGPAEHRLYTYLKQQQGGLLSSNIKWNFTKFLVDREGRVVKRFAPVDSIQTIEKTLARYV

SEQ ID NO: 22142 - protein, 169 aa, Zea mays
  misc_feature (52)..(52): Xaa can be any naturally occurring amino acid
  misc_feature (102)..(102): Xaa can be any naturally occurring amino acid
  misc_feature (158)..(158): Xaa can be any naturally occurring amino acid
MESKGGKKSSSSRSSLMYEAPLGYSIEDVRPAGGIEKFRSAAYSNCSRKPSXIIPLALFSLYQPSETMAGSAIGFEGYEKRLEITFSEAPVFTDPNGRGLRXLSRAPIDSVLDLAKCTIVSELSNEKFDSYVLSESSLFVYPYKVVIKTCGTTKLLLXIPGVLSFAESC

SEQ ID NO: 22143 - protein, 294 aa, Staphylococcus sciuri
VLGVSKDASKDEIKKAYRKLSKKYHPDINQEEGADAKFKEISEAYEVLSDENKRAQYDRFGHSGPQQGFGGSQGFGGQDFSGFGGFEDIFGSFFGGGGARRDPNAPRQGDDLQYSMTLTFEEAVFGTEKDITVRKDVECETCHGNGAKPGTNKKTCTYCNGQGHVTVEQNTILGRMQTQKVCPECEGSGQVFEEKCSDCHGKGTQNKKVTIKVKVPEGVDNDQQIRLAGKGGPGINGGPAGDLYVVFRVKPHSKFRRDGDNIFYDLNLSFPQAALGDEITVPTLTGNVSLTVPA

SEQ ID NO: 22144 - protein, 242 aa, Crocosphaera watsonii
MFQPFLQHLEKELFSRFDLTSRPIAPELEFQISQRGKNPAMIESWCYECPQLRKIRYTYINAGETAQIFNSVIYPNHQYDLPLLGIDFLAFGKKKILVVLDFQPLFRDSDYLKKYIEPMAPIRAKYNELAQDLEMRFYDANQYFSPYLLFARTNPQTVIEQLFPAYQEYIQLYWQLVEQAEPKTESTELERIIKAQKDYDQYSAERDPASGLFNSYFGHEWSEKFLHKFLFEDAVAVAAKKS

SEQ ID NO: 22145 - protein, 294 aa, Staphylococcus simulans
VLGVSKDASKDEIKKAYRKLSKKYHPDINKEEGADEKFKEITEAYEVLSDENKRANYDQFGHNGPQGGFGGQGFGGQDFSGFGGGFEDIFSTFFGGGGAQRDPNAPRKGDDLQYTMTISFEEAVFGAEKEISIRKEVKCETCDGSGAKPGSKKKTCHYCNGAGHVSVEQNTILGRVRTEKVCPVCNGTGEEIEEPCPTCHGKGTQTKNVKIKVKVPKGVDTDQQIRLAGEGAPGHNGGPQGDLYVVFRVKPSDKFIREGDDIFYNLKISFPQAALGDEVKVPTLDGEVILTVPE

SEQ ID NO: 22146 - protein, 294 aa, Staphylococcus succinus
ILGVSKDASKMKLKRLTVNYQNNIIQILIKKKVPTRNSKEISEAYENLSDDNKRANYDQFGHNGPQGGFGGQGFGGQDFSGFGGGGFEDIFSSFFGGGRQRDPNAPRKGDDLQYTMTVTFDEAVFGSEKEISIRKDVSCHTCHGEGAKPGTKKKTCEYCSGSGHVSVEQNTILGRVRTEKVCPVCSGSGQEFEEPCPTCKGKGTENKSVKISVTIPEGVDNEQQIRLAGEGAPGENGGPQGDLYVVFRVKPSETFERDGDDIYHSLNISIAQASLGDEVKVPTLKGVVMVTIPS

SEQ ID NO: 22147 - protein, 461 aa, Burkholderia pseudomallei
MTSRDERLHRGLEERHINLMALGATIGVGLFLGSATAIRAAGPAILLTYILGGVAIFLIMRALGEMAIDNPVAGAFSRYARDYIGPLAGYLTGWTYWFMWIVTCMAEITAVGVYMHMWFPDVPNWIWTFAALIVMGAVNFIAVKLYGEFEFWFALIKIVTIVLMIAGGALMIVAGVGNGGVPTGVSNLWAHGGFLPNGWPGVVDALPIVMFAYLGVEMLGLTAGEARNPEKSLAKAVNSVFWRVVIFYVGALFVIMSVYPWNQIGTQGSPFVMTFSRLGIPAAAGIINFVVLTAALSSCNSGIFSTARMLFNLAEQGQAPERLASVNRRGVPVHGVLISVALLFVGVVLNYFAPQKVFVWLTSVSTFGAIWTWCVILIAQLRFRRRVSAERLARLPLRVPCYPLSSFVALAFLAFVVVLMAFSPDTRVALVIGPLWIAALTVYYYASQAGRRSPLGAPTDG

SEQ ID NO: 22148 - protein, 327 aa, Yersinia pseudotuberculosis
MVKKIGVLTSGGDAPGMNAAIRGVVRAALSAGLDVFGIEDGYLGLYENRMKKLDRYSVSDMINRGGTFLGSARFPEFRDPEVRKVALKNMHERGIDGLVVIGGDGSYAGADLLTKEGGIHCVGLPGTIDNDVAGTDYTIGFFTALETVVEAIDRLRDTSSSHQRISIVEVMGRYCGDLTLAAAIAGGCEFIAIPEVEFKRDDLVAEIKAGIAKGKKHAIVAITEKLDDIDSLAKYIEKETGRETRGTVLGHIQRGGAPVAYDRILASRMGSYAVDLLLQDHDYKKGGFCVGVQNEKMVHELISVCIAPENKKSKFKEDWYDTAKKLF

SEQ ID NO: 22149 - protein, 150 aa, Glycine max
REDDRRAWILDEYSEFHGHSPAVVTGKPVELGGSLGRDAATGRGVLFATEALLKEHGMSVSGQRFIIQGFGNVGSWAAQLISEKGGKVVAVSDITGAIKNTNGLDIPSLLKHSREHRGVKGFHGGDAIDPNSILVEDCDVLVPAALWGVI

SEQ ID NO: 22150 - protein, 559 aa, Legionella pneumophila
MCSIGEYLAKRLEELNISEYFAIPGDYNLILLDEVLKNEKIKMINCCNELNAGYAADGYARVKGVSALFVTYSVGGLSVVNAVAGAYAENLPILVISGGPNTNSIQDAEILHHTLATEDNLYVRDIFSRITAHVVCIRKPEQAAMQIDEAIAIAIAKKKPVYIEIACNIANYPISKPTQRAFNTYKISDSSSLAAAVEHAAEKLNSALKPSLIVGSKVRHCNAINSVSELAKCTGYAMAAMPDAKGFISEQHPNFIGIYWGPVSSSGCAEIIDSSDAYLLIGPNENDYTTVGYVWGINPHKSIKTTKGGVIIGETVYTNIFMNDFLRELSKKLKFNDASYKAYKRIAEETVVYPELDQPDAPLSSRYLFGQIQKMLSDKKALLAETGDSWFNCMRLSLPEGCPFEIQMQYGSIGWSVGALLGMQAALHNQKRVIACIGDGSFQMTAQEISTMIRYGYKPIIFLMNNACYTIEVQIHDGPYNVINNWRYAELVNVFRGEQSNAKSFVVKTNKELLTAIKQAEKTDALCFIEVFLDKDDCNKNLLEWGSRVANYNSRPPRR

SEQ ID NO: 22151 - protein, 250 aa, Picea glauca
MEHLNAAAAQASSSLYGVSMAEYGDVGVSSMMALMTQHEPHERDSILTTSMPSSFSSFHGHAECLLSAAMFQASQGDHKLKRQPEMDQLVSEQAVMSDSSMPSVKTEGCSSLRNQFEIRREQTGNCYTDQSSNAPVSPLVTSLVPQAGGEARMITSLEADSSHFSGGNEAEAIKAKILAHPQYPSLLGAYIDCQKIGAPPEVVARLDALTHEYENQQHRTTVSIGMDPELDQFMVKEAYCEMLTKYHEEL

SEQ ID NO: 22152 - protein, 311 aa, Ralstonia metallidurans
MACEKPTDSAPMAYKTIEDTIGNTPLVRLQRIPGTAIEARGNVILGKLEGNNPAGSVKDRPAVSMIRHAEARGRIKPGDTLIEATSGNTGIALAMAAAIRGYRMVLIMPEDLSLERRQSMAAYGAEIILTPVKGGMEYARDLADAMERDGKGVILDQFANPDNPLAHYETTGPEIWKDTDGRVTHFVSAMGTTGTITGVSRYLKEKNPLIQIIGAQPAEGSRIPGIRKWPEAYLPKIYDPKFIDRQEPVTQADAEHMARRMAREEGIFAGISAAGALCVALRIAEEVENATIVFVVCDRGDRYLSTGVFPA

SEQ ID NO: 22153 - protein, 347 aa, Coprinopsis cinerea
MPESDIPRGHLAVSKWFAPTKLVITFEREGLGKFTQEDIESYIQRNEQGEPVSLNLPTKFVFVQTYADWWYAWCFTYFSSPKGVHKYVYITLKKSLRWVPIVGWGMQFFNFIFLARSWASDRLQLASDLASLGKAAEREHRPFCFMLYPEGTLVSKDTRPISKKFADKIGVDDLKHVLLPRSTGLHYSLRSLSPRIQKLKLLDATTVYPGVPPMGYGQNYYTLRSIFFDGVPPPAIHLHLRMFDVRTDVPIGDLSSTKSTPGEKGATPEVEIPPAEKEIFDAWLRQLWQEKDSTIETFHSSGSFSRQPDTTVVEVPLQLRRKWEVLDAFCFFWPAALAYSLKRMREQ

SEQ ID NO: 22154 - protein, 1318 aa, Arabidopsis thaliana
MNPEEQKMESASDLGKLFIGGISWDTDEERLQEYFGKYGDLVEAVIMRDRTTGRARGFGFIVFADPSVAERVIMDKHIIDGRTVEAKKAVPRDDQQVLKRHASPMHLISPSHGGNGGGARTKKIFVGGLPSSITEAEFKNYFDQFGTIADVVVMYDHNTQRPRGFGFITFDSEESVDMVLHKTFHELNGKMVEVKRAVPKELSSTTPNRSPLIGYGNNYGVVPNRSSANSYFNSFPPGYNNNNLGSAGRFSPIGSGRNAFSSFGLGLNQELNLNSNFDGNTLGYSRIPGNQYFNSASPNRYNSPIGYNRGDSAYNPSNRDLWGNRSDSSGPGWNLGVSVGNNRGNWGLSSVVSDNNGYGRSYGAGSGLSGLSFAGNTNGFDGSIGELYRGSSAQTHQPMPQKDTPETTMSEIDKHIEVLKHRKKSTKRSENCRSRRTAISVAEFEELLFRYQVEKETNFLHHKKKVQKSQRSNRNSDSSKSRSPSPSLLQNIIRSLLLSHPHSHSHSHCLKTMKSPAILSENRFLGSITSSSIRNLLPKSISGKQKPIIQNPDTKIPRSNDENAIPVDPNQKASDHHTALQFTKQSDSKDGNFGEPIKDNKMGQSTFAEDKRSLLDSPLKVESRSILSRRTNSVPSEIKEEDDDDSLGDQIRELKEELIRTKSDGYNKADASKSGHFARDSLSQLRVSINKSLLMSCPKRDESEGKEVIVDGEDVLELNKHIEKLHGSYDSVHSSFASASCYEADSMSGDDEDVCSEDLEKPMHGNHKDVDFVDNDPSQLDNVEFDTTGSGISIRSQLPSCVLEEPIFSESPKFKNVQKSVAASTKFSANPRNVSESSNIGDMKVNQISPCMSKKVSGPTDSLAASLQRGLQIIDYHQGSSLSKSSSVSFSFGHMALKPCAEGENLNASVQSFRKDKASEGGLSSILLCLSCRKKVDQEAEVTEEAGSNEKHLKNMCMEQAAKIEELTLLLRKSDDGEDGTEFIKETYETKQISEEFGKTNFEVSEKEALLKEIADLKSKLQPTKSTDNLRSSLLLRSIQMRKSIDVSRNGENSDDLAKEREMWTEMESEWISLTDDLRMDIDNHRSRAENLEFELKQEKLATEELNDALTRAVLGHSRFIEQYTELQETYNELGEKHSVMMAGITDVKKAASKAAMNGRHGKRFAKAFSDELSAIRAEKEKERELLKKENKNLRTQLRDTAEAVQAAGELLVRLRESEQALQVSEERFSVVEEEKERLKKQMEQLKSKHKTEIGTMKQYLAESKLPGSALLQPWYKDEEDEIEQVSEHETGAVSFDDYEDDQAWRAEFGATYQDHHY

SEQ ID NO: 22155 - protein, 406 aa, Mycobacterium tuberculosis
MNAHVTSREGVNEFDDGIVIVGGGLAAARTAEQLRRAGYSGRLTIVSDEVHLPYDRPPLSKEVLRSEVDDVALKPREFYDEKDIALRLGSAAVSLDTGEQTVTLADVTVLGYDELVIATGLVPRRIPSLPDLDGIRVLRSFDESMALRKHASAARHAVVVGAGFIGCEVAASLRGLGVDVVLVEPQPAPLASVLGEQIGQLVTRLHRDEGVDVRTGVTVAEVRGKGHVDAVVLTDGTELPADLVVVGIGSTPATEWLEGSGVEVDNGVICDKAGRTSAPNVWALGDVASWRDPMGHQARVEHWSNVADQARVVVPAMLGTDVPTGVVVPYFWSDQYDVKIQCLGEPHATDVVHLVEDDGRKFLAYYERDGVLVGVVGGGMAGKVMKVRGKIAAGAPIAEVLDQTQA

SEQ ID NO: 22156 - protein, 493 aa, Aspergillus oryzae
MSSALLDEAARIARQFDFPAEGVQRGVKEYIREIDEGLSKEGTTLSQIPTFVTSVPNGTEKGLYLAVDLGGTNFRVCSVDLHGDNTFSLTQSKIMIPRELMASGTSKDLFTFLARQIEAFLRIHHNEHFEAHLKRRREGNSEEDLFDLGFTFSFPVRQVGINKGTLIRWTKGFNIPDAVGHDVCALLQNALDALELPVRVAALVNDTVGTLMARSYTSPGETGTFLGAIFGTGTNGAYVEKLDKITKMATIEHSDYDKTTGEMIINAEWGSFDNHLSVLPNTVYDQQLDEESNNPGIQMFEKRVSGMFLGEILRRVLVDLHRNESLGLFKPSASSDVIVPENSTLFRQWGLDTSLLSLVEADNSESMEPTKTALKDHLKIERASTTDCKAVKTIVHAIGKRAARLSAVPIAAILIATKKLETDDLVDVGVDGSLVEFYPNFEGYMRDALREVPEVGVAGDKKVRIGISKDGSGVGAALIALVASKEEARMKAQ

SEQ ID NO: 22157 - protein, 420 aa, Unknown
  Oceanobacter sp. RED65
MFKRDMNIADFDPAVWEAMQAEVKRQEDHIELIASENYTSPRVMEAQGSQLTNKYAEGYPGKRYYGGCEHVDVVEQLAIDRAKELFGAGYANVQPHSGSQANAAVFMALCKPGDKVLGMSLAHGGHLTHGASVSFSGRIYDAVQYGLHPETGDIDYEEVERLALEHKPKMIIGGFSAFSRIVDWQRFRDIADKVGAYLFVDMAHIAGLVAAGVYPSPVGIADVVTTTTHKTLRGPRGGLILAKEDEELNKKLNFAVFPESQGGPLMHVIAAKAVCFKEAMSEEYKTYQAQVVKNAQAMAEVFIERGINIVSGGTDDHLFLVDLIGKEYTGKDADAALGEAHITVNKNAVPNDPRSPFVTSGLRIGTPAITSRGFKEEQARDLTSWICDVLDSLENGNKDEVAAQVRAKVQALCAEFPVYS

SEQ ID NO: 22158 - protein, 109 aa, Desulfitobacterium hafniense
MAGENVKTFTTANWNEEVLGSDKAVLVDFWAAWCGPCRMVAPIIEELADEMAGRVIIGKLNVDEEPAIAGQYQVMSIPTLAVFKNGQVVDKSVGFRGKADLVKMIEKHA

SEQ ID NO: 22159 - protein, 242 aa, Vibrio vulnificus
MATVSMRDMLKAGVHFGHQTRYWNPKMKPFIFGARNRVHIINLEKTVPMFNEALAELVKVGEKKGKVLFVGTKRAASEAVKEAAIASNQYYVNNRWLGGMLTNYKTVRQSIKRLKELEVQSTDGTFDKLTKKEALMRTREMEKLEKSLGGIKDMGGLPDALFVIDADHEHIAIKEANNLGIPVFAVVDTNSNPDGVDYIIPGNDDAIRAVQLYLNAAASSLTEGRNKDVAAVAEKDGFVEAE

SEQ ID NO: 22160 - protein, 304 aa, Oryza sativa
MATAVASQVAVSAPAGSDRGLRSSGIQGSNNISFSNKSWVGTTLAWESKATRPRHANKVLCMSVQQASESKVAVKPLDLESANEPPLNTYKPKEPYTATIVSVERIVGPKAPGETCHIVIDHGGNVPYWEGQSYGIIPPGENPKKPGAPHNVRLYSIASTRYGDSFDGRTTSLCVRRAVYYDPETGKEDPSKNGVCSNFLCNSKPGDKVKVTGPSGKIMLLPEEDPNATHIMIATGTGVAPFRGYLRRMFMEDVPKYRFGGLAWLFLGVANTDSLLYDEEFTSYLKQYPDNFRLLDIICLDSSY

SEQ ID NO: 22161 - protein, 529 aa, Anabaena variabilis
MKALLLYPRFPQSFWSYDRFIEIAGLKALLPPLGIITVAALLPKNWEIKFCDRNVNPETEADWEWCDLVILSAMLVQKPDFHALIQKAVRLGKKVAVGGPYPTSIPQDALNSGAHYLILDEGELTVPQFLEALNQGQEQGIFRSLEKPDVSQSPMPRFDLLQRDAYLMMAIQFSRGCPFNCEFCDIITLYGRKPRTKEPQQTIAELEALYDLGWRGSLFIVDDNFIGNQRNVKRLLRELIPWMKQHNYPFTFITEASVNLAEDEEMLQLMSEAGFYAVFLGIETPDQDSLQVTQKLQNTRNPLVEACRKINEAGMLIYAGFILGFDGERPGAGERIQAFVEQTSIPQPMLGILQALPNTALWTRLQKEERLLENQGVGGTEVGDQNTLMNFIPTRSIDAIAREYVDGLWTLYEPSNYLRRCFQQCLSIGVPSKRKQTMQFSPGKGLRLVAQLIWHQGLRRPEIRWQFWQQLWTILVKKPQVLNMYLGLCAAGEHFWEYRTLARERITQQLGYDPLKVSVLPKPELMLTK

SEQ ID NO: 22162 - protein, 778 aa, Oryza sativa
MPHRRRLLNPAPSLPPPPAAAPAGFHHHLLAVDDTRLPLLADYALLQGDAAAAPASAEWSAGSGFTGISTDPATATTATTASTATAPGSASNLTAATAGGGGRETWVRRAREGYYLQLSLAIRLTSEAFLAGVPPELLIGCGGGGEAENHADVAADAAAVSYRLWVNGCLSWGDKIAHGFYNILGVDPHVWAMCNAAAEDGRRLPTLVALRAVDSGESSVLEVVLVDKCGDPALADLERRALDLYRAAGVSLDLVRHLAVLVSDHMGGALRSEDGDLFMRWKAVSKQLRKRHRCVVVPIGSLSIGFCRHRAILFKSLADFIGLPCRIAQGCKYCSAPHRSSCLVKIDNERRFVREYVVDLVVEPGRLSSPDSSINGQLLSSVPSPFKTSCTMSSANYATPAASWNRAISGDRRNSILSNPQYSVAKYCVAEEKSSVQVATKEAMLPKCGQITQNGNCNKNSMAVFEVSKQMKAMEISSESGDKDNISSATPLKRLSIEPSFCADWLEISWDEIELKERVGAGSFGTVYRADWHGSDVAVKVLTDQDVGEAQLKEFLREIAIMKRVRHPNVVLFMGAVTKCPHLSIVTEYLPRGSLFRLINKASAGEMLDLRRRLRMALDVAKGINYLHCLNPPIVHWDLKTPNMLVDKNWSVKVGDFGLSRFKANTFISSKSVAGTPEWMAPEFLRGEPSNEKCDVYSFGVILWELMTMQQPWNGLSPAQVVGAVAFQNRRLPIPQETVPELAALVESCWDDDPRQRPSFSSIVDTLKKLLKSMLGGS

SEQ ID NO: 22163 - protein, 168 aa, Kluyveromyces lactis
MSDDFYSYSCETKDGSEYHMSELRGKVVLIVNVASKCGFRGQYGELQELYKEFHAKGFEILAFPCNQFMNQEPGSDEEIGKFCQEHYGVSFKIMKKCKVNGVNALPLYKYLKDQQPRMFGFTFVRWNFEKFLIDRSGRVHGRYSTLTKPKSMKEDIEQLLKQKSQLQS

SEQ ID NO: 22164 - protein, 759 aa, Oryza sativa
MASGNSSSSSGSMAATAGGVGGWLGFSLSPHMATYCAGGVDDVGHHHHHHVHQHQQQHGGGLFYNPAAVASSFYYGGGHDAVVTSAAGGGSYYGAGFSSMPLKSDGSLCIMEALRGGDQEQQGVVVSASPKLEDFLGAGPAMALSLDNSAFYYGGHGHHQGHAQDGGAVGGDPHHGGGGFLQCAVIPGAGAGHDAALVHDQSAAAVAAGWAAMHGGGYDIANAAADDVCAAGPIIPTGGHLHPLTLSMSSAGSQSSCVTVQAAAAGEPYMAMDAVSKKRGGADRAGQKQPVHRKSIDTFGQRTSQYRGVTRHRWTGRYEAHLWDNSCKKEGQTRKGRQGGYDMEEKAARAYDLAALKYWGPSTHINFPLEDYQEELEEMKNMSRQEYVAHLRRKSSGFSRGASIYRGVTRHHQHGRWQARIGRVSGNKDLYLGTFSTQEEAAEAYDVAAIKFRGLNAVTNFDITRYDVDKILESSTLLPGELARRKGKVGDGGGAAAVADAAAALVQAGNVAEWKMATAAALPAAARTEQQQQHGHGGHQHHDLLPSDAFSVLQDIVSTVDAAGAPPRAPHMSMAATSLGNSREQSPDRGVGGGGGGGVLATLFAKPAAASKLYSPVPLNTWASPSPAEQRVGFAKPNSLWWCLSSQSKLKAHSRSNGGRKPSRGSEKNPPNPCMTFSASLDRTNEFEDATLHVDVILLKVHLVYTLGVSSVAASPRVTEDVALSCVFLHYSLTWELIPSAQPSFVRYVQPSSECKLTD

SEQ ID NO: 22165 - protein, 341 aa, Escherichia coli
MKRMLINATQQEELRVALVDGQRLYDLDIESPGHEQKKANIYKGKITRIEPSLEAAFVDYGAERHGFLPLKEIAREYFPANYSAHGRPNIKDVLREGQEVIVQIDKEERGNKGAALTTFISLAGSYLVLMPNNPRAGGISRRIEGDDRTELKEALASLELPEGMGLIVRTAGVGKSAEALQWDLSFRLKHWEAIKKAAESRPAPFLIHQESNVIVRAFRDYLRQDIGEILIDNPKVLELARQHIAALGRPDFSSKIKLNTGEIPLFSHYQIESQIESAFQREVRLPSGGSIVIDSTEALTAIDINSARATRGGDIEETAFNTNLEAADEIARQLRLRDLGG

SEQ ID NO: 22166 - protein, 114 aa, Triticum aestivum
  misc_feature (29)..(30): Xaa can be any naturally occurring amino acid
  misc_feature (33)..(33): Xaa can be any naturally occurring amino acid
  misc_feature (105)..(105): Xaa can be any naturally occurring amino acid
GIGPGPPRFVRTDAYFLINMRYTIELKPXXPYXVIKNWNTPPLWRPSHNGEGKCWTPKVKCEEELTAAIEMALGEKEDSLCFIEVIAHKDDTSKELLEWGSRVSXANSRPPNPQ

SEQ ID NO: 22167 - protein, 121 aa, Chlamydomonas eugametos
SLFAKLGGREAVEAAVDKFYNKIVADPTVSTYFSNTDMKVQRSKQFAFLAYALGGASEWKGKDMRTAHKDLVPHLSDVHFQAVARHLSDTLTELGVPPEDITDAMAVVASTRTEVLNMPQQ

SEQ ID NO: 22168 - protein, 650 aa, Medicago truncatula
MATLAKLLSSICVCVIVMLTTKAVEATPTYTATHCTNTTTYAPNSTFQTNLDILLYYFSNNISQSNGYFLGITGFNSVNAVGGLFLCRGDVATTVCNQCLTTAIKEIRQHCPNQTEALIWYDECLVHYTNRYFAVDKIDPRVNLNDGNIVSSVDLGRFNQSLHGLLNDLATEASGSSESKKFAAGEVVVTESMTVYGLMQCTNDLTNSECGTCLKNAIGTIPNGKQGARALLPSCNVRYQLYPFFTSSSPSSSGGMKLGPGTIAVVVVVPIFFLIILFLGCYYFKRRSKKKILLPSIMENFGDEFPTLESLQFNLATLEAATNQFSLANKIGSGGFGEVYKGVLLDSRQIAVKKLSKTSGQGTIEFKNEIVLIAKLQHRNLVTLYGFCSEEQEKMLVYEYVLNKSLDYFLFDPHKERVLSWRERYNIIGGIARGIHYLHDQSRLKVIHRDLKPSNILLDKNMNPKISDFGMAKMIDIDEHQGNTKRIAGTYGYMSSEYAMHGHYSEKSDVFSFGVIIIEIISAKRNALSLHSLDFDDLLSYAWKNWRDEKSLEILDSNIEKSYSYIEVIRCIQIGLLCVQQNPDDRPTMERIVSYLSNVSVELPLPQEPGGFMGNRTNQIPRDNISDQRNNSNTTGSSVNDITMNNSFPR

SEQ ID NO: 22169 - protein, 1357 aa, Pseudomonas putida
MPGQPAPFCVFHRSPPMANSEVRSVCPYCGVGCGIVMSVADGKVGKISGDKLHPSNFGRLCTKGLTAHQPLSASGRMADAYLRQQRSQPPVRTSMDQAIAATAERLRGIIDQHGPDAVALYVSGQMSLEAQYLANKLAKGFIRTRHIESNSRLCMASASSGYKLSLGADGPPGSYQDFEHADVFLVIGANMADCHPILFLRLLDRVKAGAKLIVVDPRRSATADKADLFLQVRPGSDMALLNGLLHLLHRNGHTNPDFIARHTEGWDEMPAFLDDYTPERVAAITGLAEADIIKAAEWIGSANNWMSCWTMGLNQSIHGTWHSNAICNLHLATGAICRPGSGPFSLTGQPNAMGGRDMGYMGPGLPGQRSALVEDDRAFVERQWQLPPGSLRSEGGEGTVALFGQMKAGEVKACWVICSNPVASVANRQQVIDGLRKAELVITQDAFLDTETNRYADILLPAALWAEGEGVMINSERNLTLMPRAVEPPGQSLPDWQIIARVACAMGYADAFDYPNAEAVYEEIRRFHNPSTGYDLRGIGYAELRTQPRQWPCAPGSEQHRSPLRYLNDGSSQALLLDARGRRPALAFPTASGKAHFFARPWLPAAEVPDDDYPMVLNTGRVQHQWHTLTKTGKVPALNKLEPGPYLEIHPEDAARLGVAEKDQVAVRSRRGQAVLPARISDRVMPGNCFAPFHWNDLIGEQLAINAATCDAVDPLSLQPAFKHCAVALERVAGERIDALDLNTATVEPVRMPTATLSRLLGLHTLPVPVLAEEERHYLQGFLLGLDQARAEGVPRLPASAPLAASRRLFVDGLLAGLFAQPATAPIAAQAAPWHQVLWASQTGNGEQLAERCAARLRGAGLNVQLSCLEAVSPSQLQGAASVVLIASTFGDGDAPDSGAAFWQALQGEEGAHCAGLPYAVLALGDSSYDQFCGFGRKLDQRLAELGGHRLLARVDCEPDFDEAFAGWLEALLPALGTAAAPSPASEPAPVSAFSKQQPWMATVLENRLLNGPGASKETRQLVFDLGGSGFSYAAGDALGVWPRNCPALVEELLTLMQLDGQAMVELKGHSTMPLAEALRAHLEIAKVTAQQLQAFASNAPDLQRLLQPECKAELQDWLWGRQLVDVLRAFPQQLPLASWLELLKPLQPRLYSISSSPLAHPGQVHLTVSTVRYGERKGVCSSFLADRAQVQKVAIFPQVSKHFRLPEDDSVPVIMVGPGTGIAPFRAFLEEREARGAKGDNWLFFGEQYAATDFYYQEQLQAWQAAGHLRLDTAFSRDQVEKIYVQQRMLEQGALLWQWLEAGAYFYVCGDAQRMARDVDAALRVIVAEHGRMDAAAAAAYVEGLSKARRYRRDVY

SEQ ID NO: 22170 - protein, 464 aa, Solanum berthaultii
MVRVTLFLLLLLVSDVVSDHFIVETLPGFHGKLPFTLETGYIGVGEEEKVQLFYFFVPSERDPLNDPLMIWLTGGPGCSGLSSFVYEIGPLTFDYANSNGNFPKLELNSNSWTKVANIIFIDQPAGTGYSYANTSEAYNCNDTLSVTLTYDFLRKWLMDHPEYLNNPLYVGGDSYSGIFVALLTRKIYDGIEVGDKPRLNIKGYIQGNALTDRYIDSNGRIKYANRMGLISDKIYQSAKTNCNGSYFDVDPHNILCLNDLQKVTKCLKNIRRAQILEPYCDLPYLMDILQETPTNGQSVFPIAGPWCREKNYIYSYVWANDKVVQKALNVREGTTLEWVRCNESMHYRGKERTESYVYDVPSAVGDHRHLTSKSCRALIYSGDHDMVVPHLSTEEWIDTLKLPIADDWEPWFVDAQVAGYKVKYLQNDYELTYATVKGAGHTAPEYKPEQCLPMVDRWFSGDPL

SEQ ID NO: 22171 - protein, 850 aa, Pseudomonas putida
MKATASSGQRERLVIVGNGMVGHHCVEQLVSRGALQRFEVRVFGEERQRAYDRVHLSEYFGGSCAETLALCEHDFYEANGVHLHLGEAVLEIDRERREVVTAAGRYGYDQLVLATGSYPFVPPIEGSSGNARLVYRTLDDLDGIRAAAAGARRGVVVGGGLLGLEAANALKSLGLEAHVVEFAPRLMPVQLDGEGGAALKAQIEALGVGVHLSRATQSVSAGETYRYRMNFDGGEHLETDLIVFSAGIRPQDALGRGCGLDIAARGGVVIDNHCRSSDPRIFAIGECASWNGSVFGLVAPGYSMARNLAGLLMGEAAVAFTGADMSTKLKLLGVDVGSIGDAHGATPGARSYRFIDEANSAYRRLVVDASGKHVLGAVLVGDNSYYDTLLQYAQNGIALPADPAALILPQGGGAPALGADALPDSATICSCHNVSKGAVCAAIDSGCSDLAAVKGCTKAATGCGGCAALLKQVFEHELTARGVAVDKSLCEHFAYTRQELYGLVRVEGIRTFSELLERHGKGHLGCDICKPAVGNILASCWNQPIMDPALVPLQDTNDTFMANMQKNGTYSVVPRIPGGEITPDKLIVIGQVAKKYDLYTKITGGQRIDLFGAQLHELPLIWGELIEAGFETGHAYGKSTRTVKSCVGSTWCRYGVQDSVAMALRLEDRYKGLRSPHKLKFAVSGCTRECAEAQSKDIGVIATDKGWNLYVCGNGGMRPRHAELFATDLDDEALVRLIDRVLMFYIRTADKLQRTSVWRENLEGGLDYLKQVIIDDSLGLASELESQMQHVVDQYECEWANALNDPEKLKRFRTFVNDRRADPDVHFVREREQRRPAAPLHLIPTVEEAV

SEQ ID NO: 22172 - protein, 456 aa, Solanum berthaultii
  misc_feature (449)..(449): Xaa can be any naturally occurring amino acid
MVLAFIVFVLMLLLTDVVSSHFIVETLPGFDGQLPFKLETGYIGVGEEEKLQLFYFFVESERDPQNDPLMIWLTGGPGCSGLSTFLYEFGPLTFDYANSSGNFPKLELNLHSWTKVANIIFIDQPVGTGYSYAKTSEAYNSNDTLSATLTYDFLRKWLMDHPEYLKNPLYVGSESYAGIYSALVTRKIYDGVEVGDEPQMNIKGYIQGNALTDAYITVNSRVKYVYHMGLISDKIYQSAKANCNGNYVDIDPNNILCLNDLQKVKKCLNNIQSHHILENWCDLSLLRSNVHSGPWCRENNYIYSKIWANDKAVQKALNVREGTILEWVRCNNSMKYSARESMKRSGSYVYEIQSSIDDHRHLTSKSCRALIYSGDHDMIISHVSTEEWIDTLKLPIVDDWEPWFVEDQVAGYKVKYLQNDYELTYATVKGAGHTAPEYKPRQCMSMVDXWFSGDPL

SEQ ID NO: 22173 - protein, 177 aa, Methanothermobacter thermautotrophicus
MKVDLEIDGSGKSSVNTGLGFLDHMLESVARHGLLDLEVEARGDLEVDDHHTVEDVALTLGEALREALGDKSGIRRMAHAMVPMDDALATVALDLSGRPYTVLELEFDDAVIGDVKSQNIGHFIESLAVSAAMNIHASVRGRNDHHKAEALFKALALAIRDAVRVEHGEIPSTKGKL

SEQ ID NO: 22174 - protein, 461 aa, Solanum berthaultii
MVRVTLFLLLLLVSDVVSDHFIVETLPGFHGKLPFTLETGYIGVGEEEKVQLFYFFVPSERDPLNDPLMIWLTGGPGCSGLSSFVYEIGPLTFDYANSNGNFPKLELNSNSWTKVANIIFIDQPAGTGYSYANTSEAYNCNDTLSVTLTYDFLRKWLMDHPEYLNNPLYVGGDSYSGIFVAPLTRKIYDGIEVGDKPRLNIKGYIQGNALTDRYIDSNGRIKYANRMGLISDKIYQSAKTNCNGSYFDVDPHNILCLNDLQKVTKNIRRAQILEPYCDLPYLMDILQETPTNGQSVFPIAGPWCREKNYIYSYVWANDKVVQKALNVREGTTLEWVRCNESMHYRGKERTESYVYDVPSAVGDHRHLTSKSCRALIYSGDHDMVVPHLSTEEWIDTLKLPIADDWEPWFVDAQVAGYKVKYLQNDYELTYATVKGAGHTAPQYKPEQCLPMVDRWFSGDPL

SEQ ID NO: 22175 - protein, 155 aa, Coprinopsis cinerea
MSSDHTRDPCPWVILNDFGGAFSMGAVGGGIWYGIKGARNSPRGERFVGAISQIKARAPVTGGNFGIWGGMFSTFDCAVKGYRQKEDAWNAIISGFMTGGCLALRSGPKSALGSAIACGILLGVFEGVGVLLGRVFSEGQGPPMAQLPPQPAPAA

SEQ ID NO: 22176 - protein, 631 aa, Taxodium distichum
MSCSARLVVDSYTSSRVPLRESSQWRHQSLSRTSNSRRLHKHVDIHAHVATPTSPIDRKPITQTSTPTPTSTSNSTSLTWRSDPHRIFEIPNRIFPGMGEKKSKSESKSESCGWNPVQRLAAAALDVVEKSFIAGLEKKFPLPKTADPEIQIAGNFAPVPESPVQHELQVVGEIPQCLEGVYVRNGANPLFEPLAGHHFFDGDGMVHAVRLKQGIASYCSRFTRTHRLVEEEKLGRAFYPKAIGELHGHSGIARLMLFYARSMFGLVDPSKGMGVANAGLIYFNGRLLAMSEDDLPYAVRVTEDGDLSTVGRFDFDGQLQSAMIAHPKIDPETKELFALSYDVIKKPYLKYFMFYPDGRKGPDVRISVKEPTMMHDFAITDKYVVVPDQQVVFKLQEMVTGGSPVIYDKEKVPRFGILPKYDSDESRMKWVEVPDCFCFHLWNAWEENEDEVVVIGSCMTPPDSIFNESDEDLRSVLSEIRLNLKTGKSSRREIAPMNLEAGQVNRNKLGRKARYAYLAIAEPWPKVSGIAKVDLEAESPESVVGKIEYKQGCYGGEPFFVPRTSNPEAPEDDGYVLTFMHNEETWQSELLILDAKSPTLEPVASVKLPSRVPYGFHGTFITSQELDQQAL

SEQ ID NO: 22177 - protein, 615 aa, Xanthomonas axonopodis
MTAASSALPPSPLPDERKVLLDRLVDGLDTASLWWLSGYAAGLAQGHPPRSLAVLPGGQAHPLAQEGQRLTVVYGSQTGNARREAEHLAAEAEAAGLSVRLVRADAYPTRELASERLLYVVISTQGEGDPPDDAIGLVEFLSSRRAPKVPELKYAVLGLGDSSYADFCGIARRIDERLAELGGSRVQPRGEADLDIDSVALPWRAQALTHAREQLKGGLHSATVTPLRSSPATPVWSHQQPFAAELLSNQIISGRDFKGPGFRVYAAPGKRVRHLEFSLQGSGLSYEPGDALGIRHRNPPALVDAVLQTLRLDGDAAVTIGEQTLELHAWLATQRELTKLSRPFLTAHAERAGAQELQALLAPTQTAGLASLLADHQVIDVLRRWPADWDHAGLLAALRPLTPRLYSVASSRKRVGDEVHLTVDEVTYQAHGHAHLGAASGFLAALGEGDTAPVYIEPNERFRVPADADRDILMIGPGTGVAPFRGFVQERAETGAKGRNWLFFGAQHFNTDFLYQAEWQLALRRGELHALDLAFSRDQAEKLYVQHRLRARGAEVYAWLQGGAHVYVCGATSMGKDVHAALLDIVATHGAQDAEAAAAYLTQLQVEGRYARDVY

SEQ ID NO: 22178 - protein, 295 aa, Staphylococcus warneri
VLGVSKGASKDEIKKAYRKLSKKYHPDINKEEGADEKFKEISEAYEVLSDDNKRANYDQFGHAGAQGGFGSQGFGGGDFGGFSGGGFEDIFSSFFGGASRQRDPNAPRKGDDLQYTMTITFDEAVFGGKKEISIRKDVTCHTCDGEGAKPGTNKKTCSYCNGAGSVSVEQNTILGRVRTEQVCPKCEGSGQEFEEPCPTCHGKGTENKTVKLEVTIPEGVDNEQQIRLAGEGSPGVNGGPSGDLYVVFRVKPSEVFKRDGDDIYYDLNISFPQAALGDEVKIPTLNSNVVLTIPA

SEQ ID NO: 22179 - protein, 372 aa, Salinibacter ruber
MPAPFARSVLTFSTALMHENGALANGNQTNGHQHPDLAAFEDVDFSEAEMRDVVVIGTGPAGWTAALYTARADLSPLIFMGPEPGGQLTTTTDVENYPGFPEGLMGPEMMDRFQDQAERFGTESRYGTVTHVDFRERPFRLLIDGETPVYAQTAIISTGASARYLGLENEQRLIGKGVSACATCDGSFFRGETVAVVGGGDSAMEESTFLTKFAEKVYVLHRREELRASEIMQQRAFENDKIEFVWNTEVIDVLGESAVEGIEVINNETGETRLMGDVTGFFLAIGHTPNTGPFEGWVQMDETGYIQTEGASTYTDVPGVFACGDAQDSTYRQAVTAAGTGCKAAIDAERWLSEHGAAEAPRADANRQPVEA

SEQ ID NO: 22180 - protein, 295 aa, Staphylococcus xylosus
VLGVSKGASKDEIKKAYRKLSKKSHPDINKEEGADEKFKEISEAYEILSDDNKRANYDQFGHDGPQGGFGGQGFGGQDFSGFGGGGFEDIFSSFFGGGRQQRDPNAPRKGDDLQYTMTVTFDEAVFGSEKEISIRKDVTCHTCDGEGAKPGTKKKTCHYCSGAGHVSVEQNTILGRVRTEKVCPVCSGSGQEFEEPCPTCHGKGTENKNVKISVTIPEGVDNEQQIRLAGEGAPGENGGPQGDLYIVFRVKPSEKFERDGDDIYYSLDVSIAQATLGDEVKVPTLNGSVMLTIPA

SEQ ID NO: 22181 - protein, 456 aa, Staphylococcus epidermidis
METIKKNEVKTGKVIDLTHEGHGVVKVDRYPIFIPNALIDEEIKFKLIKVKKNFAIGKLIEVISESDDRVTPPCIYYAKCGGCQLQHMTYRAQLDMKREQVVNLFHRKGPFENTVIKETIGMVNPWRYRNKSQIPVGQSNSNQVIMGFYRQRSHDIIDMDSCLIQDRQHQEVMNRVKYWLNELNISIYNEKTKTGLIRHLVVRTGYHTDEMMVIFVTNGATFKQSELLVNKLKKEFPNITSIKQNINNSHSNVIMGRQSMTLYGKDKIEDQLSEVTYHISDLSFYQINSSQTEKLYQQALNYAQLTGKEIVLDTYCGIGTIGLYMAPLAKHVYGVEVVPQAIKDAEDNATKNQLKNTTFECGKAEDVILTWKSQGIKPGVVMVDPPRKGCDETFLTTLLKLNPKRIVYISCNPSTQQRDAQILAEQYELVEITPVDMFPQTTHIETVALFVRKDEE

SEQ ID NO: 22182 - protein, 571 aa, Candida albicans
MPEDYEKYRMGSSNESHQKLVQPISSSISKSNKKTKHQTDFVQDSDIIEASSINDEFGEVKRDLKARHVSMIAIGGTIGTGLFISTGSLLHTTGPVMSLISFLFVTTICFSVTQSLGEMATYIPISGSFAQFVTRWVSKSCGAANGWLYWFSWAVTFGLELSVVGQVIQFWTDAVPLAAWISIFFVILTIFNFFPVKFYGEVEFWIASIKIIAVFGWIIYAFIMVCGAGKTGPVGFRYWRNGYAWGDGILVNNNGKYVAAFVSGLINSIFTFQGSELVAVTAGEASPRALRSAIRKVMFRILVFYVLCMLFMGLLVPYNDPKLTQDGGFTRNSPFLIAMENSGTKVLPHIFNAVIVTTIISAGNSNIYSGSRILYGLAQAGVAPKFFLRTNKGGVPFFAVAFTAAFGALGYLACSSQGNKAFTWLLNITATAGLISWGFISVSHIRFMKTLQRRGISRDTLPFKAFFMPFSAYYGMVVCFIVVLIQGFTVFWDFNASDFFTAYISVILFVVLWVGFHFFFYGFGKDSFKMSNILVPLDECDIDSGVRDINDAEFDIPPPKNAWDKFWANVA

SEQ ID NO: 22183 - protein, 550 aa, Solibacter usitatus
MSMLPPETPEQHTLRFPKLSAAQIAQLAPWCVRRHANAGEVVYDVGSAAHGVYIVESGSLEIIGVTSGVETVVAVLEPGEFTGETNLLSGRRALVRCRARSASALLEIERANLRRVMQSDATLGDLFLRAFLLRRVFLIANSVGDAVLIGSKHSADTLRLRTFLGRNGHPYAYLDVDADADVQNVLDHFSVRIDEIPVLICRGELVLRNPTNAEAAVCFGLNAGIEAEGVYDLIVIGAGPGGLAAAVYGASEGLSTLVVECNAPGGQAGSSSRIENYLGFPMGISGQELADRAFLQAEKFGAQISVARTATELKCRRPPYAVQLDDGSVVQGRTMIVASGSRYRRLDLPNIGKFEGSGIYYGATTVEAPLCQSEVVAVVGGGNSAGQAAVFLSGYASHVHLLVRAPGLAATMSRYLIARIEASPEITVHTFTNVEALEGDTRLERIRWRNTKTGMTESHEIHHLFLMMGADPNTGWLSECVALDGKRFIKTGPELADDWPLQRAPFPLETSLPGIFAVGDIRANSIKRVASAVGEGSMAVQFVHQVLAGT

SEQ ID NO: 22184 - protein, 337 aa, Nostoc punctiforme
MELGMIGLGRMGANMAHRLTQAGHTVIGYTRQPQKAEVLVQEGAIARGVTSFVELIEALTPPRAVWLMLPAATVDATLHTLMPFLDADDIIIDGGNSHYIDDIRRADQLKVKGIEYIDCGTSGGIWGAERGYCLMIGGALAVVKYLDPIFAALAPGVSAAPRTPGRELMGGTAEQGYLHCGSHGAGHFVKMVHNGIEYGIMAAYAEGLNILHHANIGKQLHQIDAETAPLRNPEFYQYDFNLADIAEVWQRGSVISSWLLDLIAIALLKDPDLANFEGRVSDSGEGRWTLMAAIEEGVPVPVLSTALYTRFSSRGQSDFANKLISALRYEFGGHLEK

SEQ ID NO: 22185 - protein, 501 aa, Pichia pastoris
MSDNNQPLPPVSNSILEHIGKTPLVKLNRIPKILNLKPQVYAKVELFNSGGSIKDRIALRMVEQAEKEGRIKPGYTLIEPTSGNTGIGLALVGAVKGYRTIITLPEKMSNEKVAVLKALGAEIIRTPTEAAWDSPESHIGVARRLEKEIPNAVILDQYGNVNNPDAHFYTTGAEIWDQTNGKVTHGVAGAGTGGTITGIAKFLKSKNPNIQIIGADPHGSILALPESLNTSNEQYKVEGIGYDFIPEVLDREIVDTWYKTDDKDFFKLARQLISEEGILVGGSSGSALSAAVKIINDAKLDESAVVVVVCPDSIRSYLTKFADDDWMKLNGFTEDEPAPLKRKSSFSKDTLSSYTIKDLALKPVVSVTIDDSIESTINILQTKGFDQLPVLKNDKLAGIVTLSQLLRLLSNKKIHLTSKVESAYFDFSKLENFEKSYNINKESTNKRREYQKITTSTTLAKLNKFFETSSAAIVENDKGQPIHIVSKVDLLSFLASKGEFN

SEQ ID NO: 22186 - protein, 529 aa, Arabidopsis thaliana
MEASISFLGSTKPNISLFNPSSNVLPRRDFPLPALKLKKVSVLPRILHQKRLIRAQCSDGFKPEEDDGFVLEDVPHLTKFLPDLPSYPNPLKESQAYAIVKRTFVSSEDVVAQNIVVQKGSKRGVHFRRAGPRERVYFRSDEVKACIVTCGGLCPGINTVIREIVCGLNNMYGVNNILGIQGGYRGFYSKNTMNLTPKVVNDIHKRGGTFLQTSRGGHDTAKIVDNIQDRGINQVYIIGGGGTQKGAEKIYEEVERRGLQVAVSGIPKTIDNDIAVIDKSFGFDTAVEEAQRAINAAHVEVESVENGVGIVKLMGRYSGFIAMIATLANRDVDCCLIPESPFFLEGKGGLFEFIEERLKENRHMVIVIAEGAGQDYVAQSMRASETKDASGNRLLLDVGLWLTQQIKDHFTNVRKMMINMKYIDPTYMIRAIPSNASDNVYCTLLAQSAVHGAMAGYSGFTVGPVNSRHAYIPISVTEVTNTVKLTDRMWARLLASTNQPSFLTGEGALQNVIDMETQEKIDNMKISSI

SEQ ID NO: 22187 - protein, 234 aa, Triticum aestivum
MGETEEVKLLGVWFSPYAIRPKIALRLKSVDYDYVEEDLFGSKSELLLKSNPVHKKVPVLIHNNKPILESLNIVEYIDETWNASDPSILPSHPHDRAQARFWSAFVDDKWFPALKAAAITKSEEAKEKGMKEVEGGLLQLEEAFVSISKGNPFFGGEAIGFMDICLGSFVGILKAREKLKGEKLLDESKIPFLCKWANEFLSDDTVKNVVPEIDKVVEFLGELEVRAQSAVSKT

SEQ ID NO: 22188 - protein, 917 aa, Pseudomonas syringae
MLTKLGIKGRVLLLTILPASLMAAMLGGYFTWMQLSELQSQLLQRGEMIAQDLAPLAANALGRKDKVLLSRIATQTLEQTDVRAVSFLDTDRTELAHAGPTMISPSPIGSGSQLLSSTGTDATRYLLPVFGSQRHLTSPIIPAEADTLLGWVELEISHNGTLLRGYRSLFASLLLILTGLACTATLAVRMSRTINGPMSQIKQAVSQLKDGNLETRLPPLGSRELDELASGINRMAATLQNAQEELQLSIDQATEDVRQNLETIEIQNIELDLARKEALEASRIKSEFLANMSHEIRTPLNGILGFTHLLQKSELTPRQFDYLGTIEKSADNLLSIINEILDFSKIEAGKLVLDNIPFNLRDLLQDTLTILAPAAHAKQLELVSLVYRDTPLALSGDPLRLRQILTNLVSNAIKFTREGTIVARAMLEDETEEHAQLRISVQDTGIGLSSQDVRALFQAFSQADNSLSRQPGGTGLGLVISKRLIEQMGGEIGVDSTPGEGSEFWISLKLPKAREDKEESLNIPLGGLRAAVLEHHDLARQALEHQLEDCGLQTIVFNNLENLLNGVTAAHETPAAIDLAVLGVTALEISPERLRQHIWDLENLNCKVMVLCPTTEHALFQLAVHDVYTQLQAKPACTRKLQKALSELIAPRAVRADIGPPLSSHAPRVLCVDDNPANLLLVQTLLEDMGAEVVAVEGGYAAVNAVQQEAFDLVLMDMQMPGMDGRQATEAIRTWEAERNQSSLPIVALTAHAMANEKRSLLQSGMDDYLTKPISERQLAQVVLKWTGLALRNPAPERQNEAPEVHVGPLVLDHEEGLRLAAGKADLAADMLAMLLASLDADREAIRVARASQDVHALIERIHRLHGATRYCGVPQLRTACQRAETLLKQNAAHTEEALDDLDKAIIRLESEARVTA

SEQ ID NO: 22189 - protein, 485 aa, Sinorhizobium meliloti
MSQKLSVFPAFFRVAQKSVAVFGNGDEAFAKLRLLLNTEARIVAYADRPEPAFDAFLDANNIETVREPFGAHQVEGSVLVFAATGDAALDRVVVTAARERKIPANAVDQPDYCDFLTPALVNRAPVAVAIGTEGAGPVLAQMIRAQIDQLLSPSLGIVASLAANYRDAVERLVPRGVARRVFWRRFFSGPVADQVALGDLASARREASRLLDAAGGVAGHVWLVGAGPGAEDLLTLRAQRVMMEADAIVYDALVPQAIVDMGRRDAERLSVGKRKGCHTKSQDEINQLLVKLAGEGKRVVRLKSGDPLVYGRAGEEMAALREAGISYEVVPGITSAFAAAADFELPLTLRGVASSLVFTTGHDLTGSVLPDWARLAVSGATIAVYMGRTVAASVASRLMQAGLPQDTTVAVIENASRAERRLLHGTLRDLPDLEARTELDGPVMVIIGEAVAGANFERSEPLAAGRTKYSGASKVSAKRTEQIWN

SEQ ID NO: 22190 - protein, 452 aa, Arabidopsis thaliana
MEQKMESASDLGKLFIGGISWDTDEERLQEYFGKYGDLVEAVIMRDRTTGRARGFGFIVFADPSVAERVIMDKHIIDGRTVEAKKAVPRDDQQVLKRHASPMHLISPSHGGNGGGARTKKIFVGGLPSSITEAEFKNYFDQFGTIADVVVMYDHNTQRPRGFGFITFDSEESVDMVLHKTFHELNGKMVEVKRAVPKELSSTTPNRSPLIGYGNNYGVVPNRSSANSYFNSFPPGYNNNNLGSAGRFSPIGSGRNAFSSFGLGLNQELNLNSNFDGNTLGYSRIPGNQYFNSASPNRYNSPIGYNRGDSAYNPSNRDLWGNRSDSSGPGWNLGVSVGNNRGNWGLSSVVSDNNGYGRSYGAGSGLSGLSFAGNTNGFDGSIGELYRGSSVYSDSTWQQSMPHHQSSNELDGLSRSYGFGIDNVGSDPSANASEGYSGNYNVGNRQTHRGIEA

SEQ ID NO: 22191 - protein, 760 aa, Candida albicans
MIMNMTTDYRDPLLDLFGTESNSGNETSSPSDIPVINRSGTFNQQQFSPLLTQQSLYNTPNSGSTPNIFDPNYTQMQEEQTSPSSNKLQPEDPPRKKRNTRSQTKIHQQSEGDEYNSNDYKDSIDLDKPPVVEPSPPFFVESDTTPEFVIPTPTSEQQQQQHHELIAQDYQRSNNSNQFGNLTHYEPNLPPLPPLSESILPQTNTFHPLVLPHDPRHAITAGPANNSQQQQQRQQQDSSIPSDGISSKIQQLHAPSLSNNQSASQRKKKESSGPKTRPAFVMKIWSMVNDPANHEYIRWNDDGKTFQVFHREDFMKVILPKYFKHNNFASFVRQLNMYGWHKVQDVANGTLNQNSDKNGQDEIWQFENPNFIKDREDLLDKIVRNKSSSNQDDVSGVSFNGINNSANLSLILQELETIKMNQYVISEDLRRVRQDNKMLWQENYLNRERNQVQGRTLDKILKFLSVVYGNNANKILNGHGFADFSDSNNIMTQYRPSPMGSPLLSRPQTQPPPSNSRFARDNNQTAQPTYESPLSTSDTNNNNNNTFEYQQAVNRPRLMLTNRAHSRRPSMSRTKSTPEGSIEEIIRSYSNDKAAESNVNRMYEQLVGHQPGATTNNNNHSSSTAISAPSPRHSFLQELNLPGTPRNLDDLEKHINKEGQSIQQVQDWIDKLAQEQHEKQQQQQGNDDDDDFDVNEFLKDATTTPSSNVPNGGHYNNGNISFVGSPIAMTPGSNVSSNINDSDGNEKKSKKRSIEEVSDH

SEQ ID NO: 22192 - protein, 178 aa, Mycoplasma gallisepticum
MKDKGLALRFLISLERKEMVKKIYLAGGCFWGVEEYFKRTKRIIDSSVGYANYKPEFRNPTYKEVCSGLTGGVETVEITYDDQIISLEEIIDHFLKVVDPTTLNYQKNDRGTQYRSGFYFVNDDDETVIKSKLAQAQGRYSKPIVTEVLKLQNFSKAEDYHQDYLEKNPGGYCHIKFE

SEQ ID NO: 22193 - protein, 107 aa, Lilium longiflorum
RAAPAQASMVAPFVGLKSSSAFPVTQKPATGLPTLPSNGGRVQCMKVWPIVGKKKFETLSYLPTLPVEALLKQIEYLIRSGWVPCLEFSLVGFVSRDYHQSPGYYDG

SEQ ID NO: 22194 - protein, 491 aa, Coprinopsis cinerea
MAEPTGDIGLIGLAVMGQNLILNMNDKGFNVVAYNRTTSKVDHFLANEAKGTNIQGAHSVQELVAKLKRPRKIILLVKAGSAVDDFIKQLEPHLEAGDIIIDGGNSHFPDSIRRTKELEAKGLLFVGSGVSGGEEGARYGPSLMPGGSTAAWPAIKDIFQKTAAQVNGEPCCDWVGETGSGHYVKMVHNGIEYGDMQLIAEAYDILKRGLGLDEDEIADIFLKWNKGVLDSFLIEITANILKFKDDDGEHVVNKILDKAGQKGTGKWTAIAALDAGTPVTLIGEAVFARCLSAIKEERVRASKIISGPAKEPFRGDKKQFIDDLEQALYASKIISYTQGFMLMRETAKELGWHLNYAGIARMWRGGCIIKSVFLGDITAAYTKNPELESLLFDDFFNKAVHNAQAGWRRIIAQAVLWGIPTPAFSTALAFFDGYRSEIVPANLLQAQRDYFGAHTFRVLPGKENERFKAGEDIHVNWTGRGGNVSASTYNT

SEQ ID NO: 22195 - protein, 197 aa, Streptomyces coelicolor
MSRVGRVERTTKETSVLVEIDLDGTGKTDIATGVGFYDHMLDQLGRHGLFDLTVKTDGDLHIDSHHTIEDTALALGAAFRQALGDKVGIYRFGNCTVPLDESLAQVTVDLSGRPYLVHTEPENMAPMIGEYDVTMTRHILESFVAQAQVALHVHVPYGRNAHHIVECQFKALARALRYASERDPRAAGILPSTKGAL

SEQ ID NO: 22196 - protein, 1035 aa, Debaryomyces hansenii
MISRVVARSARANRLSTLTRSVPRAYNLNLKLAASNRFLASKADTSSADYEKVYDPSAKTVSLGNLDTFARRHLGPTPENVKTMLSALGYKDLDEFLSKAIPEHVLYKRALQIQPQQGFTELEMLEHLHNLANKNKIVKSFIGKGYAGTKVPPVIQRNLLESPEWYTSYTPYQPEISQGRLESLLNYQTMVTSLTGLNMANASLLDEGTAAGEAMSLSFHSLKGKRGKYAVDTNLHPQTLDVMKSRAENIGVEIVELPLSTQEGLEELERIASDSCGALVQYPGTDGSLNNYTKVGEIVHAHKGLFAMATDLLALTLIKSPAEFNADIALGTSQRFGVPFGYGGPHAAFFATNMKYSRKIPGRIVGLSKDRLGKPALRLALQTREQHIKREKATSNICTAQALLANMAAMYAVYHGPKGLKDIASRVYGYTTVLANEISNNSQHEIVNDKWFDTLTVKLGGGVKSDEILNKALNEYNINLFKAGEDKVSLCLDETVEEKDLIALVDVFTGNDLFSTSSISELPKLPTELLRTDEILAHPVFNTHRSETSMLRYLHLLQSRDLSLANSMIPLGSCTMKLNATVEMQTLSMPGFNQIHPFAPLNQAQGYKELVDEFEKDLNDITGFDATTNMPNSGAQGEYTGLSLIRQYHKSKGEYEQRNICLIPVSAHGTNPASAAMCGLKVVPVKCLNNGSIDVDDLKVKAEKHAENLCSIMITYPSTYGLFEPGIKTAIDLVHNNGGLVYLDGANMNAQVGLTSPGDLGADVCHLNIHKTFALSHGGGGPGQAPVCVKEHLKPFLPKHHFLDTPHSTNESIQAVNSAPYGSASVIPVSYSYIKMLGAKALPHVSSIAMLNANYMLEKLKDDYQIMFVDHSASTDEGLKHCAHEFILDLREFKAVGVEAIDVAKRLQDYGFHAPTMSFPVAGTLMIEPTESENLEELDRFINSLLSIRKEINAMANKEPLGQVLKNAPHSLNDIVSTSQADWEARGYTREQAAYPLPFLKESKCWPSVSRVDDTYGDMNLMCTCPSVEEVAADQ

SEQ ID NO: 22197 - protein, 584 aa, Aspergillus oryzae
MATPGNQNHRAWWKESSVYQIWPCSFKDSNDDGIGDIPGIISKLDHIKNLGIDIVWLCPSYKSPQVDMGYDIADYYDIAPEYGTVADVEKLIKGCHERGMKLLMDLVVNHTSDQHEWFKQSRSSKDNEYRNWYIWKPARYDEQGNRQPPNNWVSHFQGSAWEWDEHTQEYYLHLYATEQPDLNWEHPPVRKAVHDIMRFWLDKGANGFRMDVINFISKDQRFPDAPIKDPRTPWQWGDKYYANGPRLHEYFQELGKILKEYDTFSVGEMPFVTDTEEVLRAVKYDRNELNMIFNFEHVDIDHGKYDKFEPGSWELTDLKFFFERWQKFMYENDGWNALYWENHDQPRSVDRYTNAKEEDRVIASKMLATILALKAGSPFVYQGQEIGMGNVPPEWDIEEYKDIDCLNHWKRLPNDPEIQKIARQEYQKKSRDNGRTPVQWTNAPNAGFTSPNVKPWMSVNPNYARGINAEAQVNDPNSTYSYWASVLGLRKKYVDIFVYGNYELVDRDSQEIFAYTRQYEDQKALVLANWTDGTLEWDSSSNGVKAVKDVLLNTYDSASDVKERFSGSKWSLRPYEAVVLLIEA

SEQ ID NO: 22198 - protein, 547 aa, Leuconostoc mesenteroides
MRIIIVGGVAAGMSAATRLRRLSEKDEIIVFEKGPFVSFANCGLPYHISKTIKHRSQLIVQTADDLRSRFNIDVRVNSEVTHIDRDNKMISVNHDDQQEKLYYDKLILSLGSSPVIPKIEGLHTQSNIFQLRNIPDLDNIMSHLDESIKTVAVLGAGFIGIEVTENLIKRGFSVNLIERSNQILPNLDIEMAQSITNELIKNDVRINTGTTINKVSRDILYLDNGMSIQADAVIIAAGIRPNSDIAIAAGLKVGPNKGIVVDHDFKTSDSNIYAIGDVISVIHQITEQETLIPLAGPANRHGRQVADAIHGLSIKNKPEIGTSIVKVFSKSAASTGINEKQAKQLGLNYHVTHTFSYHHASYYPGATQVMMKLIFTNTGDIIGAQAVGNEGVDKRIDLLATAIKFRLKVDDLPELELTYAPPFGAAKDPVHISGYVAENIINSRSHNIQYNELENYRRDGYLLIDVRSSQEIRAMGLINGFINIPLEKIRDRINQIPKDTGIIVSCATGQRSYTAERIFINNGFRNVKNLDGAFSLYQLMYPQNIVK

SEQ ID NO: 22199 - protein, 699 aa, Unknown
  Azoarcus sp. BH72
MPTAIKKTFTYGAHTVTLETGEVARQAGGAVIVNVDDTVVLATVVAAKDAKPGQDFFPLTVDYVEKFYAAGRIPGGFFKREGRPTEKETLTSRLIDRPIRPLFPEGFYNEVQVIVTVLSLNPEVDADIPAMIAASAALSISGIPFDGPIGAARVGYADGQYLLNPTVEQLKTSKLNLVVAGTASAVLMVESEADELSEQVMLGAVVFGHEQMQAAINAINELVEVAGKPEWNWQPPAANDALVARVKELALADVEEAFRITSKQARTERLSEIRKRTIAALTDGVDNAPSENEIKDIFFTLEAGTVRSRILNGEPRIDGRDTRTVRPIDIRVGVLPRTHGSALFTRGETQALVVATLGTGRDEQIIDAIAGEYKERFMLHYNFPPFSTGETGRFGVTKRREIGHGRLAKRALVAMLPKGEDFSYTIRVVSEITESNGSSSMASVCGGSLALMDAGVPMKDHVAGIAMGLIKDGNRFAVLTDILGDEDHLGDMDFKVAGTENGVTALQMDIKIQGITKEIMQVALAQAGEGRLHILKQMKDALGVARGEVSEFAPRMLNMKINPEKIRDVIGKGGAVIRALQEETGTVIEIEDDGSITISSVSAEGAQKAKARIEDITAEVEVGKVYEGTVVRLLDFGAIVNILPGRDGLLHVSQIANERVNNVGDYVKEGQAVRVKVLETDERGKIRLSMKALLNENAG

SEQ ID NO: 22200 - protein, 443 aa, Methanothermobacter thermautotrophicus
MALAVYLVPLPGLRASGHAALALLVFAVTMWATEAVPLAVTSLIILFAQPLIGVESFENAVIGFANPILFLMIGGFIMAEAIRKSGLAQRFTYYLLGRLGTSPERGLFVSIFSTGLLSAWIENVVAFAMLLPIIKEIVDIMGCSEPEKGKSNYAKAMILGASFGSLAGGFGTEIGTAPNLMAAAYTSIPFLNWMIFGLPLSIAMLLVTWFLLMRIFPSEVRALENGDALIGERIRMMGSMSRDEKLSAGILLFAILLWVTAGFTGINSYSVSLIAAVMFIFAGVITWKDAQKNIDWGLVVFFGGALSLGSALLKTGAAAWIIDKLVGMLGSDPSTVIVMLVLMAVAVIITQVMSNIALSAILVPLSVTLASAQHQPIGVYAVPVAIACSLSFMLPMADPTVAMAYGSGYVKLRDIPRAGIPIIAVGIILTVLVITTLAAPFIS

SEQ ID NO: 22201 - protein, 478 aa, Lactobacillus plantarum
MSNEKPQIGVIGMAVMGKNLALNIESRGYKVAIFNRTGAKTEKVVKDHADKQLVPSYKIEDFVASLETPRRIIMMVKAGKPTDAVIDELLPLLDKGDVLIDGGNTNFNDTMARNARLDKSGINFIGMGVSGGELGALQGPSLMPGGQKEAYDLVAPILEKISAKAPQDGAPCVTYIGPNGAGHYVKMVHNGIEYGDEELIDESYNIMRNVAGLSVDEMSDIFTDWNKGELSSYLIEITADILSRKDDLGADKTKPIVDMILDRGNNKGTGKWSSEDALNVQVPQSVITEAVYARYISMMKNERVAASKKLAGPTADVDLPAKEELVEKIRQALYFSKIMSYAQGFEQLRFASEHYGWDLKFGELAQIWRAGCIIRAQFLQNITDAFDKKPDLNNLLMDDYFADIAAKYQQSTREVLSLAIQAGVPVPSFSAALSYYDSYRAEVLPANLLQAQRDYFGAHTYERTDREGLYHYSWYEEQ

SEQ ID NO: 22202 - protein, 328 aa, Oryza sativa
MAKSSADDAELRRACAQAVAASGARGEEVSFSIRVAKGRGIFEKLGRLAKPRVLALTVKQSTKGEAAKAFLRVLKYSSGAVLEPAKLYKLKHLTKVEVISNDPSGCTFVLGFDNLRSQSVAPPQWTMRNIDDRNRLLFSILTMCKEILSYLPKVVGIDFVELALWAKENTVTLDNQSSTQDGQEKSVTTQTERKVTVTVENDLGSQAKDEEEDMEALLDTYVMGIGEADAFSERLKQELVALEAANVYQLLQSEPLIDEVLQGLDAASATVDDMDEWLRIFNMKLRHMREDIASIESRNNGLEMQSVNNKGLVEELEKLLDRLRIPQE

SEQ ID NO: 22203 - protein, 423 aa, Xanthomonas axonopodis
MKSFPTAISRRYGLALPQRCCRTVTPAFPLLADLRGRAVLVVGGGADAERATGQLLQAGALPLVGAPELTAQLRHWAQAGRLRWLAGRFDPAWLAQSDQPLWLTIAASESAALNDALRQAASAHRLLTHAAAPAASATVPARSTGPRSAIGTLAPGNVSLVGAGPGDPGLLTRHALRALRQAEVVLHDRLVSPQILRLARHGAHLIEVGKSAQGHSTRQEQIHGLMLEHARAGRRVVRLKGGDPFVFGRGGEELEFLRAHGIGFQVIPGITAAIACAAYAGIPLTHRDHAQSLRLITAHCKDSLDTLDWQALGQERQTLAFYMGVAGLDAIQQRLLQAGRAPTTPFALVENGSRPQQRVITGTLASLAASARQHAVTAPALLILGEVTALAQTLHWFGSAPLSASPPHSPGATPHTPTLAHAA

SEQ ID NO: 22204 - protein, 548 aa, Dechloromonas aromatica
MRITLVHPAGFNFVPGQPDFSVLANRMPPIGIMQLASWLEKFGHSVQLHDCLGPYAPPTIAENAEIVLATDPEMVGFSATTSGFMDAFEIAAYIRERRPEIRIVFGNVHVSSLGAPILEHFPEIDYLVIGEGEGSFLDLADGKPLNEIGNLVWRNENGRIVVNPRRDRILDLDELPFPAYEKLAGFPHAYHLPLFAYEKRFGATMITSRGCPYTCSFCDRTVFERLYKTNSAQYTYDHMKYLRDNFGVYHINMYDDLFTAKKQRVFDLCELLIEKPLGIQWNCAIRTGHTSDEMLAKLKQAGALMVSMGIESADPGMMERHKAGVTLDAVRDTVRQIHAAGLRAKGLFIFGMPGETPETVKVTSDFILSLDLDEMNMTKFSPLHGAPIWDECAAGVGGEMIEDWRLMNCLNFVYLPEGFKSREEMDALYNWHVKRFYDSKGYRHRFAKRLWAHRWSLWHVLKHLPETIAAARYFSSNKEQLEKAKREFKLHPRQPVGLKPQLSTDLQIDNIVAMSPVKLSRREAMKAIIPLVYEGSSCCSPPAPQPAV

SEQ ID NO: 22205 - protein, 319 aa, Xanthomonas axonopodis
MALYDNILDTIGRTPVVKLQRLAPDNVTLYVKVESFNPGGSVKDRLALAIILDAEQRGLLKPGDTIVEATSGNTGVALAMVAAARGYKFVATMVETFSIERRKLMRAYGAKVILTPAAERGSGMVRKAKELAEQHGWFLASQFANPANPAYHRNTTAAEILRDFAGHRLDHFVTGWGTGGTLTGVGEVLSVARPEVRITASEPAGAALLQGQDWKPHKIQGWTPDFIPEVLNREVAHEVLSVEDTDAITVARRLAAEEGIFTGISGGATVATALRVAEGAVPGAVILAMLPDTGERYFSTPLFADINEGSDDDWLAGLP

SEQ ID NO: 22206 - protein, 201 aa, Oryza barthii
GVLPSDQEIAVKRLSQSSRQGIEELKNELVLVAKLQHKNLVRLLGVCLEEHEKLLVYEYMPNKSLDTILFDPDRSNVLDWWKRLKIVNAIARGLQYLHEDSQLKIIHRDLKASNVLLDSDFNPKISDFGLARLFGNDQSQDVTNRVVGTYGYMAPEYAMRGHYSIKSDVFSFGVLILEIVTGRKNNVSYDSEQSVDLLTLV

SEQ ID NO: 22207 - protein, 183 aa, Alteromonadales bacterium
MDSIYQFNAPLYNSENFSLSELKGKTVLIVNTASKCSFSMQLNALEKLYQEYKDRGLTVLAFPCNQFGQNEPLDNLAIRDFYQMQFGVSFKVFGKVMVNGPDAHPLFSYLKCHTRGISQNRAVKWNFTKFLINSQGQLVARYAPRTKPETLKQVIETHLQKAVESSEIKATPIMSALNRRTAL

SEQ ID NO: 22208 - protein, 201 aa, Oryza barthii
GVLPSDQEIAVKRLSQSSQQGIEELKNELVLVAKLQHKNLVRLLGVCLEEHEKLLVYEYMPNKSLDTILFDPDRSNVLDWWKRLKIVNGIARGLQYLHEDSQLKIIHRDLKASNVLLDSDFNPKISDFGLARLFGNDQSQDVTNRVVGTYGYMAPEYAMRGHYSIKSDVFSFGVLILEIVMGRKNNVSYDSEQSVDLLSLV

SEQ ID NO: 22209 - protein, 271 aa, Burkholderia xenovorans
MNPNTGKVTLLSAGPGDLDLLTLKAAKALAAADVVLLDDLANPEIVTLAPQARVIRVGKRGGCRSTPQAFIERLMRCYALKGLHVVRVKGGEALLFGRAGEELAVLRGAGIPVEIVNGISSGFAAAAGLGISLTHRRHCHGVSFVTAHTEDHGEPDWAALAATRTTLAIYMGMRRIGSIAAALLASLPADTPAAVVQWAGGGNERRLMSRLDRLAEDAVSAGFGSPAVILVGSAIGESIERAWGEDSAGRDEKAAMQADMRIAREAIAQAA

SEQ ID NO: 22210 - protein, 862 aa, Burkholderia xenovorans
MPQDGARNQHIEETALMKIIVIGHGMVGHKLVECLAEDAAHGLDITVLCEESRPAYDRVHLSEFFAGKTADDLSLVEPGFFERRNVLLKLNAKAVAIDRDARTVTVSTGETLPYDKLVFATGSYPFVPPVQGRERTDCFVYRTIDDLEAMRECGARSKTGTVVGGGLLGLECAKALRDMGLQTHVVEFAPRLMAVQVDDGGGRVLRTKIEELGVTVHTQKNTTAIVDGEAGTHRMQFADGSHLDTDMIVFSAGIRPRDDLARESGLTLGARGGIVIDNACRTSDPHIYAIGECALWNGQLFGLVAPGYEMARAVAKQLLGGAAEFAGADMSTKLKLMGVDVASIGDAHGSTPGSRAYQFSDERKQVYKKLVVSECGKYLLGGVMVGDAGEYGALLQMMLNRIELPASPEFLILPQADGNAKPALGVEALPAGAQICSCNNVSKGELCAAVCAGATDIGALKGATGAGTSCGGCVPLVTQVMKAEMKKQGLAVNNHVCEHFPYSRQELYHIVRVEGVRSFGALLAKHGHGLGCDICKPLVASILASCWNEFVLKKEHASLQDTNDYYLANIQRDGTYSVVPRMAGGEVTPDGLIAVGQVAKKYGLYTKITGGQRVDLFGARVEQLPLIWEELIAAGFESGHAYGKSLRTVKSCVGSTWCRYGVGDSVGLAVEMENRYKGLRTPHKIKFGVSGCTRECAEAQGKDVGIIATEKGWNLYVCGNGGMKPRHAELLASDLDKETLVRYIDRFLMFYVRTADRLQRTSVWRDNLEGGLEYLIDVVVNDRLGVAGELESEMQHVVDTYECEWKKAVTDLETRKRFRHFVNSGESDSNLAFVEERGQIRPATPAERRSKLAAIPVVAETV

SEQ ID NO: 22211 - protein, 230 aa, Brassica napus
MDPDAVKSTLSNLAFGNVLAAAARDYKKEVLANEKAQSSNHVNEEVDLDELMDDPELEKLHADRIAALKREVEKREAFKRQGHGEYREVSEGDFLGEVTRSEKVISHFYHKEFYRCKIMDKHLKTLAPRHVDTKFIKVDAENAPFFVSKLAIKTLPCVLLFSKGIAVDRLVGFQDLGTKDDFTTTRLENVLIKKGMLSKKKKEEDDEDAEYQESIRRSVRSSENLDSDSD

SEQ ID NO: 22212 - protein, 248 aa, Picea glauca
MEHLNAAAAQASSSLYGVSMAEYGDVGVSSMMALMTQHEPHERDSILTTSMPSSFSSFHGHAECLLSAAMFQASQGDHKLKRQPEMDQLVSEQAVMSDSSMPSVKTEGCSSLRNQFEIRREQTGNCYTDQSSNAPVSPLVTSLVPQAGGEARMITSLEADSSHFSGGNEAEAIKAKVLAHPQYPSLLGAYIDCQKIGAPPEVVARLDALTHEYENQQHRTTVSIGMDPELDQFMEAYCEMLTKYHEEL

SEQ ID NO: 22213 - protein, 201 aa, Oryza meridionalis
GVLPSDQEIAVKRLSQSSRQGIEELKNELVLVAKLQHKNLVRLLGVCLEEHEKLLVYEYMPNKSLDTILFDPDRSNVLDWWKRLKIVNGIARGLQYLHEDSQLKIIHRDLKASNVLLDSDFNPKISDFGLARLFGNDQSQDVTNRVVGTYGYMAPEYAMRGHYSIKSDVFSFGVLILEIVTGRKNNVSYDSEQSVDLLSLV

SEQ ID NO: 22214 - protein, 1401 aa, Burkholderia xenovorans
MSSTSVKTVCPYCGVGCGMVLHVEDGQVVKISGDKEHPANFGRLCTKGQSAHVALRKSGRLEGAFVRHARGRDPAPLPMTQAISATAARLRGLLDEHGPDALSFYVSGQMSIEAQYLVNKLAKGFVGTNNIESNSRLCMASAGSGYKLSLGADGPPGSYEDIDHADLFFVIGANMADCHPILFLRMMDRVKAGAKLIVVDPRRNTTAEKADLFMQIKPGTDLALLNGLLHLLHENGHTDAAFIAEATEGWEAMPAFLADYTPEKAAQITGLAVEDIRAAAQMIGSANEWISCWTMGLNQSTHGTWHTNAICNLHLATGKICRRGSGPFSLTGQPNAMGGREMGYMGPGLPGQRSVLVEEDRAFIEDLWRIPKGTLKPEAGNGTIDMFTRMAAGEIKACWIICTNPVASVANRQNAIDGLRAAQLVIAQDAFLDTETNRYADVLLPGALWAEAEGVMINSERNLTLMQKGVEPPGAALPDWQIIARIACEMGYAEGFTYASAEEVFAEITRVSNPKTGYDLRGASHRRLKETPLQWPLASDESAERNPVRYLNDGVSQTLKELADGSRPRLVFPTASCKAVFFARAYAAPAELPDREFPIVLNTGRLQHQWHTMTKTGKVAMLNKLNPAPFVEIHPEDATTLGIKAQDPVEIRSRRGRAVLPAVVTERVSAGSCFAPMHWNDVFGDDLCINAVTSDAVDPISQQPELKFCAVALSPVAADSRQPLLTDDDATITDASVAVAVSAAPGNTVSASAEDLDMPRIDALTSLLQLPPTPAPSFNDQQRLYLAGFVSGLRSAEAKGIDSTPVLPGNAPFDTTSRLYVDGLLAGLYSRSAMVPAASAPTLAVSHAETSHASGVRIVRARPKVTLLWASQTGNTESLTEGYATRLMESGFEIRTSCMADYPASALAKAQYVLLMTSTFGDGDPPDNAQSFWTQLSGEGAPRLDGVRFAVLALGDRNYDQFCGHGRRLDERLAGQGAQRLMDRVDCDSEYQASADAWLERIIVRIKEEDAALYAVPAGGMVNAVVPGTVPTKTRPAASRLVSNLRLNKQGAAKDTRYVSLHTGDSGLEYEAGDALGVWPSNCPELVDELIGLSGLHADAAVNVAGAGEMRLADALGKHYEIARPNPDLLAFVAARSNNGALRDLLAPDRKADLKQWLWGQQIADVLHEFPVSLTASELTGMLKRLQPRLYSIASSPKAHAGEVHLTVAAVRYSNGRRHRKGVSSTFLADRAGDVNVPVFVQKSAHFRPPHGSETPMIMVGPGTGVAPFRGFLHERRARGDTGRNWLFFGEQHAASDFYYRDELESMRDSGVLTRLDVAFSRDQADKVYVQDRMREQGAQLWAWLEDGAHFYVCGDANRMAKDVDAALKEVVARHGGMSDDKALEYVSRLAQEKRYARDVY

SEQ ID NO: 22215 - protein, 201 aa, Oryza meridionalis
GVLPSDQEIAVKRLSQSSRQGIEELKNELVLVAKLQHKNLVRLLGVCLEEHEKLLVYEYMPNKSLDTILFDPDRSNVLDWWKRLKIVNGIARGLQYLHEDSQLKIIHRDLKASNVLLDSDFNPKISDFGLARLFGNDQSQDITNRVVGTYGYMAPEYAMHGHYSIKSDVFSFGVLILEIVTGRKNNVSYDSEQSVDLLSLV

SEQ ID NO: 22216 - protein, 497 aa, Lactobacillus reuteri
MKFSELGLSDSLLKAIKRSGYEEATPIQEQTIPMVLEGKDVIGQAQTGTGKTAAFGLPIIENVDTENPNIQAIIISPTRELAIQTQEELYRLGKDKHVRVQVVYGGADIRRQIKSLKQHPQILVGTPGRLRDHINRHTVKLDHIKTLVLDEADEMLNMGFLEDIESIIKETPDDRQTLLFSATMPPEIKRIGVQFMSDPETVRIKAKELTTDLVDQYYVRARDYEKFDIMTRLIDVQDPDLTIVFGRTKRRVDELSKGLIARGYNAAGIHGDLTQDKRSKIMWKFKNNELDILVATDVAARGLDISGVTHVYNYDIPSDPDSYVHRIGRTGRAGHHGVSLTFVTPNEMDYLHEIEKLTRVRMLPLKPPTAEEAFKGQVASAFNDIDELIAQDSTDRYEEAAEKLLETHNATDLVAALLNNMTKEAASEVPVKITPERPLPRRNKRNNRNGNRNNSHGGNHYRRKNFRRHQHGSHRNDNHGKSHSSRHSFNIRHRKEN

SEQ ID NO: 22217 - protein, 224 aa, Anabaena variabilis
MYKHISFVLSVLLLGGGTATIPTIAQGQVLVVQANNAELKRLLEDGKRLVDAGDYNGAIAVYQQAATMEPRNARIHSGIGYLHAQQGNFQAALASYRRAIAINPNNSDFFYAVGYIKGNMGDTPGAKEAYRRAIQLNRNNVSAYVGLGITQSRMGDFQSANWAFEQAIKLDKNNAQTYEFMAAMYKQRRQTKQASNLLQKARDLYQRRNDADGVARVEAMLQQL

SEQ ID NO: 22218 - protein, 630 aa, Mesorhizobium loti
MCGIFGIVLKNEGTPVCAAAVERCADALAHRGPDASGLYINQSVAFAHRRLSIVDAHSRANQPYRDANTGVVVTYNGEIFNYREIRTELRDMGFFFSTVSDTEVLILSYIAWGKSFLNRLDGIFAFALFDPRNSLVLIARDRLGVKPLYYTICDVGLLFASQPNALIRWPGVMRGPDMIGALSFLSYRAVVGARTLFAGISKLEPGHLLEIRNGRHTSERWWNLSERISRCKPDYSDIRRLLGSAVERQLVADVPVAALLSGGLDSSILAYEASARSQIRPICYTGKVETADYDETAYAMEVAAEFGLTHRVVPIGEPSDIYAVSELVRLRGHPLGMHNEIAMFTLAKAISKEHKVVLTGEGADEIFAGYSRLFRTPYDYNRSKIIAALPRALAQVARRRLGLDVHGSQLQFFLARYSYFPTDEIRSLVIDGRVRREHEMALFDHFSTQFAEAGGDFFSKISYVLVSTHLPALLEMVDNTTMAAGLEARVPYTDHQLVTAAMAMPGSQRLRWRSPIASVQALWHPVASFSERLDVSKFPLRREYRSVLPRSVLSRKKMGFPLPLGQWAVGEGATEYRRLLFDKDSPLGDLFDPAALRRWFEAGRRNPSDSFGRKFWLLANLGIFFKEVFS

SEQ ID NO: 22219 - protein, 420 aa, Rickettsia conorii
MNIFNNNLHETDKEINEIIKHEKLRQSSVIELIASENFVSPAVLEAQGALLTNKYAEGYPSKRFYNGCEEVDKAENLAIERVKKLFNCKYANVQPHSGSQANQAVYLALLQPGDTVLGMSLDSGGHLTHGAAPNMSGKWFNAVSYSVNKETYLIDYDEIERLADLHKPKLLIAGFSAYPRNIDFAKFREIVDKVGAYFMADIAHIAGLVATGEHQSPIPYAHAVTSTTHKTLRGPRGGLILSNDEAIGHKINSALFPGLQGGPLMHIIAAKAVAFLENLQPEYKSYIQQVISNAKALASSLQERGYDILTGGTDNHIVLVDLRKDGITGKLAANSLDRAGITCNKNAIPFDETSPFITSGIRLGTPACTTRGFKEKDFVLVGHMVADILDGLKNNEDNSALEQKVLNEVTKLIELFPFYG

SEQ ID NO: 22220 - protein, 390 aa, Trichodesmium erythraeum
MTNLKTPAKEVGFTHEDFAALLDKYDYHFSPGDIVAGTVFSLEPRGALIDIGAKTAAYIPIQEMSINRVENPEEVLQSNETREFFILTDENEDGQLTLSIRRIEYMRAWERVRQLQAEDATVRSQVFATNRGGALVRIEGLRGFIPGSHISTRKPKEDLLNEELPLKFLEVDEERNRLVLSHRRALVERKMNRLEVGEVVIGAVRGIKPYGAFIDIGGVSGLLHISEISHDHIETPSSVLKVNDELKVMIIDLDADRGRISLSTKQLEPEPGAMVKNPQMVYDQAEEMAAKFREKMMAPQGGETAVETPEVGVIAEATEAPEGVATAEALEAPEEVATSEALKVPEEVITSEALEVPEELATEASQKTEETETTVEIAIVDEETSAAALE

SEQ ID NO: 22221 - protein, 831 aa, Bordetella parapertussis
MSMARRDFIKQTAAAAAATVAGVPLTGYTQNIVTESEAAKLKWSKAPCRFCGTGCGVNVAVKDNQVVATHGDFNAEVNKGLNCVKGYFLSKIMYGSDRLTQPLLRIKDGKYAKDGEFAPVSWDQAFDVMAEQFKRVLKDKGPEAVGMFGSGQWTVWEGYAALKLMKAGFRTNNLDPNARHCMASAAVGFMRTFGADEPMGCYDDIENADAFVLWGSNMAEMHPILWTRVTDRRLSAPATKVAVLSTFEHRSYELADLTLTFEPQSDLAILNYIANHIIRTKRVNRDFVDKHTVFREGNADIGYGLRPEHPLQQAARNAGDAGGSKPITFDDFARFVSKYDLEYTAKLSGVPKNRLEELAELYADPKVRVTSFWTMGFNQHTRGVWCNNMVYNIHLLTGKISTPGNSPFSLTGQPSACGTAREVGTFSHRLPADLVVTNPEHRRHAEEIWKLPDGTIPSKVGAHAVLQNRMLKDGKINAYWVMVNNNMQAAANLMNEGLPGYRNPENFIVVSDAYPTVTTLSADLILPAAMWVEKEGAYGNAERRTQFWHQLVDAPGQARSDLWQLVEFSKRFKVEEVWPADLLAKKPEYRGKTLYDVLFANGKVNQFPNTELDPEYANQEAQAFGFYLQKGLFEEYAEFGRGHGHDLAPFDVYHKARGLRWPVVDGKETLWRYREGSDPYVKPGTGFQFYGNPDGKAVIFALPYEPPPEAPDKEYPFWLSTGRVLEHWHSGSMTRRVPELYKAFPEAVCFMHPDDAQALGVRRGVEVEVVSRRGKMRTRVETRGRDKPPRGLVFVPWFDAGQLINKVTLDATDPISFQTDFKKCAVKIVKV

SEQ ID NO: 22222 - protein, 144 aa, Triticum aestivum
  misc_feature (108)..(108): Xaa can be any naturally occurring amino acid
  misc_feature (116)..(116): Xaa can be any naturally occurring amino acid
  misc_feature (131)..(132): Xaa can be any naturally occurring amino acid
  misc_feature (143)..(143): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFNKVGFIFREQNATPGYXNGGTGTMXWKLPMFGVQPTPRKXXTKVEEVKEREXP

SEQ ID NO: 22223 - protein, 748 aa, Filobasidiella neoformans
VSQSHPNIVDGWFREINTQWPGQAMTLKVKQILHQEKSLFQDVLVFESETYGNVLVLDGVIQATERDEFSYQEMITHLPMASHPNPENVLVIGGGDGGVIREVLKHKSVKKVTLCDIDEAVIRVSKQWLPLMSDCYKDSRVEVHIGDGFKFLPEHKNEYDVIITDSSDPVGPAEALFQPPYFQLLKEALKEGGSVSTQAECLWVHLPLIKTLKETCSKLFPVVKYGFTTIPTYPAGQIGIMVCSKDSTRDLTVPLRAVPTPRYYNSEVHRAAFTIPEFGRAMLEDGVNVLPKFSGARPTPTTTKKKVLLLGSGLVAGPAADYIARHNHELTIACRTLASAQDLASGLPNATPMSVDVSSADALRQAIKGHDVVVSLIPYTYHAQVMEAALEEKVHVVTTSYVNPQMRALEQKFKDAGLICFNEIGVDPGVDHLWAIKVFDEVKKAGGKIKSFYSFCGGLVEPAAADNALGYKFSWSPVGVLMALNNDGKYLKDGKVVEVAGKDLMSTAKPYYFTPAYNLVAYPNRDSTVFREFYGLEGVQNLCRGTMRYAGFCEVITAWKEIGLMSDAQVDYLAQGAAPITWIKVVSQLLGVEAKEAAVIEKLKTLKSFETESRVLITKFRDLGLFSEEQVAQRGSVMRALSALLEEKCAFKEGEVDLVLLQHTFEIINADGSEQTITSSLEAYGDRNGGPSAMAKLVGVPCGMAVQFILEGVLNKPGVFAPYDEETCKLFRERLEKEEGITMVEKLV

SEQ ID NO: 22224 - protein, 311 aa, Unknown
  Shewanella sp. ANA-3
MFFEGAEKKLEIRLTPKMASLRQREYGFWSTLVACANAEILSTISNPACDAYLLSESSLFVWDDKILLLTCGNSTLVDAACHFINALGVEHIAALCYQRKNEYQAQRQSTSFVDDIAKLRTLIPGKAFRVGHLDSHHHYLFCTDKQTVSSTETCLELMMYHIRGELADYLKLPTQTEQGIYQRLGFQQLFGDFQFDMHCFQPAGFSLNAIRGTDYVTLHITPSLGLGEHSYVSFETNLDLANYSHPVVARLVDLFSPISWDLISFNQPILTAGLPEHLCLGQAEVTTASGGEITFSHYQQLETQVLQPEFM

SEQ ID NO: 22225 - protein, 127 aa, Arabidopsis thaliana
  misc_feature (59)..(59): Xaa can be any naturally occurring amino acid
  misc_feature (64)..(65): Xaa can be any naturally occurring amino acid
  misc_feature (71)..(72): Xaa can be any naturally occurring amino acid
  misc_feature (78)..(78): Xaa can be any naturally occurring amino acid
  misc_feature (80)..(80): Xaa can be any naturally occurring amino acid
  misc_feature (83)..(83): Xaa can be any naturally occurring amino acid
  misc_feature (92)..(94): Xaa can be any naturally occurring amino acid
  misc_feature (100)..(101): Xaa can be any naturally occurring amino acid
  misc_feature (104)..(104): Xaa can be any naturally occurring amino acid
TFFEPGLFLDTQGKGLRALAKSQIDEILQPAECTIVSSLSNDQLDSYGLSESVSLSSVXIVIKXXGLLSSXXYGAPLXVXGGXFLEVKVGRXXXGNFPGXXGKXFPPEFKKGGALLKIGVKKGGPNG

SEQ ID NO: 22226 - protein, 246 aa, Bacillus licheniformis
MSVISMKQLLEAGVHFGHQTRRWNPKMKRYIFTERNGIYIIDLQKTVKKVEEAYNFTKNLAADGGKILFVGTKKQAQDSVKEEAERSGMYYVNQRWLGGTLTNFETIQKRIKRLKDIEKMQENGTFDVLPKKEVVQLKKELERLEKFLGGIKEMKELPDALFIIDPRKERIAVAEARKLNIPIIGIVDTNCDPDEIDVVIPANDDAIRAVKLLTSKMADAILEAKQGEESAETEAKEAETTETTTA

SEQ ID NO: 22227 - protein, 532 aa, Oryza sativa
MDAAHKRKRPDADDDGAAGAVDLSSLEGADDVEVLDLRAAKRLLLAFERRLRDNLEARMKHPDDPARFADSEIALHAETDRLRLLAGAPDLFPDLVPLGLASSLSSLLTHDNADLAAAAASLLADLTDSDDPDDLAGLHSLADALVEANALDLLVHNLSRFSEADPDEAEAVHHTLSVVENLLELRPQLADIVCDRTKLLRWLLARLKAREFDANKQYASEILAILLQDSPANQKRLGNINGVDGLLQAVAMYKSRDPKTSDEEEMLENLFDCLCCVLMPMENKERFVKAEGVELMIIIMKQKKLAYSSAIRTLDFAMTRFPPACERFVDVLGLKTAFAAFMDSCEQEKQKRELSGSTRRTGHFTNCFIVWGSEDATFDFLNTSSVSQCGITKGSRRIRLLGKFVENECEKIDRLMEFYTRYSERVKAETERLDSLDLDDLEMDEDERYNRKLEAGLYTLQLIALILGHIWHSGNSQMRTRIELLLRQNKLTKDDVKDILEEYHDNIGDLDGPEEKERAQGRTKEIIASLSL

SEQ ID NO: 22228 - protein, 109 aa, Buchnera aphidicola
MTNCIVELTDGIFKQYILESKKAVLVDFWAEWCNPCKILAPILEDIAKEYEHKLIVTKINIDKNPNTAPKYSIRGIPALLLFKNSELVGTKVGALSKVQLKDFLNLYLK

SEQ ID NO: 22229 - protein, 704 aa, Xanthomonas axonopodis
MAKITKTFQYGKHTVTLETGEIARQAGGAVIVKVDDTVLLVTAVAAKSAREGQDFFPLTVDYQEKFYAGGRIPGGFFKREGRATEKETLISRLIDRPIRPLFPEDYKNEVQIIATVMSMNPDIDGDIAALIGASAALSLAGTPFKGPIGAAKVGYKNGEYILNPTVTELKDSQLELVVAGTANAVLMVESEAELLSEEVMLGAVTFGHREMQKVINVINELTVEAGTKPSDWVAPAKNDGMIAALKEAVGDQLASAFQVRDKLQRRDAISAIKKDVLGALAPRATIEGWAAGDLAKEFGELEYQTMRGSVLSTKVRIDGRALDTVRPISATAGVLPRTHGSALFTRGETQAIVITTLGTARDGQVIDAVSGEYKENFLFHYNFPPYSVGECGRFGAPKRREIGHGRLAKRGVLAVMPTLEEFPYTIRVVSEITESNGSSSMASVCGSSLALMDAGVPIKAPVAGIAMGLVKEGNDFVVLSDILGDEDHLGDMDFKVAGTAEGVSALQMDIKIEGITEEIMKQALQQAKAGRLHILGEMAHALTTPRQELSDYAPRLLTIKIHPDKIREVIGKGGSTIQAITKETGTQIDIQDDGTIIIASVNAIAAQAAKSRIEQITSDVEPGRIYEGKVAKIMDFGAFVTILPGKDGLVHVSQISSERVEKVGDKLKEGDLVRVKVLEVDKQGRIRLSIKAVEEGEGVQASAE

SEQ ID NO: 22230 - protein, 203 aa, Solanum demissum
MDILGNLYIDPLPLVIPTTTSSTTFDNNSNEKVMLLLASKIPKRRGDRKKFHETRHPVYRGVRWKNFEKWVSEVRVPAKKSRIWLGTFPNAEMAAKAHDVAVMALKGRSACLNFADSTWRLPVPASAAVKDIQKAAAEAAEAFRVSESLERENSEEVVINNDDHYVVDSGWRLVIPASAVARDIQKAVAEAFCPSESSKGEYF

SEQ ID NO: 22231 - protein, 384 aa, Solanum demissum
MAIDCMITRNNNMTSKEGQEYDIIKTNKSLSFDASLMKNESNIPSQFIWPDHEKPNCASVTRELQVPLIDLSGVLSNDPIEIKKATRLVNEACTKHGFFLVTNHGVDTNLIKKAHVYIDKFFELPLCEKQKAQRRVGEHCGYASSFIGRFSSKLPWKETLSFQYSDEKGSSHIVEQYFQRTLGEKFSHIGKIYQEYCNAMSTLSLGIMELLGLSLGVSKNHFKEFFQENESIMRLNYYPTCQKPELTLGTGPHCDPTSLTILHQDSVGGLQVFVDNEWHSITPNFNAFVVNIGDTFMALSNGRYKSCLHRALVNNKVPRKSLTFFLCPKKDKVVTPPIELVDSNNPRIYPDFTWPTLLEFTQKQYRADMNTLQTFSNWLKKTHP

SEQ ID NO: 22232 - protein, 571 aa, Arabidopsis thaliana
MGDEIVPPANQLAADNLENDGSTVQKAQFSDRVLIRSILGGGAKLAGQKVRIGGWVKTGRQQGKGTFAFLEVNDGSCPANLQVMVDSSLYDLSRLVATGTCVTVDGVLKIPPEGKGLKQSIELSVETVIAVGTVDPTTYPLPKTKLTPEFLRDVLHLRSRTNLISAVARIRNALAFATHSFFQEHSFLYIHTPIITTSDCEGAGEMFQVTTLINHTERVEQDLIDNPPPTEADVEAARLIVKERGEAVAQLKVAKASKEEITASVAQLSVAKASLAHVEERLRLKPGLPKNDGKIDYSNDFFGRQAFLTVSGQLQVETYACALSSVYTFGPTFRAENSHTSRHLAEFWMVEPEIAFADIHDDMNCAEAYVKYMCKWLMDKCGDDMELMDKNVDEGCTKRLNMVAKASFKRVTYTEAIERLEKAVAQGKVVFDNKVEWGIDLASEHERYLTEVEFDQKPIIVYNYPKGIKAFYMRLNDDEKTVAAMDVLVPKVGELIGGSQREERYDVIKQRIEEMGLPMEPYEWYLDLRRYGTVKHCGFGLGFERMIQFATGIDNIRDVIPFPRYPGKADL

SEQ ID NO: 22233 - protein, 313 aa, Crocosphaera watsonii
MSNTKKKLTIIGAGLWGQALAKLAQYNDQNNVKIWSRTSSESLASVVQEADVILSAVSMKGVRLTVEKLTALTIPEETIFISATKGLETKTLLTPSQIWQKSFPSHPVVVLSGPNLSKEIQQRLPAATVVASEDVVAAAKVQEIFSSDIFRVYSNQDPIGTELGGTLKNVMAIASGVCDGLQLGTNAKSALLTRALPEMIRIGTELGASRETFFGLSGLGDLIATCYSPLSRNYRVGYGLSEGKTLEQILIELGSTAEGINTANVLIELAQKHRIAIPISRQVYQLINGETTPQEAVKELMARDLKAEFDVLS

SEQ ID NO: 22234 - protein, 396 aa, Streptococcus pyogenes
MSDFLFFIESFYGLVSYIMNNTEYYDRLGVSKDASQDDIKKAYRKMSKKYHPDINKEAGAEQKYKDVQEAYETLSDSQKRAAYDQYGAAGAQGGFGGGAGGFGGFDGGGFGGFEDIFSSFFGGGGSRNPNAPRQGDDLQYRVNLSFEEAVFGVEKEVSYNREATCGTCLGSGAKPGTAPVTCRKCHGSGVMTIDTQTPLGMMRRQVTCDICHGSGKEIKEPCQTCHGTGHEKQAHKVSVKIPAGVETGQQIRLQGQGEAGFNGGPYGDLFVILNVLPSKQFERNGSTIYYSLDISFTQAALGDTVEIPTVHGDVEMAIPAGTQTGKTFRLKGKGAPKLRGGGQGDQHVTVNIVTPTKLNDAQREALQAFAEASGDKMLHPKKKGFFDKVKDALEDI

SEQ ID NO: 22235 - protein, 84 aa, Vigna radiata
GGYYDAGDNIKFGFPMAFTTTMLSWSVIDFEKSMGAELGNALKAVRWGTDYLLKATAKIGSGVVFVQVGDPYSDHNCWERPEDM

SEQ ID NO: 22236 - protein, 325 aa, Glycine max
MAGLVVSSQCFLKLLLVVSVFHVSFAARRLNELVQDQSQLLHYHNGPLLYGKIAVNLIWYGNFKPSQKAIITDFVTSLSSPASQSSQPSVATWWKTTEKYYHLSPKNKKAASSLSLSLGDQFLDEGFSLGKSLTSKNLVELASKGGQRNAINVVLTSADVAVEGFCMSRCGTHGSSSSASHVKKNNNGKNYKFAYIWVGNSETQCPGQCAWPFHQPIYGPQSPPLVAPNNDVGLDGMVINLASLLAGTATNPFGNGYFQGPAEAPLEAASACPGVYGKGAYPGYAGNLLVDSATGASYNVEGDNGRKYLVPALYDPSTSSCSTPV

SEQ ID NO: 22237 - protein, 530 aa, Glycine max
MVSACVTLKANTHLVKSRKDNTFRQDGGFLGERIKGGLNYSPWIINQLASTSSLRTQEKVNKAKPGVVSAVLTSSNIKESVAFQMPSFLRRKADPKNVVSVILGGGPGIQLFPLTKRAATPAVPVGGCYRLIDIPMSNCINSGLNKIFVLTQFNSASLNRHISRTYFGNGINFGDGCVEVLAATQTQGEAGNNWFQGTADAVRQFTWVFEDAKHANIENVLILAGDHLYRMNYMDLVQSHVDRNADITVSCAAVGESRASDYGLVKADARGRIIQFSEKPNGADLKAMQVDTSVLGLPLHEAKRSPYIASMGVYVFKTDVLLRLLKWRYPTSNDFGSEIIPAAVRENNVQAYFFIDYWEDIGTIKSFYDANLALTEENPMFKFYDPKTPIYTSPRFLPPTKIDKCRIVDAIISHGCFLRECTVQHSIVGERSRLDYGVELQDTVMMGADYYQTESEIASLLAEGKVPIGIGRNTKIRNCIIDKNAKIGKDVIIMNKDGVQEADRPEDGFYIRSGITVILEKATIEDGTVI

SEQ ID NO: 22238 - protein, 772 aa, Xylella fastidiosa
MQNSLLTQHIAQIIATEISSQPTQARAAIALLDEGASVPFIARYRKEATGGLDDTQLRTLETRLTYLRELEERRSAILASITEQGKLNDLIHAEILAADTKSRLEDLYLPYKPKRRTRAQIAREAGLEPLADSLLTDPTLIPETVAANFVDPEKGITDIKTALEGARAILIERWGEDAALIGELRQWLANNGVIHARLIDNKEDTGAKYRDYFNHTELLSKIPSHRLLALFRARSEEILHLDLDPGNDADAGHQYCESMVMQAACVADQGRPADTWLMTACRLTWRAKLHMHLMLDLFNQAREKAEAEAITVFSNNLKDLLLAAPAGPRIVLGIDPGIRTGCKIAIVDTTGKLIATETIYPHEPRREWDKSLHTLKTLCTQHHVTLIAIGNGTASRETDKLVSDLIKAHPALKLQKIVVSESGASVYSASESAAKEFPNLDVSLRGAVSIARRLQDPLAELVKIDPKAIGVGQYQHDVDQFHLAKALDARVEDCVNAVGVYVNTASAALLSRVSGLSASVAENITRYRDEHGSFKQRQDLLKVPRLGAKTFEQCAGFLRIADGNQPLDASAVHPEAYPVVERIVQTTGKPIKALIGDSHTLRMLKPEQFTDTNFGIPTIRDIIKELEKPGRDPRPEFKAVRFTEGVENIKDLKPGIILEGVVSNVAAFGAFVDIGVHQDGLIHISALADRFVKDPRDIVKAGDIVKVKVLEIDVPRKRIALTCRLHEETPPETPAANRTGNERGRPNPVAKKLKATPTDNALAQAFARARLK

SEQ ID NO: 22239 - protein, 201 aa, Oryza longistaminata
GVLPSDQEIAVKRLSQSSRQGIEELKNELVLVAKLQHKNLVRLLGVCLEEHEKLLVYEYMPNKSLDTILFDPDSSNVLDWWKRLKIVNGIARGLQYLHEDSQLKIIHRDLKASNVLLDSDFNPKISDFGLARLFGNDQSQDVTNRVVGTYGYMAPEYAMRGHYSIKSDVFSFGVLILEIVTGRKNNVSYDSEQSVDLLTLV

SEQ ID NO: 22240 - protein, 202 aa, Prunus mume
LTHEIRGTLDRHTILKTTLVELGRTLALEECALWMPTRTGLELQLSYTLRQQNPVGYTVPIHLPVINQVFSSNRALKISPNSPVARMRPLAGKHMPGEVVAVRVPLLHLSNFQINDWPELSTKRYALMVLMLPSDSARQWHVHELELVEVVADQVAVALSHAAILEESMRARDLLMEQNIALDLARREAETAIRARNDFLAV

SEQ ID NO: 22241 - protein, 379 aa, Mannheimia haemolytica
MAKKDYYEVLGLSKGASEKDIKRAYKRLAAKHHPDKNQGSKESEEKFKEITEAYDVLTDSEKKAMYDQYGHAAFEQGGAGAGGFGGFGGGGFGGFEDIFSEMFGGGFGGGGRRQRVVRGDDLRYDIEITLEEAVKGCKKDIRIHTLAECDTCHGTGAEAGSKVETCSHCHGSGRIRRQQGFFVTDAVCPSCHGTGKRIEKPCRSCHGDGRVHKAKNLSVTIPAGVDTGNQLRLSREGAAGENGAPAGDLYVVIPVKEHDIFERDGSNLYCEVPIIFTLAALGGEIEMPTLDGQLKLKFRQKLQPVNYSVLRGKGVTSPRGGYAGDLICKVVVETPVNLTEEQKALLRQFEESLEGQGKHRPKHEGFFDGVKKFFDNLGK

SEQ ID NO: 22242 - protein, 98 aa, Gracilaria tenuistipitata
MSDYNVTLLLEDDKTATIKCPDTTYILDQAEESGYELPYSCRAGACSTCAGKLVSGTIDQDDQSFLDDDQIQEGFVLTCIAYPTSDCTILTHQESSLY

SEQ ID NO: 22243 - protein, 202 aa, Prunus mume
LTHEIRSTLDRHTILKTTLVELGRTLGLQECALWMPSRAGMNLQLSHTLNYQIQVGSTVPINLPVVNEVFTSSRAIRIPYTCPLARIRPLVGRYVPPEVVALRVPLLNLSNFQINDWPDLSAKSYAIMVLILPTDSTRKWRDHELELVDVVADQVAVALSHAAILEESMRARDQLMEQNIALDLARREAEMAIHARNDFLAV

SEQ ID NO: 22244 - protein, 201 aa, Oryza nivara
GVLPSDQEIAVKRLSQSSRQGIEELKNELVLVAKLQHKNLVRLLGVCLEEHEKLLVYEYMPNKSLDTILFDPDRSNVLDWWKRLKIVNGIARGLQYLHEDSQLKIIHRDLKASNVLLDSDFNPKISDFGLARLFGNDQSQDVTNRVIGTYGYMAPEYAMRGHYSIKSDVFSFGVLILEIVTGRKNNVSYDSEQSVDLLSLV

SEQ ID NO: 22245 - protein, 379 aa, Streptomyces albus
MATDYYAVLGVRRDASQDEIKKAFRRLARELHPDVNPDPKTQERFKEINAAYEVLSDPQKKQVYDLGGDPLSQNGGGGAGGFGQGGFGNFSDIMDAFFGTASQRGPRSRTRRGQDAMIRLDIELDEAAFGTTKDIQVDTAVVCNTCNGEGAAPGTSAQTCDMCRGRGEVSQVTRSFLGQVMTSRPCPQCQGFATVVPTPCPECAGDGRVPSRRTLTVKIPAGVDNGTRIQLAGEGEVGPGGGPGGDLYVEIHELPHSVFQRRGDDLHCTVTIPMTGPRPSAPRCLETLDGMEEIDIRPGTQSGQSVPLHGRGITHLRGGGGRDLIVHVEVTTPGKLDAEQEHLLRELAKLRGEERPTGQFQPGQQGLFSRLKDAFNGRS

SEQ ID NO: 22246 - protein, 242 aa, Brassica napus
MVGSTSSNNSLAGLQDHSKLAREYALEGSYDTSVIFFDGAIAQINKHLNSLDDATSRTKWMNVKKAVMEETEVVKQLDAERRAFKEAPTGRSRPSSPPINSTKSSSFVFQPLDEYPTSSSSSGAPIDDPDVWRPPTRDVASRRPARAGQSGMRKSPNDGAWARGGGPTTRAAPASRGGRGGKSAAASARSSAVGKKGAASKSTKPESTNGDGEDGKSKRGLYDGPDEDLAAMLERDVLDSTP

SEQ ID NO: 22247 - protein, 729 aa, Synechococcus elongatus
MFDLSKFLPVITPLMIDTAKTLCPYCGVGCGLEAVPPAQPGRATVRDREGTPIWQIRGDRQHPSSQGMVCVKGATVAESVSKSRLKYPMFRASLDDPFTEISWDEALDRLCDRIQQTQADYGKDGICFYGSGQFQTEDYYIAQKLVKGCLGTNNFDTNSRLCMSSAVSAYSLCLGSDGPPACYEDLDLADCLLIVGSNTAECHPILFNRYRKRHKQGGTNLIVVDPRCTPTAEVADLHLALKPGSDVALLNGLGWLLYQMGYVKKDFIANQTEGFEDWLAIIEDYPPQRTAELTGLAVAELVRAADLIASAQRWLSLWSMGVNQSIQGTAKATSLINLHLLTRQIGLPGCGPFSLTGRPNAMGGRETGGLAHLLPGYRKVIDPQHRADVETIWGLPMGSISPQPGRTAWQMIEGLEQGAVGFLWVAATNPAVSLPDVKRAQAALKRSPFTVLQDAYHPTETTTYAHLLLPAAQWSEKTGTMTNSERRVTLCQAFRQPPGEARADWQIFAEVGRRLGFAFDYTDAAAVFAEYVQVTAGRLCDLSGLSHELLAQAGPQQWPFPAGAEPTTESKRLYTKHHFAYADGRARFQPFHHLGVAEPPDDRYPLVLTVGRLYGHWHTQTRTGRIDKINKLHPSAFVEIHPRDADRYNISEGQAVVIRSRRGEGCFPAKVTTAISPGVLFVPMHWGALWGDRTEANALTHPAACPISGEPELKACAVQIEAASSTFTI

SEQ ID NO: 22248 - protein, 134 aa, Glycine max
MRQAGAYSGLLCGGVSGRTGPHSLPLARIKKIMKNSGEDVKMISGEAPIIFSKACELFIEELTRRSWIMAIQGKRRTLHKEDLASAVIATDIFDFLITLVSSSESHAVGGATNVMGRWKLLDYSLSHLTLHTAA

SEQ ID NO: 22249 - protein, 663 aa, Chlamydophila abortus
MGKISFYPGSPLPLGATQLSSDCYRFALFSSQATQVVLVLADQNLHTQEIVLSRKENRTGAIWHIEVEGISDLWSYTFRVDGPASPLGRFDFKKYLADPYAKNLRSPQTFGSIKTPGDYAFSYLKNEEFSWEGDRCLNLPKEESIIYEMHVRSFTWDNSSKSRYPGTFLGIIEKIDYLKKLGINAIELLPIFEFDETYHPFRKVDFPHLCNYWGYASVNFFSPCRRYAYGSDPCAPSREFKTLVKALHQAGIEVILDVVFNHTGLENTTCPLQWIDLPSYYIVDSQGEFANYSGCGNTVNTNHTPTTQLILDSLRYWVQEMHVDGFRFDLASIFSRDPSGKPLPFSPALQAISYDPILADTKIIAEPWDAAGLYQLGYFPTLHSRWSEWNGQYRDTVKAFLNGNDQLIGTFASRISGSQDLYPYGSPCNSINYICSHDGFTLYDTVAYNNKHNEENQEGNCDGSDANYSYNFGEEGETQNPHIIELRQRQMRNFLLTLFLSQGIPMLQSGDEYGHTAKGNNNRWALDTDANHFLWDRLSNNASLVDFVCHAIHFRKKHKEIFNRGFLTQDNITWLDATANPIQWHPGKFLAYELKQARYSLFTAFYTGKEQIKVQLPNLRENFMPYQKIADSSSGFVSQHLPEKITLDPYMMVVAMSYANHQD

SEQ ID NO: 22250 - protein, 255 aa, Sinorhizobium meliloti
MALPDFTMRQLLEAGVHFGHQTHRWNPKMKPYIFGDRNNVHIIDLAQTVPMLSRALQVVSDTVASGGRVLFVGTKRQASEIIADAAKRSAQYYVNARWLGGMMTNWKTISNSIQRLRKLDEILASEASGFTKKERLNLEREREKLNRALGGIRDMGGTPDLMFIIDTNKESIAIDEAKRLGIPVVAVIDSNCDPDQIDYAIPGNDDASRAIALYCDLIARAAIDGIARQQGASGRDLGASEEVPVEPALEEASEA

SEQ ID NO: 22251 - protein, 499 aa, Hordeum vulgare
MARCRRRSGCTAGAALLLLLALALSGGGGAAPQGAEVTGLPGFDGALPSKHYAGYVTVDEGHGRNLFYYVVESERDPGKDPVVLWLNGGPGCSSFDGFVYEHGPFNFESGGSVKSLPKLHLNPYAWSKVSTMIYLDSPAGVGLSYSKNVSDYETGDLKTATDSHTFLLKWFQLYPEFLSNPFYIAGESYAGVYVPTLSHEVVKGIQGGAKPTINFKGYMVGNGVCDTIFDGNALVPFAHGMGLISDEIYQQASTSCHGNYWNATDGKCDTAISKIESLISGLNIYDILEPCYHSRSIKEVNLQNSKLPQSFKDLGTTNKPFPVRTRMLGRAWPLRAPVKAGRVPSWQEVASGVPCMSDEVATAWLDNAAVRSAIHAQSVSAIGPWLLCTDKLYFVHDAGSMIAYHKNLTSQGYRAIIFSGDHDMCVPFTGSEAWTKSLGYGVVDSWRPWITNGQVSGYTEGYEHGLTFATIKGAGHTVPEYKPQEAFAFYSRWLAGSKL

SEQ ID NO: 22252 - protein, 142 aa, Arabidopsis thaliana
SLFDFEMARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNLCAIHAKRVTIMPKDIQLARRIRGERA

SEQ ID NO: 22253 - protein, 550 aa, Pantoea agglomerans
MSTFTVGDYLLTRLQEIGIKHLFGVPGDYNLQFLDRVIAHPEISWVGCANELNAAYAADGYARCNGAGALLTTFGVGELSAINGTAGSYAEYLPVIHIVGAPATQAQLQGDCVHHSLGDGDFQHFIRMAAEVSVATALLTADNATAEIDRVIISALQARRPGYLSLAVDVAAMAVQPPAQPLNTHQPASADARRAFRAAAERLLAPAQRVSLLADFLALRWQQQSALAALREQSAIPCASLLMGKGVLDEQQPGYVGTYAGAASAGQVCEQIEQVDAAICVGVRFTDTITAGFTQQFATERLIDLQPFSASVGNERFAPLSMADALSELQPLFEHYGQQWQPAAAIPAAQPAEPTAVISQHAFWQAMQGFLQPGDLILAEQGTAAFGAAALRLPSRAQLVVQPLWGSIGYTLPAAFGAQTANPDRRVILIIGDGSAQLTIQELGSMLRDGQRLIIFLLNNDGYTVERAIHGATQRYNDIAPWNWTALPHALSLQGQAQSWRISETVQLDEVMTRLAAPQWLSLVEVVMLKDDLPPLLRKVTACLNQRNGG

SEQ ID NO: 22254 - protein, 564 aa, Candida glabrata
MSEITLGRYLFERLNQVDVKTIFGLPGDFNLSLLDKIYEVEGMRWAGNANELNAAYAADGYARIKGMSCIITTFGVGELSALNGIAGSYAEHVGVLHVVGVPSISSQAKQLLLHHTLGNGDFTVFHRMSANISETTAMVTDIATAPAEIDRCIRTTYITQRPVYLGLPANLVDLKVPAKLLETPIDLSLKPNDPEAETEVVDTVLELIKAAKNPVILADACASRHDVKAETKKLIDATQFPSFVTPMGKGSIDEQHPRFGGVYVGTLSRPEVKEAVESADLILSVGALLSDFNTGSFSYSYKTKNIVEFHSDYIKIRNATFPGVQMKFALQKLLNAVPEAIKGYKPVPVPARVPENKSCDPATPLKQEWMWNQVSKFLQEGDVVITETGTSAFGINQTPFPNNAYGISQVLWGSIGFTTGACLGAAFAAEEIDPKKRVILFIGDGSLQLTVQEISTMIRWGLKPYLFVLNNDGYTIERLIHGEKAGYNDIQNWDHLALLPTFGAKDYENHRVATTGEWDKLTQDKEFNKNSKIRMIEVMLPVMDAPTSLIEQAKLTASINAKQE

SEQ ID NO: 22255 - protein, 542 aa, Aspergillus oryzae
MRTWRRSFATSVARLNHKPAGQGVSPTLLRCAQVLEQSKSGTCSLEDQEIKLNGFIRSVRKQKRFAFAEISDGSTIEPIQAFLRPAQAAELSTGTAVEISGVWKACPPGKEQTHELQTTDVNVLGKADPETYPIQKKYHSPDFLRQIPHLRMRTPFSSLLSRFRSECLYQLGNVFRFAPNGGYVQVHPPLITSSDCEGAGETFTVLPREAMGAQSEGEHFFRAPKYLTVSSQLHLEAYAAELGNVWTISPMFRAEKSDTPRHLSEFYMLEAEMNYMHDLDSLTDSVEYILRDLVRRLHDTPVGQEILSAKRSGESGQDQTEGSGANLKQRWNDMMEGPKWGRMTYTQAIEKLQDAVAKGQATFEHAPEWTGGLQLEHEKYIVDVIHNGRPVFVTDYPKVVKPFYMLPSNGDSSAAPGETVACFDLLLPEVSEVAGGSLREHRLPNIIQNMREHGLIKTRAPPALEAEAEAGAQADSETPMYPHLLPGEDLGHLQWYADLRRWGTAPHGGFGLGFDRFLGYLAGVSSIRDVVSFPRYFGRADC

SEQ ID NO: 22256 - protein, 1137 aa, Prosthecochloris aestuarii
MANGILFRSIPHRLRHIFLTFFFIHNYFYRDFMPKTRTTGQPEPQWYKDAIIYEAHVKTFFDSNNDGVGDFEGLRQKLPYLESLGITAIWLLPFYPSPLRDDGYDIADYMDINPDYGTIDDFRAFLNEAHERGLKVITELVINHTSDQHAWFQRARRAEQGSDERNFYVWTDDPKKYSETRIIFQDFESSNWTWDPIAGQYFWHRFYHHQPDLNFENPSVEKALYKVLDYWLEMGVDGLRLDAVPYLYEEEGSNCENLPRTHEFLKRLRKHVDDKFPNRMLLAEANQWPEDAAEYFGDGDECHMNFHFPLMPRMYMALEMEDRFPIIDILDQTPEIAETCQWASFLRNHDELTLEMVTDEERDYMRRVYAHDPKARINLGIRRRLAPLMSNDRRKIELMNIMLLSLPGTPVLYYGDEIGMGDNFYLGDRDGVRTPMQWNGDRNAGFSRANPQQLQLPVIIDPEYHYEATNVEVQDSNINSLLWWTRHMLSTSRRYKALSRGDIRFIACQNPQILIFSRTFEDETMLCIINLSRNAQAATVDLSEYEGHTPEEVFSLSHFPGITSRPYTVTLGPYGYFWFKLIRTEEEIGSRRYVDKPFAQVASLKDLFAGKALERLETKVLPEYIRGCRWFGGKARKIVRVSVEEHIPVTACDNTVYMIVEVRYPSGSNDTYQLPVTFLPAGEFNPDDDYFLKQVVCSVKIGDEEGYLCDSAYQKSFHSFLLDTIVSSKGLKGSTGKLTGEKGSRVEEFLETQDDGEMNSVLFGAEQSNTSIMYGDRLCLKIYRKISSGVSPEVEICRMLTEKTSFESSPAYLGALHFTRSRKDQCSLGILQNFIPNEGDAWSQTLHFVHRYYEDVLVMLPQISEVPVLPSTGGESVEMPEIIHGLIGEPYLEMVSRLAERTAGMHLALASPDLGQDFIPEPFTTLYQRSIYQSMREQVKRGMVLLREQMGGVAEEYQGLAAGLLKREGEILEQLSHIKARKIAASKIRIHGDYHLGQVLWTGKDFVIIDFEGEPARSLSERRIKRSAFRDLAGMMRSFHYAAFNVLIQDRSIRQEDVERLEPWAELWSFYTGQHFFDVYEDAVRGQGLIPEDVKEQHLLLRAYLMDKAIYELNYELNNRPEWVGIALKGLSRLLEL

SEQ ID NO: 22257 - protein, 516 aa, Sulfurospirillum deleyianum
MMMKFKLLLAGSLVAVGAMALLASNINEKEKQRVELAKAPSEAGIAGKEKSEEWAKYYPRQFDSWKKTKEYDSFTDMLAKDPALVIAWSGYAFSKDYNSPRGHYYALQDNVNSLRTGAPVDAKTGPLPTACWTCKSPDVPRLIEEDGELEYFTGKWAKYGSQIVNVIGCANCHDDKTAELKVRVPHLNRGLQAAGLKTFEESTHQDKRTLVCAQCHVEYYFKKTEWKDAKGADKTAMVVTLPWANGVGKDGNAGVEGMIKYYDEINFSDWTHNISKTPMLKAQHPGFEFWKSGIHGQKGVSCADCHMPYTQEGSVKYSDHQVKENPLDSMDQSCMNCHRESESKLRGIVHQKYERKEFLNKVAFDNIGKAHLETGKAIEAGASDEELKEVRKLIRHGQFKADMAIAAHGNYFHAPEETLRLLAAGSDDAQKARLLLVKILAKHGVMDYIAPDFDTKDKAQKLAKVDIAALAAEKMKFKQTLEQEWKKEAKAKGRANPELYKDVDTINDGKSSWNKK

SEQ ID NO: 22258 - protein, 138 aa, Triticum aestivum
VHAFSVCDDPEYFYDYVQGLIDGLQSGLDSHDIVSIQNAKGLGYAMNTAEELKFVKDIATATGIVLDPVYSGKGAYAMLKDMADNPSKWKGRKVLFVHTGGLLGLYDKVDQMSSLAGSWRRMDLEESVPRKDGTGKMF

SEQ ID NO: 22259 - protein, 341 aa, Mycobacterium avium
MAAQMREPKVVVLGGGSWGTTVASICARRGPTLQWVRSRETADDINENHRNSRYLGNDVVLSDTLRATTDFCEAANTADVVVMGVPSHGFRGVLTELARELRPWVPVVSLVKGLEQGTNMRMSQIVEEVLPGHPAGILAGPNIAREVAEGYAAAAVLAMPDQHLATRLSGLFRTRRFRVYTTDDVVGAEMAGALKNVFAIAVGMGYSLGIGENTRALVIARALREMTKLGVAMGGSPDTFPGLAGLGDLIVTCTSQRSRNRHVGEQLGAGKPIDEIIASMNQVAEGVKAASVIMEFANEFGLTMPIAREVDAVINHGSTVEQAYRGLIAEVPGHEVHGSGF

SEQ ID NO: 22260 - protein, 82 aa, Vigna radiata
GGYYDAGDNVKFNFPMAFSTTMLAWSVIEFGKFMGPDLKHALDAIRWVTEYFLKATSIPGIVFAQVGDPYADHNCGERPEDM

SEQ ID NO: 22261 - protein, 654 aa, Bacillus licheniformis
MKQKAFLKMKALCLALLVIFSMSIASFSEKTRAASAEEYPHNYAELLQKSLLFYEAQRSGRLPENSRLNWRGDSGLEDGKDVGLDLTGGWYDAGDHVKFGLPMAYSAAILSWSVYEYRDAYKESGQLDAALDNIKWATDYFLKAHTAPYELWGQVGNGALDHAWWGPAEVMPMKRPAYKIDAGCPGSDLAGGTAAALASASIIFKPTDSSYSEKLLAHAKQLYDFADRYRGKYSDCITDAQQYYNSWSGYKDELTWGAVWLYLATEEQQYLDKALASVSDWGDPANWPYRWTLSWDDVTYGAQLLLARLTNDSRFVKSVERNLDYWSTGYSHNGSIERITYTPGGLAWLEQWGSLRYASNAAFLAFVYSDWVDTEKAKRYRDFAVRQTEYMLGDNPQQRSFVVGYGKNPPKHPHHRTAHGSWANQMNVPENHRHTLYGALVGGPGRDDSYRDDITDYASNEVAIDYNAAFTGNVAKMFQLFGKGHVPLPDFPEKETPEDEYFAEASINSSGNSYTEIRAQLNNRSGWPAKKTDQLSFRYYVDLTEAVEAGYSAEDIKVTAGYNEGASVSELKPHDASKHIYYTEVSFSGVLIYPGGQSAHKKEVQFRLSAPDGTSFWNPENDHSYQGLSHALLKTRYIPVYDDGRLVFGHEPGY

SEQ ID NO: 22262 - protein, 338 aa, Lactobacillus plantarum
MMKKIAVLGAGSWGSILANLLDENGHSVRLWSYSPAQVTELNEKHTNERYVPDFKYSETLTAYSNLTQAIDGADVILFVVPTKAIREVAQQVTAVLAKTHQRPIIVHASKGLEQETHKRLSQVLAEEIPTELRQAIVVLSGPSHAEEVARHDITLITAASADESAAELVQQLFMNDYFRIYTNTDVVGVELGAALKNIIALGAGALHGLGYGDDAKAALMTRGLAEISRLGVALGAEPLTFIGLSGVGDLIVTATSVHSRNWRAGNELGAGQDLKTVIDTMGMVIEGIPSTKAAYELAQQQNIEMPITEAIYDVLYKSADIKEVIPQLMRREGKPEIQ

SEQ ID NO: 22263 - protein, 251 aa, Codonopsis lanceolata
MGKCYPTVTEEYEKAVEKCKKKLRGLIAEKKCAPLILRLAWHAAGTYDYKTKTGGPFGTIRSPEELSHAANNGLDIAVRLLEPIKQQFPILSYADFDQLAGIVAVEVTGGPEIPFHPGREDKTKPPPEGRLPNATKGTDHLRQVFGHQMGLSDQDIVTLSGGHTLGRCHKERSGFEGPWTFNPLIFDNSYFKELLAGEKEGLLQLPTDKVLLEDPVFRPLVEKYAADEEAFFRDYAESHLKLSELGFAEAE

SEQ ID NO: 22264 - protein, 125 aa, Vigna radiata
GGYYDAGDNVKFGFPMAFTTTMLSWSVIEFGGVMKGELQNAREAIRWGTDYLLKATAHPDTIYVQVSLLFSSLHHFSFICQLLSCCAKMLMTTEKARKVRLLGVVFLQVGDAEKDHACWERPEDM

SEQ ID NO: 22265 - protein, 395 aa, Bacillus licheniformis
MMTKKGLLTVLMPFLLALSAIQFGNPRPALAASPFVETAGTSFTLNGKEFYFAGTNNYYFHYKSKKMVDDVFEDMKAMNLKVIRIWGFLDGQPQENTVMQPRPGIYDESGFSKLDYAIYKAGQTGIKLVIPFVNNWDDFGGMNQYVRWFQADGHDAFYTHPDIKEAYKNYVSYMLNRVNTYNGVKYKDDPAIMAWELANEPRVQSDRTGNTLVEWADEMSEFIKSIDQNHLVAVGDEGFYHIEGHPDWHYNGGEGVDWKRLTALKHIDYGTYHLYPDHWGKTAEWGNQWITDHICDGKEIGKPVVLEEYGYQDKSRRDYVYRTWLELIEKQSGAGSQFWILTGIQDDGTLYPDYDGFRIVYPSSAASVISEHAERMNEKSAASEMLQTKRCHDLQ

SEQ ID NO: 22266 - protein, 359 aa, Glycine max
MGDIDPAFIQSTEHRPIAKVVEVREIPVIDLSEGRKELLISEIGKACEEWGFFQVINHGVPFEISREVEIVSKKFFETSLEEKKKVKRDEFNAMGYHDGEHTKNVRDWKEVFDYLVENTAQVPSSHEPNDLDLRTLTNQWPQNSPHFRETLQEYAREVEKLAYKLLELISQSLGLAADKFHGCFKNQLSMVRLNYYPACPFPDLALGVGRHKDSSALTVLAQDDVGGLQVKRKSDGEWIPVKPTPNAFIINVGDIVQVWSNDKYESVEHRVVVNTEKERFSIPFFFFPAHHVMVKPAEELVNEQNPARYREYKYGKFFANRNRSDFKKRDVENIQIHHFRILDEAFGLASSISSISEHN

SEQ ID NO: 22267 - protein, 72 aa, Vigna radiata
GGYYDAGDNVKFGWPMAFATSLLSWAAVEYESEISSVNQLGYLQSAIRWGADFILRAHASPTTLYTQACFYI

SEQ ID NO: 22268 - protein, 312 aa, Lactobacillus plantarum
MAKSYDVIIIGAGPAGMTAALYASRANLSVLLLDRGIYGGQMNNTAAIENYPGFKSVLGPDLAKDMYESATQFGAEYAYGSVESVEDRGDVKIVTTDSDTFETKALVIGTGSEYRKLGVTGEDTYGGRGVSYCAVCDGAFFRNKHVVVVGGGDSAIEEGTYLTQLADKVTVIHRRDQLRAQQILQDRAFANPKMEFVWNSNVTEIIGDDKKVTGVKVNNNKTGEDSEIAVDGVFIYVGINPITKPFSNLGITDENGWIETNDHMETKVPGIFAVGDVRKKDLRQVATAVGEGGTAGQGVYTYITALGDKVNN

SEQ ID NO: 22269 - protein, 212 aa, Coxiella burnetii
MTHSKRWLEEHEKDPYVKRAKKEGYPSRAAYKLLEIHQKYKLFKPSMNVIDLGAAPGGWSQVAKDLVGPKGVVIAIDLLPMQSMLDVIFIQGDFNEPEIFNQLEAIVAKKTLTGQVDLVISDMAPNISGIKNVDQSRSLHLVELAWDCAQKLLARGGTFLVKVFQGPGVDRFLINLRPYFNQVKFLKPSASRSRSSEIYILAGEFLGYNQRV

SEQ ID NO: 22270 - protein, 516 aa, Glycine max
MAEDDGYTKDGTVDYCGNPANKKETGTWKACPYILGNECCERLAYYGMSTNLVLYFKNRLNQHSATASKNVSNWSGTCYITPLIGAYLADSYLGRYWTIAVFSIIYAIGMTLLTLSASVPGIKPTCHGHGDENCRATTLESAVCFLALYLIALGTGGIKPCVSSYGADQFDDTDSAEKERKSSFFNWFYFSINIGALIASSLLVWIQDNVGWGWGFGIPAVAMAIAVVSFFSGTRLYRNQKPGGSAITRICQVVVASIRKYNVEVPADESLLYETAETESAIKGSRKLDHTDELRFFDKATVLARSDKVKESTNPWRLCTVTQVEELKSILRLLPVWATGIIFSTVYGQMSTLFVLQGQTMDTRVGNSTFKIPPASLSIFDTLSVIFWVPVYDRIIVPIARKFTGYKNGLTQLQRMGIGLFISIFSMIDNAGLEWGFGIPAVAMAIAVVSFFSGTRLYRNQKPGGSAITRICQVVMASIRKYNVEVPADESLLYETAETESAIKGSRKLDHTNELR

SEQ ID NO: 22271 - protein, 494 aa, Populus alba
MAVATVFSLKLQILFIIFCCRSYFSTAFTSQDYADALEKSILFFEGQRSGKLPVNQRLTWRGDSGLSDGSAYHVNLVGGYYDAGDNVKFGLPMAFTTTLLAWSVIEFGSSMQNQITNAEAAIRWSTDYLLKAATATPDTLYVQVGDPNMDHRCWERPEDMDTPRNVYKVTTQNPGSDVAAETAAALAAASIVFKESDPSYSTELLHAATKVFDFADRHRGSYSDSLSSAVCPFYCSYSGYQDELLWGASWLHKASLNGTYLAYIQSNGHTMGSDDDDYSFSWDDKRPGTKILLSKEFLDKTTEEFQIYKSHSDNYICSLMPGSSSFQAQYTPGGLFYKATESNLQYVTSTTFLLLTYAKYLGSNGGVAKCGGSTVTAESLIAQAKKQVDYILGDNPAKMSYMVGFGNKYPQHVHHRGSSVPSIHAHPNRISCNDGFQYLYSSSPNPNVLVGAIVGGPDNRDHFADDRNNYQQSEPATYINAPFVGALAFFSAKN

SEQ ID NO: 22272 - protein, 396 aa, Codonopsis lanceolata
MPGLRAPSNYSEEPPRHPCLKINAKEPFNAEPPRSALITSYVTPVDFFYKRNHGPIPVVDDIERYCFSINGLIEKPKELFMKDIRNLPKYNVTAVLQCAGNRRTAMSKTRTVKGVGWDVSAIGNAVWGGAKLADVLELVGIPKLTSVTPWGGKHVEFVSIDRCKEENGGPYKASIPLSQATNPEADVLLAYEMNGETLNRDHGYPLRVVVPGVIGARSVKWLESINIDAKVCQGFFMQKDYKMFPPSVNWENIDWSSRRPQMDFPVQCVICSLEDVNVVKHGKVAIKGYAVSGGGRGIERVDVSIDGGKTWLEASRYQKPGIPYNADDESSDKWAWVFFEAEADIPPSAEIVAKAVDSAANVQPENVEVIWNLRGILNTSWHRVQVRVGHSNMDSG

SEQ ID NO: 22273 - protein, 360 aa, Salinibacter ruber
MVWWWRALGPSGEGQPGPLPSSLFPVIDPSRPTMQDIECLGVYTSGGDAPGMNACLRAVVRTAIANDIAVMGIRRGYEGMIEADFVEMERRSVSNILQSGGTILKSARSEAFRTEEGRRAAANSLRENGIDALVAIGGDGTFRGASKLYDEHGLGVVGCPGTIDNDLYGTDQTIGYDTALNTAIDNIDRIRDTADAHNRLFLVEVMGRDAGFIALNSGIGGGAELILIPETITEMDMVKERILSLMTAQRRSTIVVVAEGDELGGAQGIERALRDDAAFSDIELRSTILGHTQRGGAPTASDRVLASRLGVAAVESLMDGHSDVMVGMTNNEIKLTPLRNVYGRRKSIDYDLLKLTQILS

SEQ ID NO: 22274 - protein, 458 aa, Staphylococcus epidermidis
MGEIGMNDTDRTHKENKLEQDITLPYLKKAVIFSITFGFFGVNMAFALQSAMMGRIFQTLGANPNNLGWFFILPPLVGMIVQPLIGYYSDRTWTRFGRRMPYLLIAGPIGAIVLVLLPNAGSFGFGYASLMALSFGAVMTLLMDLTSNACMQPYKMIIGDMVNEKQRDMAWSWQQIFSNLGGIIATVLPFLLTMLGISNVAPKGEVPMTVKLAYYIAAAVLLIASIWTVISVREYEPKTYNYYHGINENNRNNKLNLLQLLKKAPKQFWQISVVQFFNWFALMYLWTYSTGAIAKNVWNVTDPSSAGYQAAGNWYGVLYCIQFLSSVIFGFVIARSKPSQRKFWYSFGLVFGGIGLISIFFIHNQWLLIFSFVLIGINNLTMNTQPFTLLTEAIDGENSGAYLGLFNTSICLPQIVASIVSFGLYPLLGSSMPAMLLLAGIMMLLGAVSVKFINAKFE

SEQ ID NO: 22275 - protein, 570 aa, Unknown
  Synechococcus sp. RS9917
MNESLPLADDPTMAAPSVAQYTLSRLAQLGIDQIFGVPGDYAFSIDDAAEEVPGLSWVACANELNAAYAADGYARIRGAALLTTTYGVGELSAINGVMGSKAHRLPVFHLVGMPSERIQKQGLITHHNLGDAVYDRFQVLSAEAACVSAVLTPDNCIDELERVIREALRQSRPAYLVISEVNGGQPVLGTPVQGQPLVAIKRQHSVPQELEAAVGTILARLAAAQKPVAVLTHLVSRYGVRDQALELIRKTNLPTALTPNDKGTIDESMPQYAGLYAGDWSSSDAVRDLVGNADLVLDIGGIITTELNTGLWTGNYDPAKVVSIQDNFVRAGSKVFVNVAIDDVLNALCERVSTRCNDHGLKLEPMPLVGAAGDATCSATFYPRLQRRLRAGDTLVIETGTCMTHLNKVLLPEGVSAEGQGLWGSIGWGTPACLGVAMAKTSGHTWMVTGDGSHQLTLNELAVMGRYGVKPRIFVLNNGLFGIEDVISERGHGYDDLAPVNYHLLPEAFGCRNWLSARVSTVAELDAVLDQIDAHDGAAYIEVMIPNEESQPLPQSTIDSGYKLSTPPIG

SEQ ID NO: 22276 - protein, 344 aa, Oryza sativa
MEAEAAAKRVRESGDAAAAGAGEQAGISAVIPGWFSEISPMWPGEAHSLKVEKVLFQGKSDYQNVMVFQSSTYGKVLVLDGVIQVTERDECAYQEMITHLPLCSIKDPKKVLVIGGGDGGVLREVSRHSSVEQIDICEIDKMVVDVFSPYPLSVCLVTLISAFGVAAATGDLPRYPRKESEEISEPEGQAKGEGHAYLHCNHCVMAVCVVVIVPVSNAWQLEPDLGRSRRRWSPNNFFLIWLLDLKTPVCHYTLEMDRLKSFSRSLSSSQLPELCVLVVFGVIGFMLCSTEGPTVDFQHPIFNIEDNEFSTKSKGPLKFYNSEIHSASFCLPSFAKRVIGSKAN

SEQ ID NO: 22277 - protein, 524 aa, Unknown
  Synechococcus sp. RS9917
MSASVTNVPPHQPDVLNGLPPVAVIGAGPGGLVAARWLLAKGFDCLLLESCAELGGQWNGANRRSATWPGLVTNTSRVMTAFSDLDHPEGTATYPSREQAQVYLQRYAERFDLLRRIRYGCEVTELDRDPSGQGWQLRWREKGVLLQARFQQVVVATGAQSCPSTPNLPGLESFSGRLGVHHTAHFRGAEGFRGASVLSVGCSISSLEIATALAQQGVEVHATYRRQRYVLPKLLAGVPNDHVMFTRSAALAAECLPIEAVAEALKAEVLRHAGSPEQWGARQPHANILQAGISGCQGFLPLVAEGRIQVHPWIEAIEGDSVVFQDGSRERFDALLLGTGFRFHLPFLSRDLCELINLQEKSMGLYAQTLHPQLPGLAFIGFYGLIGPYWPVLELQARWLAGCWGDATQLPDRETMQAAINAQAARPLPAEGVPMQGMALQFARLAGVEPTLSRWPELERALLFGPLSPASFRLEGPDALAEAPQRTLAAAACFGHQADTVLRPEEAGLRDALSQPAREAVPLP

SEQ ID NO: 22278 - protein, 306 aa, Thermoanaerobacter tengcongensis
MVANNILDLIGKTPVVKLNKVPDKNSAEVYLKLEFFNPAGSVKDRIALAMIEKAEKEGILKKGSVIVEPTSGNTGIGLAMVGAAKGYKVIIVMPDTMSMERRMLLAAYGAEVILTPGKLGMEGAIRKAEELVKQNKNYFMPQQFENLANPLIHEETTAKEIIEDFKEGLDAFVAGIGTGGTITGVGRVLKKVFPDIKIVGVEPYSAAVLSGREPGPHKIQGIGAGFIPKVLDREVLNEVIPVKDEDAFEMTRILAKKEGILAGISTGASLWAALNVAKKLGKGKKVLAIAPDSGERYLSTQIFREH

SEQ ID NO: 22279 - protein, 107 aa, Streptomyces clavuligerus
MAGVLKNVTDDTFEADVLKSEKPVLVDFWAEWCGPCRQIAPSLEAITEHGGQIEIVKLNIDQNPATAAKYGVMSIPTLNVYQGGEVVKTIVGAKPKAALLRPGPVPR

SEQ ID NO: 22280 - protein, 506 aa, Ruta graveolens
MDLLLLEKALLGLFAAAVVAIAVSKLRGKRFKLPPGPFGFPVFGNWLQVGDDLNQRKLANLSKKFGDVYLLRMGQRNLVVVSSPEMAKEVLHTQGVEFGSRTRNVVFDIFTGKGQDMVFTVYSEHWRKMRRIMTVPFFTNKVVQQQRFNWEDEAARVVEDVKKDPQAATTGIVLRRRLQLLMYNNMYRIMFDRRFESVDDPLFNKLKALNGERSRLAQSFEYNYGDFIPILRPFLRGYLKLVKEVKERRLKLFKDYFVEERKKLTSTKSMTEENFKCAIDHVLDAQQKGEINEDNVLYIVENINVAAIETTLWSIEWGIAELVNHPDIQKKLRAEIDRVLGPDHQITEPDTHKLPYLQAVIKETLRLRMAIPLLVPHMNLNDAKLAGYDIPAESKILVNAWWLANNPAHWKDPQVFRPERFLEEESGVEANGNDFRYIPFGVGRRSCPGIILALPILGITIGRMVQNFELLPPPGQSKIDTSEKGGQFSLFILNHSTIVLKPRSSV

SEQ ID NO: 22281 - protein, 276 aa, Synechococcus elongatus
MWFVPPFRESRVVSFSAGVYFVGVGPGDPELMTVRAQKLIAAADVLLYTDSLVPPAILADARPDAERLPTAHRTLEEILPILKERVAAGAIVARLHDGDPSLYSTIAEQIAGLRSQDIPYQVIPGVSAFQAAAARLGQELTLPGLVQTIILTRCAGRIGLPDRESLSSLAAHQASLCLYLSARQAEKAQTELLEHYSPETPIAVCYRLGWPDEAIWLGKLSELAQITQDQQLDRTVLYLISPALQAVETGRSQLYNPDYHHLFRPETTAARSPQPS

SEQ ID NO: 22282 - protein, 435 aa, Zea mays
  misc_feature (57)..(57): Xaa can be any naturally occurring amino acid
KLRYVEVEEDAGVELFYYFVQAESGAAAAADDTPFLFWLTGGDRCSVFSGLAYEIGXQVFVLEPYNGTLPRLRYNHNSWSKVSHILFVDSPVGAGFSFSRDPKGYDVGDISASLQLQEFLIKWFSDHPEYLANPFYIGGDSYVGKIVPFLGQMISEGIELGRRPFPNLKGYLVGNPITGESIDFTSRVPYAHGVGIISDQLYETILGHCQGEDYTSPANALCAQALDTFNNLINEVQNAQILLDTCVYASPAPNVLSRPVDGGRRILRAAGMGGGATLNHPPARPRFGCITYGYYLSYFWANDERTRTALGIKKGTVDEWVRCHDADLPYTIDLKSAIKYHRNLTSRGYRALVYSGDHDLLVPHLGTQAWVRSLNFPVVDDWRAWHLGGQAAGFTINYSNNMTFATIKGGGHTAPEYEPERCFAMFSRWILDRPL

SEQ ID NO: 22283 - protein, 957 aa, Salmonella typhimurium
MTQTLSQLENRGAFIERHIGPDAAQQQEMLNAVGAESLNALTGQIVPKDIQLATPPQVGEAATEYAALAELKAIAGRNKRFTSYIGMGYTAVQLPPVILRNMLENPGWYTAYTPYQPEVSQGRLEALLNFQQVTLDLTGLDMASASLLDEATAAAEAMAMAKRVSKLKNANRFFVASDVHPQTLDVVRTRAETFGFDVIVDDAAKALDHQDVFGVLLQQVGTTGEIHDYSALITELKSRKVVVSVAADFMALVLLTAPGKQGADIVFGSAQRFGVPMGYGGPHAAFFAAKDEFKRSMPGRIIGVSKDAAGNTALRMAMQTREQHIRREKANSNICTSQVLLANIASLYAVYHGPVGLKRIANRIHRLTDILAAGLQQKGLKLRHAHYFDTLCVEVADKAAVLARAEAAEINLRSDIHNAVGITLDETTTRENVAQLFNVLLGDSHGLNIETLDKDVALDSRSIQQSMLRDDAILTHPVFNRYHSETEMMRYMHSLERKDLALNQAMIPLGSCTMKLNAAAEMIPITWPEFAELHPFCPPEQAEGYHQMISQLSDWLVKLTGYDAVCMQPNSGAQGEYAGLLAIRHYHESRNEGHRDICLIPASAHGTNPASAHMAGMQVVVVACDKNGNIDLDDLRAKAEQHAANLSCIMVTYPSTHGVYEETIREVCEVVHQFGGQVYLDGANMNAQVGITSPGFIGADVSHLNLHKTFCIPHGGGGPGMGPIGVKAHLAPFVPGHSVVQIEGMLTRQGAVSAAPFGSASILPISWMYIRMMGAEGLKQASQVAILNANYIASRLKDAYPVLYTGRDGRVAHECILDIRPLKEETGISELDIAKRLIDYGFHAPTMSFPVAGTLMVEPTESEGKAELDRFIDAMLAIRAEIDQVKAGVWPLEDNPLVNAPHIQSELVAEWAHPYSREVAVFPAGVADKYWPTVKRLDDVYGDRNLFCSCVPISDYQ

SEQ ID NO: 22284 - protein, 494 aa, Zea mays
MALAHASAMFPPSSPSHKTWEDPSFFKWRKREAHVPLRSQDTLEAALKYWHERRNVNYHNADTAVWNDDAVRGALESAAFWSKGLPYAKSLSGYWKFLLSPSAESIPERFYYAHFDDSNWSGLPVPSNWQMHGFDRPIYTNVTYPFPLNPPFVPADNPTGCYRTVFHIPKEWKGRRILLHFEAVDSAFFAWVNGVLVGYSQDSRLPAEFEITDCCHPCDSDKENVLAVQVMRWSDGSYLEDQDHWRLSGIHRDVLLLSKPQIFITDYFFKATLDENFSLADIEVEVEIDSHKQDQEHVPTLSIEATLIDNSGLSNSIDADLSSANAVNLKPKPKRTRSPCLGFHGYVLGGKIENPKLWSSEHPNLYTLVVLLKDANGKLIDCESCQVGIRNVVMAHKQMLVNGCPVVLRGVNRHEHHPRLGKTNLEACMIKDLILMRQNNINAVRNSHYPQHPRWYELCDIFGLYVIDEANIETHGFDESNTFKHPKKKKKKKK

SEQ ID NO: 22285 - protein, 250 aa, Prochlorococcus marinus
MNPISIVGAGPGALDLMTIRAQQRLKSADVLVWTDSLIPIQITKLVKDDCEKIKTSSLTLEEILLILIKKHKEGKKIVRLHDGDPCLYGAISEQICRLNDEGIEVEVVPGVSAYQATAATLGFELTVPDLTQTIILSRADGRTGKPKRESLQKLASIQSSLCLYLSARHVEEVQSILIKYYPANTPVAIAYRVTWPDEWIKVIPLTEMAKTSQEQNLIRTTLYIISPTLKIGNNRSKLYNPTHSHLFRSS

SEQ ID NO: 22286 - protein, 475 aa, Trichodesmium erythraeum
MENIKYLRTWLRISRQPQYRWLWFVAAALIYLGILLFPMAGVEKEAKGALAVFGVTAFLWATNTLPVAVTGLMVLFLIPLSGSMSATDTYAYFGNKAVFFVLGAFILASPIQRSGLSTRLALTVVSRFGNSQNTLIASILILSALMSFVISSYAVTAMLFPVVIEVVQAAGAKSGGRFGLAAFLALGWGCGIGGIATLLGGARAPLALGVLRSTTKGEYDITFVEWFLWSVPLVVLMLIVAYLVLLQIGKGIVVSLSSARKFLEVRSQSLGTISSREIGTLALVTGIVLLWVFKGKAWGLDTIAFFGVMCSFVCGLATWQEVEEDVNWGIFLMYGSAIALSAVLRDTGAAQALAENLLGSWINSGFVCFVAMVLIITFLTEGMSNAAAVAVLMPVGLALAAKYGIDPRAMTLGITLPSGLAFLLPVSTPVMAIIMGSGYVSPAEAFKRGLLLKLVGTLIFLAMAKFYWPLFGWGV

SEQ ID NO: 22287 - protein, 496 aa, Mycobacterium avium
MSSPAVPDHHTLIIGAGFSGIGAAIKLDKAGLPDYRVIEAGDGVGGTWHWNTYPGIAVDIPSFSYQFSFEQSRHWSRTYAPGRELKAYAEHCADKYGIRSRIRFNTKVLAAEFDDEPRLWRVHTDPGGTVTARFLISACGVLTVPNLPDIDGVDSFGGITMHTARWDHGQDLSGKRVAVIGTGASAVQVIPEIAPIVKSLTVFQRTPIWRFPKLDVPLPAPARWAMRIPGGKSVQRLLSQAYVEVTFPISAHYFTVLPLAKRMATLGKSYLRQQVRDPEVREKLTPKYAVGCKRPGFHNGYLATFNRDNVRLVTEPIDKITPDAVATTDGEHHRIDVLILATGFKVMDPDNVPTFAVTGPGGRSLSRFWDEHRLQAYEGVSVPGFPNLFTVFGPYGYVGSSYFALIEAQTHHIVRCLKRAERLGAARVEVSEEANARYFAEMMRRRHRQIFWQDSCKLANSYYFDKNGDVPLRPGTTPEVYWRSRRFNLDDYRFSA

SEQ ID NO: 22288 - protein, 281 aa, Medicago truncatula
MGSIREDDIALQLPELKKLVKVLKEKRESEGKCSEGECVKGDVFLVGTGPGDPELLTVKAVRVIKSADLLLYDRLVSNDVLDLVGDHAKLLYVGKTAGYHSRTQEEIHELLLSFAEAGATVVRLKGGDPLVFGRGGEEMDFLQQQGIHVKVIPGITAASGIAAELGIPLTHRGIANSVRFLTGHSRKGGTDPLFVSENAADPDSTLVVYMGLSTFPSLSQKLMHHGLSPQTPAVFAELKDLPEKIASTGLESPTLLIIGKVVELSPFWPMPTKQESSLMQT

SEQ ID NO: 22289 - protein, 457 aa, Bacillus clausii
MSIQGKVYLVGAGPGDAELLTVKARKVLQQADVVIFDRLANPALIMEVSDHAKLVYAGKQPCKHVLRQGDIQTEMLVHAKKGKTVVRLKGGDPAVFGRVGEEAAYLKTHHIPFEIVPGVTAGTAASIYAGVPATHRTLSSSFAVVTAYRDRDEKKEPPNWRALAQSVDTLMIYMGMKQLAAIVDQLMTHGKPAGTPVLIVEWGTYSRQRSVEGTLETIVTNVANANLANPAVILIGDVVGVRGAVSWFEHKPLSGMGILSLRGETEMTGTLRAQGADVFAAPLQQNKGKIVTDTDIAAVLQTSKNQAVLFFAKEVLFAFLAKLGEKGYDIRSVQGQLMAGTQEVEQIARSLGLQLARYSKKSTLSPVVIGTDAINRRLLPQKITVAIRRLLEEGHLTHAFCETEQEIDDLRLVLAECANEAVLPILTTSDQVQAYAKSLSMYASVVLHNQPLDQTMS

SEQ ID NO: 22290 - protein, 506 aa, Oryza sativa
  misc_feature (13)..(13): Xaa can be any naturally occurring amino acid
  misc_feature (351)..(351): Xaa can be any naturally occurring amino acid
MPRRPSGGGGGAXPAAAAVRKVPLRKLLRAASVACGVQFGWALQLSLLTPYVQELGIPHAFASLVWLCGPLSGLLVQPLVGHLSDRIAPAASPLGRRRPFIAAGAASIAAAVLTVGFSADLGRIFGDSITPGSTRLGAIIVYLVGFWLLDVGNNATQGPCRAFLADLTENDPRRTRIANAYFSLFMALGNILGYATGAYSGWYKIFPFTVTPSCSISCANLKSAFLLDIIILVVTTCITVASVQEPQSFGSDEADHPSTEQEAFLWELFGSFRYFTLPVWMVLIVTALTWIGWFPFILFDTDWMGREIYRGSPDDPSITQSYHDGVRMGSFGLMLNSVLLGFTSIVPALAXLEKLCRKWGAGLVWGVSNILMALCFVAMLVITYVAKNMDYPPSGVPPTGIVIASLVVFTILGAPLAITYSIPYAMAASRVENLGLGQGLAMGILNLAIVIPQVIVSLGSGPWDQLFGGGNAPAFAVAAAASFIGGLVAILGLPRARIASRRRGHR

SEQ ID NO: 22291 - protein, 813 aa, Bacillus clausii
MNKEKVVLIGNGMAGIRTLEEIIKREPSRFQFTVFGAEPHPNYNRILLSSVLQGDASVSDIVLNDYDWYERNQIELFTGDAVVRVDCRKKEVWSASGIKRTYDRLIFATGSDPFMLPLPGAEKEGVIAFRNIADCESMINAAKSYQKAVVIGAGLLGLEAARGLLNLKMDVDVIHIADHLMDRQLDSDAGKMLKAELEQQGMQFHLNKKTVKINGHKRVKGISFSDQTSIKADLVVMAVGIRPNVQLAKQSGLKVNQAIVVNDYMETSEEDVYAVGECAEHRGIVYGLVAPLYEQGKVLAEHICTNTSNEVSGYKGSIVSTKLKVSGVNVFSAGAFRDQDETKSIRIHDEFAGVYKKLVVKNNQVVGAVLFGDTNDANRILSLIRSGEDISAISKAALFPSETNDSSPSVVATMADEETICGCNGVSKGEIVCAIKEQGLSTVAEIRQCTNASRSCGGCKPEVAELLALTTGTDIMAKPEPLCGCTELTHEAVVASIREMGLSYVREVISVLGWKSEEGCSKCRPALNYYLGLISPLDYTDDAHSRFVNERVHANIQKDGTFSVVPRMYGGVTNPEQLRKIADVAEKYNVPLLKVTGGQRIDLLGVEKEKLPNVWRDLGMRSGYAYGKTLRTVKTCVGEDFCRFGTQDSISLGIEIEKKYEGLNTPHKVKMAVSACPRNCAESGIKDVGIVGVEGAWEIYVGGNGGVDLRSAELLCKVETNEEVMETISAFLQYYREQATYLERTSHWIERVGLESIKKVIFDDSIERAALIERMEMALSRHKDPWTEIVESEEKQNQLFEKKKIAVKQGGGM

SEQ ID NO: 22292 - protein, 526 aa, Arabidopsis thaliana
MKQNETFDQEREDLYHTFDEEDEESQTESSVPSTPLSRNRSEDVPVPWPRSYRQSMDLLTGVTPPTSTSFVSSFRQRRQSSVFGSFTSSPSKQQLLIDKDEIQSSVVSSIKSFLASHLQLSVPGDLLTPQENRSCTFSQSVLNGINVLCGVALLTMPYAVKEGGWLGLFILFSFGIITFYTGILLKRCLENSPGIHTYPDIGQAAFGTTGRILVSILLYVELYASCVEYIIMMSDNLSRMFPNTSLYINGFSLDSTQVFAITTTLIVLPTVWLKDLSLLSYLSAGGVISSILLALCLFWAGSVDGVGFHISGQALDITNIPVAIGIYGFGFGSHSVFPNIYSSMKEPSKFPTVLLISFAFCTLFYIAVAVCGFTMFGDAIQSQFTLNMPPHFTSSKIAVWTAVVTPMTKYALTITPVMLSLEELIPSSSRKMRSKGVSMLFRTILVLSTLVVALTVPFFATVAALIGSFIAMLIALIFPCLCYISIMKGRLTNFQIGICILIVIIGIVSGCCGTYSAIARLIGEMT

SEQ ID NO: 22293 - protein, 92 aa, Kluyveromyces lactis
  misc_feature (12)..(12): Xaa can be any naturally occurring amino acid
  misc_feature (62)..(62): Xaa can be any naturally occurring amino acid
  misc_feature (76)..(76): Xaa can be any naturally occurring amino acid
ARPAFVNKLWSXVNDKSNEKFIHWSTSGESIVVPNRERFVQEVLPKYFKHSNFASFVRQLNXYGWHKVQDVKSGSXLSNNDSRWEFENERHA

SEQ ID NO: 22294 - protein, 742 aa, Bacillus clausii
MGSESRQRLVLIGNGMAGVRVVEEVLKLAPRQFAITILSEEDRPSYNRILLSSVLQGKQTLHSIGIHPFQWYVDHGIELRLGEEATRIDPVAQKVYTDKGELAYDKLVIATGSEPFVLPVPGVEKEGVFVFRTIRDCERLTEWSTRYQKAAVIGGGLLGLEAAQGLAHLGVDVSVIHLSDRIMERQLDETAARLLKQSLESKGIHFLLQKQTAEISGEERVTGLLFHDGTTLSADFVVMAAGVQPNIAIAKESNIPTKRGIVVDDRLRTDVSGVYAVGECAEHNGISYGLVAPLYEQAKVLARELCGLPGLYYNGTVLATQLKISGVNVFSAGETTCSGTCTVLKTLNEITGQYKKLLFKEDCLAGAVLFGNTRQSDQLLQLIRANTPLSDDEKTQLLTEDGTAFERELASLPASHLICNCNAVSKGDIMSAMAAGQHTIAQIKAGTKAASSCGGCEVRVAAMLESFKHGQLQATVDIAERKPLCPCTSLTEQQVAQSIAEKRLVVFSDMSEKLGWKNKNGCRVCREVSAYYAGLFFPGGAPKERNGKQENDGSYTITLPHIAGRLSTDQLKQFALMAEELQVPRIDFSARNQVQLKGLTEKQLPYVFEQLDMPPAVLAGKRLQVAIDDSHYNWPEGRHLAERLLDLFNCVPFPAETEVCVTLAARRHELAAIRLSRSPLNWEVAIGSELFCSNDSVEGTFQLVCALLQYFRQSAQYSENIHAWLVRKGAVHVREVVFDAAC

SEQ ID NO: 22295 - protein, 719 aa, Bacillus clausii
MQSGYLQEKRQPPNRKIVYNSQCPFCSVQCKMQLIERKHGQETSYDVVGIENPTSKGRLCVKGLNAHQHAFHPDRLTQPLAKVNGKWLPISWDEALKQIAENVQAIQQEDGHDAMAVYGSASITNEEAYLLGKFARVALKTRHIDYNGRLCMSAAASAATTAFGIDRGLTNSLEDVLFAECLMLVGTNLAECQPTLMPYIEQAKKNGAFLIVVDPRETATAQLADLHIKLKPGTDAALANGLLKCILEGGYEDAAFIQKRVEGFAEVKAHIAKLKLENIAEQTGVSGDVITKAAETFAKARTGMIFTARGVEQQTNGSMAVRNFLNVLIATGKLGKHSCGFAAVTGQSNGQGAREHGQKADQLPGYRSIENEEHRAHIAAIWGISPEQLPRKGVSAFEMMKKADKGEITGMFLMCSNPVVSHPQADFVKNALKKLKFLVAVDLFVSETAQLADLILPSTSYLEDEGTMTNVEGRVTLREASMPPYGEARHDWQIICNIAAVLGKGTDFSYSCAEDIFTELRMASKGGIADYYGITYERLRKEKGIFWPCPSLEHPGTPLLFTDCFYRPNKKALMTVVPNDAPVPKEKPSRDYPLYLTTGRVLAHYLTGVQTRNSASLMARNFESFVEMHPETAKKHGIADRTLIKLTTKQGSMIVRCHFTETIREDTVFVPFHWSGKQNVNRIITGNLDPDCRMPAFKVSAVRAEPLVVHEQMEGVLGT

SEQ ID NO: 22296 - protein, 322 aa, Xanthomonas campestris
MSAFSASPAKHSRLLILGSGPAGWTAAVYAARANLKPVVITGLQQGGQLMTTTEVDNWPGDPHGLMGPDLMSRMQAHAERFETEVIFDHIHTADLSQRPFRLIGDGAEYTCDALIIATGATAKYLGIPTEEAFKGRGVSACATCDGFFYKDQDVVVVGGGNTAVEEALYLSNIARKVYLVHRRDTLRAEKIMQDKLFAKVAAGKIETVWHHAIDEVLGNDAGVTGVRVKSTIDGSTRDIDAHGFFVAIGHHPNTQLFDGQLAMNNGYLEIRSGLNGAATETSVAGVFAAGDVADQHYRQAITSAGFGCMAALDAERYLDKSA

SEQ ID NO: 22297 - protein, 447 aa, Escherichia coli
MDQTYSLESFLNHVQKRDPNQTEFAQAVREVMTTLWPFLEQNPKYRQMSLLERLVEPERVIQFRVVWVDDRNQVQVNRAWRVQFSSAIGPYKGGMRFHPSVNLSILKFLGFEQTFKNALTTLPMGGGKGGSDFDPKGKSEGEVMRFCQALMTELYRHLGADTDVPAGDIGVGGREVGFMAGMMKKLSNNTACVFTGKGLSFGGSLIRPEATGYGLVYFTEAMLKRHGMGFEGMRVSVSGSGNVAQYAIEKAMEFGARVITASDSSGTVVDESGFTKEKLARLIEIKSSRDGRVADYAKEFGLVYLEGQQPWSVPVDIALPCATQNELDVDAAHQLIANGVKAVAEGANMPTTIEATELFQQAGVLFAPGKAANAGGVATSGLEMAQNAARLGWKAEKVDARLHHIMLDIHHACVEHGGEGEQTNYVQGANIAGFVKVADAMLAQGVI

SEQ ID NO: 22298 - protein, 110 aa, Brassica napus
  misc_feature (82)..(82): Xaa can be any naturally occurring amino acid
PLVRCDSLRKLEIRDCPFGDKALLASASKLETMRSLWMSSCSVSFGACKLLLHKMPKLNVEVIDERGPPDSRPESCPVERVXFIYRTVAGPRFDMPDFVWNMDQQSSMSV

SEQ ID NO: 22299 - protein, 231 aa, Populus tomentosa
MVMAGSNSLSADKQESSLSSLLSDSSGSQQDSPSSNEKVLLAASRPKKRAGRRIFKETRHPIFRGVRKRNGDKWVCELREPNKKSRIWLGTYPTPEMAARAHDVAALAFRGKSACLNFADSAWRLPAPISNEAKDIRRAASEAAELFRTSDLGGQVMEDHTTENRGEVCSSTNDDIRDLPSENVSYIDEEAEFNLPGLLANMAEGLLLSPPHYTGDWNDGEIDADWSLWSS

SEQ ID NO: 22300 - protein, 705 aa, Bacillus licheniformis
MGQEKHVFSIDWAGRKLTVETGQLAKQANGAVMVRYGDTAVLSTATASKEPKTVDFFPLTVNYEERLYAVGKIPGGFIKREGRPSEKAILASRLIDRPIRPLFADGFRNEVQVVSIVMSVDQDCSSEMAAMFGSSLALCVSDIPFEGPIAGVTVGRVDNKFIINPTLEQLEKSDIHLVVAGTKDAINMVEAGADEVPEEIMLEAIMFGHEEIKRLIAFQEEIVAAVGKEKSEITLYEIDSDLKEKVRGMAESNLLKAIQVHEKHAREDAISEVKNEVLAKFEEEEHDEETLKQVKDILSQLVKNEVRRLITEEKVRPDGRAVDEIRPLSSEVGLLPRTHGSGLFTRGQTQALSICTLGALGDVQILDGLGVEESKRFMHHYNFPQFSVGETGPMRGPGRREIGHGALGERALEPIVPSEKDFPYTIRLVSEVLESNGSTSQASICASTLAMMDAGVPIKAPVAGIAMGLVKSGDNYTVLTDIQGMEDHLGDMDFKVAGTSKGVTALQMDIKIEGLSREILEEALQQAKKGRMEILESMLSTLAESRKELSPYAPKILTMSINPDKIRDVIGPSGKQINKIIEDTGVKIDIEQDGTIFISSTDESMNQKAKKIIEDLVREVEVGQLYLGKVKRIEKFGAFVELFSGKDGLVHISELALERVGKVEDVVKIGDELLVKVTEIDKQGRVNLSRKAVLREQKEKEEQKS

SEQ ID NO: 22301 - protein, 231 aa, Populus tomentosa
MVLAGSNSFSADKQESSLSSLLSDSSGSQQDSPCSNEKVLLAASRPKKRAGRRIFKETRHPIFRGVRKRNGDRWVCELREPNKKSRIWLGTYPTPEMAARAHDVAALAFRGKSACLNFADSAWRLPAPISNEAKDIRRAAGEAAELFRTSDLGGQVMEDHTTEDRGEVCSSTNDDIRDLPSENVSYIDEEAESNMPWLLANMAEGLLLSPPHYTGDWNDGEIDADWSLWSS

SEQ ID NO: 22302 - protein, 88 aa, Hordeum vulgare
DRYLKPWIIPVPEVTIVPRAKDDECLILASDGLWDVLSNEEVCDVARKRILLWHKKNGVNLSSAQRSGDSPDPAAQAAAECLSKLALQ

SEQ ID NO: 22303 - protein, 171 aa, Chlorella vulgaris
YVKSLAPNQLVTVGEDGFYQPATCQANQANPVATTNGGPGGAWPVATGNDYLPNHMADGIDYASIHMWPDNWGRTDKAFGQTWLAAHIADTKYLGKPLVLEEFGKAVGGYLPIDKQEGPEAQYAYYKQTYEAAQASLQANTGLKGIMFWRWAGVDPPPSWQTSTRAPPSPP

SEQ ID NO: 22304 - protein, 234 aa, Triticum monococcum
RLSCLQQQRSQQLNLSQIQTGGFPQEPSPRAAHSAPVTPPSSGWGGLWTQQAVQGQPHGQLMVQVPNPLSTKSNSSRQKQQKPSPDAAARSPSGGAATPRRPGQAAASDKQRQQGARTPAAAPAAGDKNLRFLLQKVLKQSDVGTLGRIVLPKKEAETHLPELKTGDGISIPIEDIGTSQVWSMRYRFWPNNKSRMYLLENTGDFVRSNELQEGDFIVLYSDVKSGKYLIRGVK

SEQ ID NO: 22305 - protein, 159 aa, Unknown
  Synechococcus sp. RS9917
MSVNVSAVTVRAADGSEKSLGDYSGQVLLIVNVASRCGFTKQYAGLQALQDAYGSKGLQVLGFPCNDFGAQEPGTLDEIKSFCSTTYGASFELFDKVHATGSTTEPYTSLNQTNPAGDVAWNFEKFLVGKDGTVIGRFKSGVTPEDPELKAAIETALAA

SEQ ID NO: 22306 - protein, 419 aa, Haemophilus somnus
MLKRSMNIADYDPVLWQAIQDENLRQEEHIELIASENYASPRVMEAQGCQFTNKYAEGYPGKRYYGGCEYADIVEQLAIDRAKALFGADYANVQPHSGSQANAAVYMALLNPGDTILGMSLAHGGHLTHGASVSFSGKIYKAEQYGITSEGLIDYDALRKQAHEVKPKMIVGGFSAYSQIVDWAKMREIADEVGAYLFVDMAHVAGLIAAGVYPSPMPHAHVVTTTTHKTLAGPRGGLILANGNEELYKKLNSAVFPAGQGGPLVHVIAAKAVCFKEALEPEFKTYQAQVVKNAKAMVEVFKQRGYNVVSNGTENHLFLVDLVSHGLTGKAADAALSRANITVNKNAVPNDPQKPFVTSGIRVGTPAVTRRGFNEEDVAELAGWMCDILDSMNKDNHEQVIADTKEKVLAICKRLPVYP

SEQ ID NO: 22307 - protein, 250 aa, Camellia sinensis
MGKCYPTVSEEYKKAIDKAKRKLRGLIAEKNCAPIMLRLAWHSAGTYDVTTKTGGPFGTMRHKLEQGHGANNGLEIAVRLLEPIKEQFPIISYADFYQLAGVVAVEITGGPDVPFHPGREDKPEPPVEGRLPDATKGTDHLRDVFVKHMGLTDKDIVALSGGHTLGRCHKERSGFEGPWTANPLIFDNSYFTELLTGEKEGLLQLPSGKALLNDPVFRPLVEKYAADEDAFFADYAEAHMKLSELGFAEA

SEQ ID NO: 22308 - protein, 201 aa, Oryza rufipogon
GVLPSDQEIAVKRLSQSSRQGIEELKNELVLVAKLQHKNLVRLLGVCLEEHEKLLVYEYMPNKSLDTILFDPDRSNVLDWWKRLKIVNAIARGLQYLHEDSQLKIIHRDLKASNVLLDSDFNPKISDFGLARLFGNDQSQDVTNRVVGTYGYMAPEYAMRGHYSIKSDVFSFGVPILEIVTGRKNNVSYDSEQSVDLLTLV

SEQ ID NO: 22309 - protein, 384 aa, Arabidopsis thaliana
  misc_feature (138)..(138): Xaa can be any naturally occurring amino acid
MDAEKKSAHFRQISSYKPQLLVLSSIHENPSSKISEKANIKADNDAEIGVFGAEKYFSMKLDHVDSTADITKQHEKENTHDHPNANPNPNTHPHPHPQLTKTTSSRSKTSRHGTPSVRSESSCNSQTFLMRINNHNEXQRKMNDTSISFGGFRCYCPCSGIKTVHTDPKNSCKSRNSDRDFVAYDARKHNDKPRLHFEAKKADFHAQEKISLPIQRSDIAMNLERKLSLLTWDAIPNQLSTKNNNHNNNGNNSSMSSNTQEEETASVASSDLFEIENITSSVYEPSEASIGWSVVTGSMADQSVISDFDMMKRVTRNGPVVKTKPVIGEKVRSAGFLSGCKSHKAVSVVDSSRKVKETAKVDHHEMSHQKKFKTEIRIQDLSFL

SEQ ID NO: 22310 - protein, 449 aa, Aspergillus oryzae
MSNTDFLGRAIDAVKKAIELDNSGEYEKAYQGYYSALELFMLALKWEKNPKSKEMIRAKTGEYLDRAEKLKTHLEATESRKKPSAVGANGKVAQGSGKGEYVSQSSQSCFYIGVGKNEDDNEDADSKKLRSALAGAILSDKPNVKWEDVAGLESAKEALKEAVILPIKFPHLFTGKRQPWKGILLYGPPGTGKSYLAKAVATEANSTFFSVSSSDLVSKWMGESERLVKQLFNMARENKPAIIFIDEVDALCGPRGEGESEASRRIKTELLVQMDGVGKDSRGVLILGATNIPWQLDAAIRRRFQRRVHISLPDINARVKMFMLAVGQTPCEMTQADYRTLAEMSEGYSGSDISIAVQDALMQPIRKIQTATHYKKVLVEGQEKVTPCSPGDAGAMEMTWTSVEADQLLEPPLVLKDFIKAVRNSRPTVSQEDLQRNSEWTKEFGSEGA

SEQ ID NO: 22311 - protein, 169 aa, Oryza sativa
MGVLSAADPPPVSAIGFEGYEKRLEITFSEAPVFADPDGRGLRALSRAQIDSVLDLARCTIVSELSNKDFDSYVLSESSLFIYSDKIVIKTCGTTRLLLTIPRILELAEGLSMPLAAVKYSRGMFIFPSAQPAPHRSFSEEVAVLNRYFGHLKSGGNAYVIGDPAKPGQ

SEQ ID NO: 22312 - protein, 470 aa, Aspergillus oryzae
MATYALSQAHRDQMEKTLVESDPEIAQIMEKEIQRQRESIVLIASENFTSHAVFDALGSPMSNKYSEGYPGARYYGGNQHIDAIELTCQARALKAFNLDPAKWGVNVQCLSGSPANLQVYQALMRPHDRLMGLDLPHGGHLSHGYQTPARKISAVSTYFETFPYRVNLETGIIDYDALEANAELYRPKCLVAGTSAYCRLIDYERMRKIADKVGAYLIVDMAHISGLIAAGVIPSPFEYADVVTTTTHKSLRGPRGAMIFFRKGVRSTDKTGKEILYDLEGPINFSVFPGHQGGPHNHTITALAVALKQVDTPEFKQYQQQVLNNAKALENEFKQLGHKLVSDGTDSHMVLVDLRAQKLDGARVEAVLEQINIACNKNSIPGDKSALTPCGIRIGAPAMTTRGMGEEDFKRIAHYIDKAIKICKDVQGALPKEANKLKDFKAKVASETVSDILELRKEIAAWASTFPLPV

SEQ ID NO: 22313 - protein, 167 aa, Synechococcus elongatus
MKIRNVSMAPQVTDIAVTTIDGAAKSLSDYAGQVLLIVNVASYCGYTSQYSGLEALYRQYRDRGLQVLAFPCNDFGAQEPGSNEEIKTFCSTRFDVSFELFDKVHAKGADQHPLYAALTQTDPAGDVAWNFEKFLVGKDGTVLARFKSGVAPNDASLIQAIEAALAA

SEQ ID NO: 22314 - protein, 390 aa, Rhizobium leguminosarum
MNECVGVKTIGGAIVAFANITETSLACRTAGANFRIRYFISVSRRFIMQLGMVGLGRMGNYMVQRLMRGGHECVVYDARPESVAELAGLGATGSASLADFVSKLAHPRAIWLMLPAAIVDKVLASLVPLLENGDIVIDGGNSYYHDDIRRGADLITKGIHYVDVGTSGGVFGLERGYCLMIGGEKGIVEHLSPIFATLAPGVGKTEASPNRSAEAAAVSTAEQGYLHCGPHGAGHFVKMVHNGIEYGLMAAYAEGINILKHANIGAASHEADAETAPLAHPEYFQYDFNLQDVAEVWRRGSVITSWLLDLTADALHADPALSKYAGRVSDSGEGRWTIMAAIDESVPTPVLSAALYGRFSSRDNDEFANKVLSAMRAGFGGHVEKPAAKS

SEQ ID NO: 22315 - protein, 456 aa, Salmonella enterica
MDSQQHGEQLKRGLKNRHIQLIALGGAIGTGLFLGSASVIQSAGPGIILGYAIAGFIAFLIMRQLGEMVVEEPVAGSFSHFAYKYWGGFAGFASGWNYWVLYVLVAMAELTAVGKYIQFWYPEIPTWASAAAFFVIINAINLTNVKVFGEMEFWFAIIKVIAVIAMILFGAWLLFSDTAGPQATVRNLWEQGGFLPHGWTGLVMMMAIIMFSFGGLELVGITAAEADNPEQSIPKATNQVIYRILIFYIGSLAVLLSLLPWTRVTADTSPFVLIFHELGDTFVANALNIVVLTAALSVYNSCVYCNSRMLFGLAQQGNAPKALLNVDKRGVPVSSILVSAVVTALCVLLNYLAPESAFGLLMALVVSALVINWAMISLAHMMFRRAKQQQGVKTRFPALFYPFGNVLCLLFMAAVLIIMLMTPGMAISVWLIPVWLLILGVGYLCKEKTAKTVKAH

SEQ ID NO: 22316 - protein, 342 aa, Aspergillus oryzae
MSLYQNIALNGSFALHGLRHPLDMYSSLGPTLSEATFGLLGYSFEPSRDIGDLSGKVLFVTGGNAGLGKETVLQLAQHNPSRIYLAARDATKAREAISSIQDIISASVDIRHIQLDLSSFQSTRDAAEKFCSECDRLDILILNAGTMANPPELTKEGFEIQFGTNHIGHFLLTKLLLPTLKKTVGSPASDVRIVTLSSVGSHAAPSLDVMTSTSALLDSHTLVRYSASKAANILFASELARRYPEILSVSVHPGVVSSELYRHTGAMNAISKFGVGLLSTVFRSIRTGAMNQLWAAGTKREQLVNGAYYVPIGVRGSSRFTDDADMARKLWEWTENQIAEKS

SEQ ID NO: 22317 - protein, 484 aa, Chlamydophila abortus
MVADKAGADIGLIGLAVMGKNLVLNMIDHGFSVSVYNRSPEKTREFLQEHSQSPELQGHETLESFVRSLKRPRKIMLMIKAGTPVDQSIDSLLPYLEAGDIIIDGGNSYYKDSERRCRDLKEKGILFIGMGISGGEEGARHGPSIMPGGNSDAWPAIAPIFQSISAKVNGNPCCCWVGPGGAGHYVKTVHNGIEYGDIQLICEAYGLLRARLDLSPEAVSVIFAEWNTRELESYLMRISVEVLSLKDSNGFPVIDTILDVAGQKGTGRWTAIDAIDSGVPLSLIIESVLARFLSSWKTIRERASQELPGVPIVFEKPRDPHLFIEDVFQALYASKIISYAQGFMLLKQASEEHQWNLNFGELALLWRGGCIIQSVFLDAIHKGFENEPEAPSLILQSYFKTVLQHSEPGWRRTVAYGVGSGYPMPCLAAALTFYDGYRTKDSPIALAQGLRDYFGAHTYERKDRPRGEFYHTDWIGSKTTTLVK

SEQ ID NO: 22318 - protein, 319 aa, Anabaena variabilis
MRIANDVTELIGGTPLVKLNKIPQAEGVVARIVVKLEGMNPASSVKDRIGVSMINSAEAEGLITPGKTILVEPTSGNTGIALAMVAAARGYRLILTMPETMSQERRAMLRAYGATLELTPGTEGMRGAIRKAEELVASTPDAHMLQQFRNPANPKIHRETTAEEIWNDTDGEVDIVIAGVGTGGTITGIAEVLKQRKPSFQAIAVEPSNSPILSGGQAGPHKIQGIGAGFVPDVLRLELVDEVIRVSDDQAMSYGRRLAREEGLLSGISSGAALCAALQVGKRPENAGKLIVMVQPSFGERYLSTPLFQDLTNETAGVR

SEQ ID NO: 22319 - protein, 337 aa, Mesorhizobium loti
MLEKFERYPLTFGLTPIEKLDRLGKHLGGKVEIYAKREDCNSGLAFGGNKLRKLEYVIPDAIASDADTLVTVGGVQSNHTRMVAAVAAKIGMKCLLVHESWVPHEDVVYDRVGNILLSRILGAEVRLVDDGFDIGIRRSWEKALYEVKARGGRPYAIPAGASVHPNGGLGYVGFAEEVRAQEEQLGFAFDYMVVCTVTGSTHAGMLVGFAKDGRQRNVIGIDASATPAKTKAQVLSIARHTATLVELGSELAEDDVVLLEDYAHPRYGIPSEETKEAIRLCARLEGMITDPVYEGKSMQGMIDLVQKGFFPAGSRILYAHLGGAPAINGYGYTFRNG

SEQ ID NO: 22320 - protein, 415 aa, Glycine max
MDPCPFVRILVGNLAVKSPASSKPSSFSGKVHPSSSPFFCKILLQGLDSNSTSPRVSSVPLISDSDPHPHSFAASFDFSKAQILKASKKPLMKISVYKGPTTPSCVFTSAKLLGKVSIPLDLTLAESRPCTFHNGWLSLSKNTNPSQLLHLTVRAEPDPRFVFRFDGEPECSPQVFQIKGDVKQPVFTCKFSFRDKDKAHFPSLNANHAAERKGWSITVHDLSGSPVAAASMATPFVPSPGSQRVSRSNPGAWLIIRPDGDGTWKPWGRLEAWREPNNSNAVGYRFEVLPGTADPVTLAASTISSQHGGKFAIDATSGVTPVNTPRGSWDLGSGSGSGSNSDFGLEPNFFYNKGFVMSAMVSGEGKCSKPEVEVGVQHVTCTEDAAAFVALAAALDLSIDACKLFSQKLRKELRQ

SEQ ID NO: 22321 - protein, 135 aa, Saccharomyces cerevisiae
ARTKQTARKSTGGKAPRKQLASKAARKSAPSTGGVKKPHRYKPGTVALREIRRFQKSTELLIRKLPFQRLVREIAQDFKTDLRFQSSAIGALQESVEAYLVSLFEDTNLAAIHAKRVTIQKKEIKLARRLRGERS

SEQ ID NO: 22322 - protein, 102 aa, Saccharomyces cerevisiae
SGRGKGGKGLGKGGAKRHRKILRDNIQGITKPAIRRLARRGGVKRISGLIYEEVRAVLKSFLESVIRDSVTYTEHAKRKTVTSLDVVYALKRQGRTLYGFGG

SEQ ID NO: 22323 - protein, 595 aa, Pseudomonas putida
MCGLAGELRFTPIDQAPRPADLAAVERITHHLAPRGPDAWGFHSQGPIALGHRRLKIMDLSDGSAQPMVDNTLGLSLAFNGAIYNFPELREELQALGYSFWSDGDTEVLLKGYHAWGAALLPKLNGMFALAIWERDNQRLFLARDRLGVKPLYLSRNGERLRFASTLPALLKGGDIDPMLDPVALNHYLNFHAVVPAPRTLLANVQKLEPGTWMRIDRHGEVERQVWWQLHYGPHPDERELDLEGWTTRVLDATRDAVAIRQRAAVDVGVLLSGGVDSSLLVGLLREVGVDDLSTFSIGFEDAGGERGDEFQYSDLIAKHYGTRHHQLRIAEHEIIDQLPAAFRAMSEPMVSHDCIAFYLLSREVAKHCKGVQSGQGADELFAGYHWYPQVDGADDAYAAYREAFFDRSHAEYRDTVQAPWLLETDAAGDFVREHFARPGAPAAVDKALRLDSTVMLVDDPVKRVDNMTMAWGLEARTPFLDYRLVELSARIPARFKLPDGGKQVLKQAARRVIPHEVIDRKKGYFPVPGLKHLEGATLGWVRELLTDPSQDRGLFNPTMLDRLLSNPHGQLTPLRGSKLWQLAALNLWLSEQGI

SEQ ID NO: 22324 - protein, 130 aa, Saccharomyces cerevisiae
SSAAEKKPASKAPAEKKPAAKKTSTSVDGKKRSKVRKETYSSYIYKVLKQTHPDTGISQKSMSILNSFVNDIFERIATEASKLAAYNKKSTISAREIQTAVRLILPGELAKHAVSEGTRAVTKYSSSTQA

SEQ ID NO: 22325 - protein, 577 aa, Synechococcus elongatus
MSGSASRSTAANPLELAWITPSAAQLASTADLYYVQDLLGRYLSFAWRSGQWLGLNSEQVVGSYLSEQFTPVDLNLYLARMRRAMHRGRAEQFRTGFRFQGQVYVFDLTLSPILQPQQASTLLLVIGRQQEPLPEALPEPPIAIAPPHHAKLFAQIAWDIRRTLDPETIWRHTVQGLGQALGLQRCLLCPYELGSTAIAIVAEYRQAHLPVVLGEQLAIARNPSLADALLSLRPTQAVVDFERSPAEPIWMVPTGYQDHPNGVLLLRSAEELTAGDRDLVWELADQVGTALAHARLYAQSQALALELQRANQTLLEQQQALIEAHRQSEALSQLKTDFLANTSHELRTPLTGMIGYLQLLQDDLAETPEERQEFIAGAYHSALHLLGIINDILDIARIEAGRLQLQAETVPLRNLLAEVETCLRSQAQAKGLVYRCRIAAETESVALWGDRQRLLQVLFNLVGNAIKFTLTGYVEVRATAVWQPLCANGQNLPGYLRLEIEDSGIGVAPERQGSLFQPFSQADSSLTRQFGGSGLGLVICRRLLESMGGIVELFSPGEGLGTTVTCLIPLAPAIIPS

SEQ ID NO: 22326 - protein, 225 aa, Methanosarcina barkeri
MVSREYVKGDLPEKAAILQRDGETYAIAPHIPGGIVYPETLRKIADIAEKYGAAALKITSAQRIAIVGLKEEDLDAAWGELNLKPGAAIGLCVRSVKICPGTTFCKRGKQDSVGLGLKLDEKYHGMQLPSKFKMGVSGCQNSCSEPMIKDIGLMGTAKGFTLSVGGSAGPRPRLGSVVAKDLTEEQALDLVERIIDFYKKYPKPRRLGEVIDEIGLEKFKEEVGL

SEQ ID NO: 22327 - protein, 473 aa, Unknown
  Shewanella sp. MR-4
MQHGDEMMKKMTGKSFALSALVAASFMAAGAMASDKTEPRNEVYKDKFANQYNSWHDTAKSEEITDALAGDPSLVILWAGYGFAKDYNAPRGHMYAVTDVRNTLRTGAPTNAEDGPMPMACWSCKSPDVPRLIEEQGEDGYFKGKWAKGGPEVVNTIGCSDCHEKGTPKLRISRPFAERGMEALGTPFDKASKKDKQSMVCGQCHVEYYFEKKDDRKGFVKFPWDSGTTVEQMEAYYDAIEFSDWTHSLSKTPMLKAQHPGYETWKMGVHGKNDVSCVDCHMPKVTNDKGRKYTDHKVGNPFDRFDETCATCHSQSKEFLEGITKERYAKVKELKARAEGQLVKAHFEAAKAWEVGATEAEMKPILTDIRHAQWRWDFAIASHGVAAHAPEEALRILGTAVDKAADARVKLAQLLAKKGVTDAVAIPDISTKAKAQAALGMDMDKMNAEKEAFKKDMLPKWDAEAKKREATYK

SEQ ID NO: 22328 - protein, 298 aa, Streptomyces antibioticus
MDLTGRRAVVTGGASGLGAETVRALAAAGAEVTVATRRPLSAEPLVQELAAAGGAGRVTAEALDLSDPASVESFARAWRGPLDILVANAGIMALPTRTLAPNGWEMQLATNYLGHFALATGLHAALRDAGSARIVVVSSGAHLDAPFDFEDAHFARRPYDPWVAYGQSKAADVLFTVGARRWAADGITVNALNPGYILTRLQRHVDDETMRAFGVMDDQGNVKPLPYYKTPEQGAATSVLLAASPLLKGVTGRYFEDNQEARTVQGQEDQPGGVAAHALDPEAADRLWEYGTDALRAA

SEQ ID NO: 22329 - protein, 213 aa, Yersinia pestis
MEKEMSNKKRSASSSRWLQEHFSDKYVIQAQKKGLRSRAWFKLDEIQQSDKLFKQGMTVVDLGAAPGGWSQYAVTQIGSKGRVIACDLLPMDPIVGVDFLQGDFRDELVLKALLERVGDKKVQVVMCDMAPNMSGTPAVDIPKSMYLVELALDMCRDVLAPGGSFLVKVFQGDGFDEYLREIRSLFTKVKIRKPDASRARSREVYIVATGRKL

SEQ ID NO: 22330 - protein, 441 aa, Arabidopsis thaliana
MANDYISFVFKSLLLLIHLVFLGQHHVDSASVVKSLPGFEGPLPFELETGYIGVGEEEEVQLFYYFIKSERNPKEDPLLLWLTGGPGCSAISGLLYENGPLTMKLDVYNGTLPSLVSTTYSWTKNSSMIFLDQPVGTGFSYSRTELFNKPSDTGEAKRIHEFLQKWLGKHQEFSSNPFYVGGDSYSGITVPATVQEISKGNYQCCKPPINLQGYMLGNPITDSKIDGNSQIPYAHGMALISDELYESLKRICKGEYEHVDPYNTECLKLLEEFNECTSKLYRSHILYPLCEMTNPDCYIYRYSLSHYWVNDETVRKALQINKESIREWKRCDWSKPYTKDIISSVPYHMNNSINGYRSLIFSGDHDFEVPLIGTQVWIKSLNYAIVDKWRPWMINNQVAGYTRTYANKMTFATVKGGGHTAEYKPDETFIMFQRWINGQAL

SEQ ID NO: 22331 - protein, 201 aa, Oryza rufipogon
GVLPSDQEIAVKRLSQSSRQGIEELKNELVLVAKLQHKNLVRLLGVCLEEHEKLLVYEYMPNKSLDTILFDPDRSNVLDRWKRLKIVNAIARGLQYLHEDSQLKIIHRDLKASNVLLDSDFNPKISDFGLARLFGNDQSQDVTNRVVGTYGYMAPEYAMRGHYSIKSDVFSFGVLILEIVTGRKNNVSYDSEQSVDLLTLV

SEQ ID NO: 22332 - protein, 533 aa, Oryza sativa
  misc_feature (35)..(35): Xaa can be any naturally occurring amino acid
  misc_feature (58)..(58): Xaa can be any naturally occurring amino acid
MEAVGVAPAPAGVPEKKLLEVKESRKAAPAAPSTXSMAAKWAMKKKLVGGDAGYVLEXDVPHLTDYLPELPTYPNPLQDNPAYSVVKQYFVNTDDTVTQKIVVHKTSARGTHFRRAGPRQRVYFQSDEVNAAIVTCGGLCPGLNTVIRELVCGLYDMYGVTSVVGIEGGYKGFYSRNTVALTPKSVNDIHKRGGTVLGTSRGGHDTGKIVDSIKDRGINQVYIIGGDGTQKGASVIYEEVRRRGLKCSVVGVPKTIDNDIAVIDKSFGFDTAVEEAQRAINAAHVEAESAENGIGVVKLMGRNSGFIAMYATLASRDVDCCLIPESPFYLEGKGGLLEFIEKRLKDNGHMVIVVAEGAGQDLIAKSMNFVDTQDASGNKLLLDVGLWLSQKIKDHFKKKRNFPITLKYIDPTYMIRAVRSNASDNVYCTLLAHSALHGAMAGYTGFTVAPVNGRHAYIPFYRITEKQNKVVITDRMWARVLCSTNQPCFLSHEDVEHLKHDDDEHHLHNTQLLEGESSPVKDSSKCNGTAAPV

SEQ ID NO: 22333 - protein, 248 aa, Picea glauca
MEHLNAAAAQASSSLYGVSMAEYGDVGVSSMMALMTQHEPHERDSILTTSMPSSFSSFHGHAECLLSAAMFQASQGDHKLKRQPEMDQLVSEQAVMSDSSMPSVKTEGCSSLRNQFEIRREQTGNCYTDQSSNAPVSPLVTSLVPQAGGEARMMTSLEADSSHFSGGNEAEAIKAKILAHPQYPSLLGAYIDCQKIGAPPEVVARLDALTNEYENQQHRTTVSIGMDPELDQFMEAYCEMLTKYHEEL

SEQ ID NO: 22334 - protein, 192 aa, Glycine max
MSSFTHATTLLHAHIKTKHKKPSTTTTTTTPLPHNHSPNRRKLISTFLATSTAALLVHGVTSTPQALAQSWGTHSFIKEHFFEPGLSPEDAVARIKQTAEGLHSIREALETMSWRYIMFYIRIKQAYLDQDLRTAFTTLPESRRKEYVKTANELVSNFGEFDRHIRTPKVYESYLYYEKTLKSIDQLVAILA

SEQ ID NO: 22335 - protein, 297 aa, Bordetella parapertussis
MTTASLRFGLAANRLHHETPDAALFTWLRACSATIREMGIQLHTVGRTHDAIVREDMLQGYSGLVRYPYGREGGLMKLVARVTEGRDGDAPFDGAIYLIDPVDPSSIFPEALALKRQCITHGRPFISTLAGAIEWIEVERVLAGLAPDATAARLFDFTGQTLALISHDALKEEMVAFAAEHFDLLSQFARRVATGTTGGLLNDLAWSRGWPKDRPWVHRYLSGPLGGDAQIAELVLEHQCQRVIFFEDPHVARQHEADIQLLERAVRVVTASATCATSPSVARRWAQAVQRRQAGRA

SEQ ID NO: 22336 - protein, 663 aa, Aspergillus oryzae
MCGLTAFLTVGGIPGCVHYANNCPGLEKQLEESLDLVNHRGPDARGRWFSTDHRVGLGHVRLSIVDLSSAGNQPFHDSEGAIHAVVNGELYDHEEHRTELAQEYDFKSNSDCEIVIALYRHYGISFLNKLRGEFALVLYDANRKLFLTARDRYGIKSLYYTMVGNRLLVATEMKSFLPFGWKPEWDVTAIREGAWMNGSQMLFKGVQRYMVSQNFNPPERTVYPHSEEEVIERVRELMLDAVRVRLRADVGLGIYLSGGLDSSAIAGMAVKLVQEGTKLGNDTSGERSKIDCFTVQFEKDSGFDESDIARRTAEWLGVGYHPVYLDEEAIAARLEDTVWYSEIPAANVNGMGRLAVAEAAHAMGKKVILTGEDSDEHFSGYSDLLPNFLLEPDYSWPQSLAKQSDFAEAWKVMEERNQILAMGMDEVAGPTKRMLNNTTLCARLSTFTTLPYSSWTDQLALRSPATAFAENFGVQVLHKMMEKWHPLHSTQYQWMKSVLANYILRYIGDNVDMVHQIETRPPFLDHYVTEYANNIPPSLKIKYDPESKTFREKNILREAMKPFVTEEIYNRTKHPFVGPFTYQEDGPVHKSLKRLLTEENVNQLGFFDNDRVQSNLVKAFRDKDGVCFQRALAVAQYVVLGQRFGVKKAQDPGCSETSSGPYV

SEQ ID NO: 22337 - protein, 551 aa, Lactobacillus acidophilus
MSHWYDHAIIYQIYPKSFQDSNDDGIGDLNGIRKRIPYLQNLGVNAVWLNPVFVSPQVDNGYDVSNYFAIDSHMGTMEDMENLIKDLHKAGIHIIMDFVLNHTSDQHPWFQDAIKNPDSLYRDYYIFAGHDNKQPNNWGSFFGGSVWEPDPAGTGQSYFHLFDKRMPDLNWKNPEVRHAMLEIAEFWLKKGIDGLRLDAFIHIGKADLRQNYPAMDDKPVIAEPFFANLPQVQEWMRPFCEQIKEDYPDALLLGEAASASVNLAVDYTNKRNHLMDCVITFRYFTEDDSKIDKSYSAQYQPKELDLTAFKQNQVVWQQTLADISQPTLYWNNHDMARLATRIAKTSTQAKSLAMLMYLQRGIPIIYYGEELGLKNLHFTSVDQFEDQTVAPWIKEAQKAGISRDAAFAMVSDTHKLPARGPMPWNDTENNGFTSAKPWLNGISQDDVTVANEVNSDNSMFTFYKNMLNLKKEKLFQDGTYYMISTGKDSYVYQRDLGNESAIVAVSLSNKKISIDLPEEYIKELLKAGEYQLTNGKLTLMPYAGVVLKKEN

SEQ ID NO: 22338 - protein, 472 aa, Escherichia coli
MPLNKKDTQGKGVKNASTVSEDTASNQEPTLHRGLHNRHIQLIALGGAIGTGLFLGIGPAIQMAGPAVLLGYGVAGIIAFLIMRQLGEMVVEEPVSGSFAHFAYKYWGPFAGFLSGWNYWVMFVLVGMAELTAAGIYMQYWFPDVPTWIWAAAFFIIINAVNLVNVRLYGETEFWFALIKVLAIIGMIGFGLWLLFSGHGGEKASINNLWRYGGFFATGWNGLILSLAVIMFSFGGLELIGITAAEARDPEKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSRRGVPINSLMLSGAITSLVVLINYLLPQKAFGLLMALVVATLLLNWIMICLAHLRFRAAMRRQGRETQFKALLYPFGNYLCIAFLGMILLLMCTMDDMRLSAILLPVWIVFLFVAFKTLRRKVN

SEQ ID NO: 22339 - protein, 424 aa, Burkholderia xenovorans
MPLRISKPDTPPSRGRRRWLGRLAAGGLAVSHAAAASELLRPLDIAPSSRVPGAPILEHPYGLPSPHEADVVRRSARAWPLPGAASSMTPLADLHGTLTPNGLVYERHHGGVPDIDPDQHRLAIHGLVRTPKLFTLDDLLRLPSESRIHFLECSGNTGNEWNGPSGMPLQLTHGLLSCCEWTGVRLSTLLEEVGGVPVSGNAGGGWLLAEGADAAAMTRSLPLDRILDRALVVYAQNGERLRPENGYPLRLIVPGFEGNTNVKWLRRLKVVDAPLQTREETSKYTSLLANGKARQFAFEMDAKSVITRPSPGHRLTTQGYYPITGLAWSGRGTIRKVEVSTDGGATWRAARLVGAIHDRALTRFEADWRWDGGAAAILSRATDSTGYLQPTRAELVAARGLNSQYHYNAIQQWRVDESGEVRNA

SEQ ID NO: 22340 - protein, 290 aa, Pseudomonas syringae
MSQETAYIFDATAANFDQLVIDKSFDQPVLVDFWAEWCAPCKVLMPLLQQITESYQGELLLAKVNCDIEQDIVARFGIRSLPTVVLFKDGQPVDGFAGAQPESEIRKILDQHVVMPPPPAADPLKQAQALFAESRFAEAEAQLKVLLGEDNTNGAALILYARCLAERGELSEAKAVLDAVTGDAHKAELAGAKAQLTFLAQAATLPDAAELKSRLAQNPQDDEAALQLAIQQLSRQQYEAALDGLLKLFIRNRNYAEGLPHKTLLQVFDLLGNEHPLVTAYRRKLFAALY

SEQ ID NO: 22341 - protein, 113 aa, Arabidopsis thaliana
  misc_feature (49)..(49): Xaa can be any naturally occurring amino acid
  misc_feature (93)..(93): Xaa can be any naturally occurring amino acid
NDPRRRGGNHSGGEYIFSHHHPHEAGGVNLGKGQTPTAQATKVAPFTGXKTTANYPGTRTDNNDITSITSNGGRVSSTKERPPIGKKKIETLXYLTEQSDVETAKEGDNQSRN

SEQ ID NO: 22342 - protein, 420 aa, Rickettsia sibirica
MNIFNNNLHETDKEINEIIKHEKLRQSSVIALIASENFVSPAVLEAQGALLTNKYAEGYPSKRFYNGCEEVDKAENLAIERVKKLFNCKYANVQPHSGSQANQAVYLALLQPGDTVLGMSLDSGGHLTHGAAPNMSGKWFNAVSYSVNKETYLIDYDEIERLADLHKPKLLIAGFSAYPRNIDFAKFREIVDKVGAYFMADIAHIAGLVATGEHQSPIPYAHAVTSTTHKTLRGPRGGLILSNDEAIGHKINSALFPGLQGGPLMHIIAAKAVAFLENLQPEYKSYIQQVISNAKALASSLQERGYDILTGGTDNHIVLVDLRKDGITGKLAANSLDRAGIMCNKNAIPFDETSPFITSGIRLGTPACTTRGFKEKDFVLVGHMVADILDGLKNNEDNSALEQKVLNEVTKLIELFPFYG

SEQ ID NO: 22343 - protein, 423 aa, Zea mays
MGKHEFLTPKAIANRIKAKGLQKLRWYCQMCQKQCRDENGFKCHCMSESHQRQMQVFGMAPDRVVEGFSEEFLESFLSLIRRAHRHSRVAATVVYNEYIADRHHVHMNSTRWATLTEFVKLLGREGYCKVEDTPKGWFMTYIDRDSEQAVKDRLKRKRIKSDMAEDERQERMIARQIERAHKSLAKPNDGDAAEGEPESGGEEEYSGSDDDGEELEDVSKEANKATGKIAIALQTAVRGPKVNPFEDKPEVKFRFDEEGDLGTGEEKDELAKKKGKDVKAAEARRSALEELMKEEEMAKERSNRKDYWLCPGIVVKVMSKSLAEKGYYKQKGVVRKVMDKYVGEIEMLESKHVLRVDQDELETVIPQIGGLLRILNGAYRGSNARLLSVDTEKFCAKVQVEKGLYDGKVLRAVEYEDICKISS

SEQ ID NO: 22344 - protein, 711 aa, Unknown
  Silicibacter sp. TM1040
MFNVTTKTMQWGEETLTLETGKVARQADGTVIATLGETSVMANVTYAREQKPGQDFFPLTVHYQEKYYAAGKIPGGFFKREARPTEKETLTARLIDRPIRPLFVPGFKNEVLVMCTVLSHDLVNDPDIVAMIAASAALTISGVPFMGPIAGARVGYEDGEYILNPTVDDMQDLRLNPEQRLDLVVAGTKDAVMMVESEAYELTEEEMLGAVTFAHEQIQPVIDLIVSLAEETAKEPFDFTPPDYSDLYAAVKAAGEEKMRAAYAISDKQERVAAVGAAKEEIIASLTEEQQEDGNLGSALKKLESVVLRGDVVKNGRRIDGRALDQVRAIECQTGLLPRTHGSALFTRGETQGLVVTTLGTGDDEQFIDALHGNFKSNFLLHYNFPPYSVGEVGRVGSPGRREIGHGKLAWRALQAVLPAPTDFPYTIRVVSEITESNGSSSMASVCGGSLSMMDAGVPLKAPVAGVAMGLVLEEDGSYGILTDILGDEDHLGDMDFKVAGTEAGITSLQMDIKVAGITPEIMKNALAQAKAGRLHILGEMAKSLTEASEFSQHAPRIETMQVPTDKIREVIGSGGKVIREIVEVSGAKVDINDDGVIKIASANGEAIQKAYDMIHAIVAEPEEGAVYTGKVVKIVDFGAFVNFFGKRDGLVHVSQIENRRLNHPSDVLKEGQEVKVKLLGFDDRGKVRLSMKVVDQETGEEIVAEKKEAE

SEQ ID NO: 22345 - protein, 321 aa, Bacillus cereus
MVVNEKVELATFAGGCFWCMVSPFEEMEGIIKVVSGYTGGHKENPTYKEVCSETTGHYEAVQITFDANKMPYEELLNIYWRQIDPTDVGGQFHDRGQSYETVIFYHNEEQHKKAEASKEELAKSERFSKPIATKILPAATFYPAEEYHQGYHKKNTFRYELYRKGSGRDAFIKQHWPKDNAHLKEKLNEMQFYVTQENGTEPPFRNEYWNHKEEGLYVDIVSGEPLFTSIDKFDSGCGWPSFTKPVMSASVKEKMDVSHNMTRTEVRSKEGDSHLGHVFPDGPGPNGLRYCINSAALRFIPKEELEKEGYGDFLMLFGNKK

SEQ ID NO: 22346 - protein, 297 aa, Streptomyces lividans
MDLTGRRAVVTGGASGLGAETVRALAAAGAEVTIATRHPQSAEPLVQEAAAAGAGRVHAEALDLSDVASVDSFARAWRGPLDILVANAGIMALPTRTLTPYGWEMQLATNYLGHFALATGLHAALRDAGSARIVVVSSGAHLGTPFDFEDPHFARRPYDPWAAYGNSKTADVLFTVGARRWAADGITANALNPGYILTRLQRHVDDETMRAFGVMDDQGNVKPLPYYKTPEQGAATSVLLAASPLLNGVTGRYFEDNQEARTVEDGDVQPGGVAAHALDPEAADRLWEYGADTLSAG

SEQ ID NO: 22347 - protein, 356 aa, Lotus japonicus
MSLLSDLINLNLSETTDKIIAEYIWIGGSGLDMRSKARTLPGPVSDPSQLPKWNYDGSSTGQAPGEDSEVILYPQAIFRDPFRRGSNILVICDAYTPAGEPIPTNKRHAAAKVFSHPDVVAEVPWYGIEQEYTLLQKEVNWPVGWPIGGFPGPQGPYYCGIGADKAFGRDIVDAHYKACLYAGVNISGINGEVMPGQWEFQVGPSVGISAGDEVWVARYILERITEIAGVVLSFDPKPIKGDWNGAGAHTNYSTKTMREDGGYEVIKKAIDKLGLRHKEHIAAYGEGNERRLTGRHETADINTFLWGVANRGASIRVGRDTEKEGKGYFEDRRPASNMDPYVVTSMIADTTILWKP

SEQ ID NO: 22348 - protein, 156 aa, Musa acuminata
PLLLSPLASTSSITQNTRSLFSPMAVAAIAEAPFHVLAVDDSVLDRKLIERLLKTSSFQVTTVDSGTKALQFLGLHAEDASISSVHADQLDVEVNVNLIITDYCMPGMTGYDLLKKIKESSSFRDIPVVIMSSENIPSRINRCLEEGANEFFLKPV

SEQ ID NO: 22349 - protein, 411 aa, Zea mays
MNALAATSRNFKQAAKLLGLDSKLEKSLLIPFREIKVECTIPKDDGTLASYVGFRVQHDNARGPMKGGIRYHHEVDPDEVNALAQLMTWKTAVANIPYGGAKGGIGCSPGDLSISELERLTRVFTQKIHDLIGIHTDVPAPDMGTNSQTMAWILDEYSKFHGYSPAVVTGKPVDLGGSLGRDAATGRGVLFATEALLAEHGKGIAGQRFVIQGFGNVGSWAAQLISEAGGKVIAISDVTGAVKNVDGLDIAQLVKHSAENKGIKGFKGGDAIAPDSLLTEECDVLIPAALGGVINKDNANDIKAKYIIEAANHPTDPEADEILSKKGVLILPDILANSGGVTVSYFEWVQNIQGFMWDEEKVNAELRTYITRAFGNVKQMCRSHSCDLRMGAFTLGVNRVARATVLRGWEA

SEQ ID NO: 22350 - protein, 463 aa, Pseudomonas putida
MNYLPLFHKLQGGRVLVVGGGEIALRKARLLADAGGVLRVVAPDVDGQLAALAREGGGEVLVRGYQAADLVGCRLVIAATDDPGLNAQVSADAQALSLPVNVVDAPALCTVIFPAIVDRSPLVIAVSSGGDAPVLARLIRAKLEAWIPSAYGELAGLAARFRHKVKSLYPDVNQRRGFWETVFQGPIAERQLAGQGAEAERLLQAMVEGAPVQQGGEVYLVGAGPGDPDLLTFRALRLMQQADVVLYDRLVAPAIIEMCRRDAERIYVGKRRAEHAVPQDQINRLLVDLAQQGKRVLRLKGGDPFIFGRGGEEIEELAEHGIPFQVVPGITAASGCSAYGGIPLTHRDYAQSVRFVTGHLKDGTSNLPWNDLVAPAQTLVFYMGLVGLPTICAELIRHGRAASTPAALVQQGTTRNQRVFTGTLADLPGLVAQHEVHAPTLVIVGEVVQLREKLAWFEGSQNS

SEQ ID NO: 22351 - protein, 313 aa, Coxiella burnetii
MTDITMRQLLEAGVHFGHQTRYWNPKMAPYIYGARQKIHIINLEETLPAFRDALKFVKEVASKRGKVLFVGTKFAAREIVKEEATRCGMPYVDYRWLGGMLTNYKTIRQSIKRLKELEERLENEENLVGMTKKEILNLMREKEKLSANLAGIKNMGSLPDVLFVIDVEHERNAVQEANRLGITVLGIVDTNASPDNIDHVIPGNDDAIRAIRLYCKAIADTIIDARSVLELQKDEEAKEEKTKAKTTAKKVVTKKAKVAEKAQAAAEKKSEKPTTEKRPTKEAAETKETSEEPKTKEVQQPIEASKAEAEEGK

SEQ ID NO: 22352 - protein, 153 aa, Brassica napus
MAETARRQGGGRPLPPPPPRGVNQQPPRPKTEPVDREKTCPLLLRVFTKTGGHHTKEDYAVRGKEPKDEVQIYTWKDANLRELTDLVKEVSVAARRRDARLSFAFVYPDKNGRFIVRQVGQTMSYPNRKQPDDSKTLADLHFEIGDYLDVAIY

SEQ ID NO: 22353 - protein, 334 aa, Cryptococcus neoformans
MARKITVAAAQVGAVHKDSQRPETLSRLISLLEQASQKGVEVLVYPETTFTTFFPRWKGLDDDREELDRWFEHGDITANPNIAPLISRAKDLGIDIVIGYGEKTDDSHYYNTCSYIHAGKEISKYRKVHLPGNKEPYPDPEFIDQLEKRYFEPGDYGFKAFRVPDLAVTPEDGEAIAGMMICNDRRWAESWRCLGLQGVELVCLGYNTSTWAPGLFGHSKDADPEVIKAQSEFQHLLVMQAHSYTNATFSIAAARAGFDDGKFGLIGCSCIVHPEGHIIAQSKTMDDELVIATIDLDDAKIGKQKVFNFGLHRQPHQYSIITQQAGVTAPPRLN

SEQ ID NO: 22354 - protein, 286 aa, Salmonella enterica
MAENTMWHETLHDQFGQYFAVDNVLYHEKTDHQDLIIFENAAFGRVMALDGVVQTTERDEFIYHEMMTHVPLLAHGHAKHVLIIGGGDGAMLREVTRHKNVETITMVEIDAGVVSFCRQYLPNHNAGSYDDPRFTLVIDDGVNFVNQTHQTFDVIISDCTDPIGPGESLFTSAFYEGCKRCLNPGGIFVAQNGVCFLQQDEALDSHRKLSHYFSDVGFYQAAIPTYYGGIMTFAWATDNDALRHLSSEIIQARFHAAGLKCRYYNSAIHAAAFALPQYLHDALSAQ

SEQ ID NO: 22355 - protein, 194 aa, Brassica napus
  misc_feature (100)..(100): Xaa can be any naturally occurring amino acid
MGEQPDPFSASTLPDFISSQKIGRPVTLEGQSNRGHPYSGLKKRGQSSRSWVKIDENGNSTVLELDKATIMKRCSLPSRDLRLLDPLFIYPSSILGRERXIVVSLEKIRCIITAEEVILMNARDASVVQYQSELCKRLQSNQNLNLKDDLPFEFKALELVLELSCLSLDAQVNELEMEVYPVLDELATNISTLN

SEQ ID NO: 22356 - protein, 123 aa, Triticum aestivum
  misc_feature (12)..(12): Xaa can be any naturally occurring amino acid
NDVLAATACQFXNFVAIVDPPRAGLHPTVIKVLRTHPRIRRLVYISCNPDTLVANAIELCTPSTEHREKNKGHRGWRNMSSAGLARQRTKSMPNSEPFVPKRAMAVDLFPHTSHCEMVMLFER

SEQ ID NO: 22357 - protein, 179 aa, Methylobacillus flagellatus
MAESVAIFAGGCFWCLEPVFSQLQGVRQVVSGYIGGNVVDPTYEEVCTGATGHAEAVQIIFDPLEIDYEVLLEIFFLAHDPTTLNRQGHDVGTQYRSAVFCQSQDQLVAVHRLLERFARENTFGAPVVTEVSTNGKFYAAEEYHQQYYARNSSQPYCQAVAAPKIAKIREKYADRIKLP

SEQ ID NO: 22358 - protein, 321 aa, Oryza sativa
MGETIAKDVTELIGNTPLVYLNRVTDGCVGRVAAKLESMEPCSSVKDRIGYSMITDAEEKGLITPGKSVLIEPTSGNTGIGLAFMAAAKGYRLVLTMPASMSMERRIILKAFGAELILTDPLLGMKGAVQKAEELAAKTNNSFILQQFENPANPKIHYETTGPEIWKGTGGKVDGLVSGIGTGGTITGTGRYLREQNPDIKIYGVEPVESAVLSGGKPGPHKIQGIGAGFVPGVLDVDLINETVQVSSDEAIEMAKALALKEGLLVGISSGAAAAAAVRLAQRPENEGKLFVVVFPSFGERYLSSVLFQSIKKEAENMVVE

SEQ ID NO: 22359 - protein, 178 aa, Salmonella enterica
MKHTVEVMIPEAEIKARIAELGRQITERYKDSDSEMVLVGLLRGSFMFMADLCREVQVPHEVDFMTASSYGSGMSTTRDVKILKDLDEDIRGKDVLIVEDIIDSGNTLSKVREILGLREPKSLAICTLLDKPSRREVDVPVEFVGFSIPDEFVVGYGIDYAQRYRHLPYVGKVVLLDE

SEQ ID NO: 22360 - protein, 374 aa, Zea mays
MAIPLVLVVLPLGLLFLLSGLIVNTIQAILFVTIRPFSKSLYRRINRFLAELLWLQLVWVVDWWAGVKVQLHADEETYRSMGKEHALVISNHRSDIDWLIGWILAQRSGCLGSTLAVMKKSSKFLPVIGWSMWFAEYLFLERSWAKDEKTLKWGLQRLKDFPRPFWLALFVEGTRFTPAKLLAAQEYAASQGLPAPRNVLIPRTKGFVSAVSIMRDFVPAIYDTTVIVPKDSPQPTMLRILKGQSSVIHVRMKRHAMSEMPKSDDDVSKWCKDIFVAKDALLDKHLATGTFDEEIRPIGRPVKSLLVTLFWSCLLLFGAIEFFKWTQLLSTWRGVAFTAAGMALVTGLMHVFIMFSQAERSSSAKAARNRVKKE

SEQ ID NO: 22361 - protein, 239 aa, Oryza sativa
MAGRGGGGGGGELQLLGTWYSPYAMRAKIALGLKGLSYEYIEQDLFGKSELLLKSNPVHKKVPVLIHAGRPVCESRVVLEYVDEAWPGAAPPLLPADPHGRAAARFWATYFDSTFFPPWRALMRATTAEQRAEAFMNAVPQVEVLERAFVECSKGKAFFGGDAVGLVDVVVGGFVVWFKVVDEVAGSSLLDEAKFPGLAAWAERFLAVDAVREAMPDAGKLLEHYKGFLAKLASPAGST

SEQ ID NO: 22362 - protein, 237 aa, Oryza sativa
MAGRGGGGELRLLGTWSSPWVIRVRVALGMKGLSYEYTEEDLSSKSDLLLRSNPVHEKVPVLIHGGRPVCESLVVLEYIDETWGATGTPQLLPADPYDRATARFWTNYVNDTFFPSWKVLFRSTAAEQRAEAFKNVVPRVEALERAFGECSKGKAFFGGDDAGLVDVALGSHLVWIKVVDEVAGANLLDEAKFPGLAAWAERFLAVDAVRQVMPDAGDVLKQYKGFLAKWTAGAGSS

SEQ ID NO: 22363 - protein, 124 aa, Oryza sativa
MVPKAEKKPAEKKPAEEKGGTGDKKGKKKAKKSVETYKIYIFKVLKQVHPDIGISSKAMSIMNSFVNDIFEKLEQEAARLARYNKKPTITSREIQTSVRLVLPGELAKHAVSEGTKAVTKFTSS

SEQ ID NO: 22364 - protein, 342 aa, Streptomyces coelicolor
MKVGVLTGGGDCPGLNAVIRAVVRKGVQEYGYDFTGFRDGWRGPLEGDTVPLDIPAVRGILPRGGTVLGSSRTNPLKQRDGIRRIKDNLAALGVEALITIGGEDTLGVATRLADEYGVPCVGVPKTIDNDLSATDYTFGFDTAVGIATEAIDRLHTTAESHMRVLVVEVMGRHAGWIALHSGLAGGANVILIPEQRFDVEQVCSWVTSRFRASYAPIVVVAEGAMPRDGDMVLKDESLDSYGHVRLSGVGEWLAKQIEKRTGNEARTTVLGHVQRGGTPSAFDRWLATRFGLHAVDCVHDGDFGKMVALRGTDIVRVPIAEATARLKTVDPALYEEVGVFFG

SEQ ID NO: 22365 - protein, 493 aa, Ostreococcus tauri
MRVARAPVTRPPAFGARAYASRARSKTASNATPRPDYDATTLFSPSVREIFLPEHIGEMYNLPKRPSPFARGGALWQFGLGQRFIDNGDSVSLNPLRTTGSSGEAASEEDVAFSDERAVRAGAREVIYYDPKKVRAAIVTCGGLCPGLNDVVRSITLTLEDYGVEDIVGIKYGFRGFFADPENALEAPMKLTSAIVDDIQITGGSMLGSSRGGADMPAIVQKIEEMELDFLFVIGGNGSHAGALAIDKLCREKNLTTSVIGVPKTIDNDILLLDRTFGFQTAVDEAVKAIRSANIEARSADNGVGLVRLMGRQSGFIAMHAALASGNTDVCLIPEIDCPLEGSGGVLAHIVRVIERQNHAVIVVAEGAGQEQLGMIGETDASGNPVLQNFAKYLQQKLKEAKPNVDIKYIDPTYMVRACRTNASDAVYCSILGQNAVHAAFAGLSAVTVGMCSGHYVYLPIPPVISAPRTVDPEGRMFERLRFAIGQPTFSKS

SEQ ID NO: 22366 - protein, 209 aa, Vibrio vulnificus
MLNKQIMVDADNALAGRQEAMAVEPIHFVNGSDITASATQGQQEILFGMGCFWGAERLFWQLDGVVSTSVGYSGGFTLNPTYQEVCSGQTGHTEVVRVIFDPQVLPLEQLLEKFWERHDPTQGMRQGNDLGTQYRSAIYTFSDQQLDIALASQQAYQAALANQQHNTITTEIRPAGPYFYAETYHQQYLAKNPEGYCGLGGTGVCFPPA

SEQ ID NO: 22367 - protein, 1063 aa, Coccidioides immitis
MVAPFSVVRLGARQLVSSSLRNASLRPSRVSPLTACRQCLQLVRYQQTQSHRRAVHLSSSGDTENLLPRDLHSPLDTFPRRHIGPGADATEQMLAVLDPPAKNLDEFVKQVLPADILTAKNLSVSEPQAAAELRKDGVLGGLGEKDMVKLLESYKNKIDATGKSFIGCGYYSTVVPPVIQRNVLENPAWYTSYTPYQAEISQGRLESLLNFQTLTADLTGLPVGNASVLDEGTAAAEAMTMSWATLPMNKQKQDGKVFVVSHLCHPQTIAVMRSRAEGFGIRLEIGDIMADNFKLVKDQGDRLIGVLAQYPDTEGGVFDFQSLSDSIHAQGGSFCVATDLLALTVLKAPGEFGADIAFGNAQRLGVPMGFGGPHAAFFACTDKYKRKIPGRIVGVSKDRLGNRALRLALQTREQHIRREKATSNICTAQALLANMTAMYAVYHGPQGLKAIAERIMALTALLRTKLQLLGFNVPVRGNASFDTLVVETKSSAEADAIVGSALSAGLYLRRVSPTKVGISLDEAVGVDELKELLAVFANLSDKKGAETLDLSKDIPSVDVPVDIRRTSSYLTHPVFNTHHSETEMLRYMQHLVSKDLSLAHSMIPLGSCTMKLNATTEMVPVTWPEFSTMHPFTPAQKVEGYVNMVEDLEKQLADITGMAEVTIQPNSGAQGEFAGLRVIKMYQDSLGEPGKRNICLIPVSAHGTNPASAAMAGMKVVPVKCDTGTGNLDVADLRAKCQKHKDELGAIMITYPSTFGVYEPTIKEVCDIVHEYGGQVYMDGANMNAQIGLCSPGEIGADVCHLNLHKTFCIPHGGGGPGVGPIGVAEHLRPFLPSHPLSEPLLAKRPASVDSPPISAAPYGSASILPITFSYINMMGSKGLTHATKITLLNANYLLSRLKQHYPILYTNENGRCAHEFILDVRKFKATAGIEAIDIAKRLQDYGFHAPTMSWPVANTLMIEPTESEPKGELDRFCDALVSIREEIAAIERGEQPKDKNVLKMAPHTQRDLLTGDWDRPYTREKAAYPLPWLLEKKFWPTVTRVDDAFGDQNLFCTCGPVEDTSE

SEQ ID NO: 22368 - protein, 343 aa, Unknown
  Synechococcus sp. CC9311
MPMLAIKFLENNSSLMSRVYADNSQAIGNTPLVRLNHVTKGCKATVLAKIEGRNPAYSVKCRIGANMIWDAEKRGVLSEGKTIVEPTSGNTGIALAFTAAARGYKLILTMPESMSIERRRVMAVLGAELILTEAAKGMPGAIAKAKEIADSDPSKYFMPGQFDNPANPEIHEKTTGPEIWDDCDGAIDVLVAGVGTGGTITGVSRYIKQEKGKAITSVAVEPSHSPVITQTMNGEALKPGPHKIQGIGAGFIPNNLDLSVVDRVEQVTNEESIEMALRLAQEEGLLVGISCGAATAAAIRLAQQDEFAGKTIVVVLPDLAERYLSSVMFADVPTGIIEQPVPV

SEQ ID NO: 22369 - protein, 710 aa, Bacillus subtilis
MTERLLRYFRDKQQDVQSEKTYDTQCPFCSMQCKMQLVEQTIVTRKKYTAIGIDNPTTQGRLCIKGMNAHQHALNSSRITRPLLKKNGEFMPVSWEEALNHIKDQVTMIQTEHGHDAMAVYGSASITNEEAYLLGKFARVGLQTKYIDYNGRLCMSAAATAANQTFGADRGLTNPLSDIPHTRVIILAGTNIAECQPTIMPYFEKAKENGAYFIAIDPRETATTKIADLHLKIKPGTDAALANGLVKIIIDEQLINEDFIQSRTNGFEELKQHTDSLDLNDIAEQTSVSLVDIRKAAVKFAKETSGMLFTARGIEQQTDGTAAVKGFLNMVLITGKIGKPYSGYGAITGQGNGQGAREHGQKADQLPGYRSIENEEHRAHIAKVWGIHQDDLPRKGVSAYEVMEKINDGDIKGLFLMCSNPAVSSPNANLVKKALRRLTFFVAIDLFISETAKYADVILPASSYLEDEGTMTNVEGRVTLREASRPCPGEAKHDWQIICDLASALGKGRYFSYTSAEDIFNELREASRGGIADYSGISYGRLRREGGIHWPCPESDHPGTGRLFTESFAHPDQKAALSVIPNEPPVPKEKPTADYPLYLTTGRVMSHYLTGVQTRKSAALAARHFESFMEIHPQTAATYNIEDRVLVKIESPRGSITVRSKLSEQIRKDTVFVPIHWADAQNVNDLIGEALDPACKMPGFKVCAVRIIPI

SEQ ID NO: 22370 - protein, 219 aa, Triticum aestivum
  misc_feature (126)..(126): Xaa can be any naturally occurring amino acid
  misc_feature (157)..(157): Xaa can be any naturally occurring amino acid
MGRRPARCYRQIKNKPYPKSRYCRGVPDPKIRIYDVGMKKKGVDEFPSCVHLVSWEKENVSSEALEAARIACNKYMTKNAGKDAFHLRVRVHTYHVLRINKMLSCAGADRLQTGMRGAFGKPLGTXCARVDIGQVLLSVRCKESNAVHADEALRRAXKFKFPGRQKIIRSRKWGFTKFNKADYIKYKSEGRIVPDGVNAKLLGVHGPIAKRAPGQAILA

SEQ ID NO: 22371 - protein, 770 aa, Bacillus subtilis
MKKQRLVLAGNGMAGIRCIEEVLKLNRHMFEIVIFGSEPHPNYNRILLSSVLQGEASLDDITLNSKDWYDKHGITLYTGETVIQIDTDQQQVITDRKRTLSYDKLIVATGSSPHILPIPGADKKGVYGFRTIEDCQALMNMAQHFQKAAVIGAGLLGLEAAVGLQHLGMDVSVIHHSAGIMQKQLDQTAARLLQTELEQKGLTFLLEKDTVSISGATKADRIHFKDGSSLKADLIVMAAGVKPNIELAVSAGIKVNRGIIVNDFMQTSEPNIYAVGECAEHNGTVYGLVAPLYEQGKALASHICGVPCEEYQGSAPSAALKIAGIDVWSAGKIQEDERTTSIKIYDEQAGVYKKALFVDDKLRVILFGDTRDKQRLLDSLLKQRDISIAKKQIIEPETSGPLFESMPSSETICQCNTVTKGAIEDAVHTNSLTTVEEVKHCTKATGSCGGCKPLVEDLLRYMTNSEYTKPASTPSFCSCTDFTEDDIIAELQRRPFTNPAEVMNQLDWKTKNGCSTCVPAIQYYLEMLYPGFVQPEPATEETCILIPQMYGGRTNAEQLRTIANIIEAYSIPDVSITHGQRLKLSGIKPADLPNMKKDLKMPVYTNEHRHALQSIKACTCGQNRSIQQLAAQIERQLEMLPLPAPISISLSCETDCTEAALQDVGAIRTQAGWDIHIGGVRGTHARSGALFCVTENEDSTAGMIKGLIQYYRETDHYLEGVHQWIDRLGIVHIREVLFEEDLRAQLLESLQTDLSLIQNPTVETGAYKKG

SEQ ID NO: 22372 - protein, 545 aa, Xanthomonas campestris
MTARRRAMALDRYPPAHAIGTASRRAARQATATQRDRFHPLPGRKSPQHGARIRLQSSTSSRFGHRHTMQTPSPSQTFPLDRSDAVCIIGAGPGGLSAARALKAQGLDYDQFERHGDLGGIWDVSNPGSPIYDSTHFISSRDLSAFIGHPMPRQYPDYPSHRQILAYLRSFAETFGLREKIQFDTAVLRIDKQADGRWQVTLADGSQRLYAAVICASGVNWDPSMPQLPGHFDGEIRHSVSFRHGDEFRGKRVLVLGAGNSGADIACEAAMHAQRAFLSVRRGYHFIPKHLMGIPVDQIAETGPHLPLWLARPIFSALLRLVNGDLARLGLPKPDHRLFESHPLLNAQLLHHLQHGNIAVKPDIDRLDGRHVVFKDGSREQIDLLLCATGYRWSCPYASDYFLWNGGRPQMYLSMFNRTHRNLFGIGYLETNSSAYKLFDTQAQMIASYLTAQRRDPASARRFDALIENDTPDLSGGIRFVASQRHAVYIEAHAFKRYLHQLRRRLGWGELGEHMYDALKLDAGGDPRMGTTATARLADSEVAHG

SEQ ID NO: 22373 - protein, 325 aa, Xanthomonas campestris
MPLFPLFANLQGRAVLVIGGGEVATRKVLALLKAQAHIRLYAHALSPELAQLMQAGRFEQMTGEFDPAWIDTVWLVVAATDDVDLNQRVAAAAGARQRLVNVVDDAELSTYQVPAIVDRDPLVIAISSAGAAPMLARRLRERLERELHASVGTLAALFARHRERIRQQLPDMNRRRRWFDQVIDGKVPQLLQAGDTVAAEAAFAAALDAVDSVPARGSVQWVGAGPGDPGLLTLNALRALNLADVLLLASDVPAAVVELARRDAQRRAWPETPGAQQAAVVELVGAGLQVVVLRMGSGDAIPAELDAALHAQGILSVRVPGLPLR

SEQ ID NO: 22374 - protein, 585 aa, Oryza sativa
MESNGGGGGSPKEAAVVVPSSGDATLGGHLARRLVQVGVSDVFAVPGDFNLTLLDYLIAEPGLSVVGCCNELNAGYAADGYARARGVGACAVTFTVGGLSVLNAIGGAYSENLPLICIVGGPNSNDYGTNRILHHTIGLPDFSQELRCFQPITCYQAVVNNLDDAHDQIDTAISTAIRESKPVYISVSCNLAAVPHPTFSRDPVPYFLSPRLSNQASLHAALDATLDFLDKAVKPVLVAGPKLAVAKAGEGFVDLADASRYGFAVMPSAKGLVPETLPAFIGTYWGAVSTAFCAEIVESADAYLFAGPIFNDYSSVGYSCLLKKEKAVVVQPDRVTVGNGPAFGCVMMRDFLSELAKRVRKNTTAFDNYKRIFVPDRQLRSARPGEPLRVNVLFKHIQGMIGGDEAVVAETGDSWFNCQKLRLPEGCGYEFQMQYGSIGWSVGALLGYAQAVQKRVVACIGDGSFQVTAQDVSTMLRCGQKSIIFLINNGGYTIEVEIHDGPYNVIKNWDYVGLVNAIHNGEGRCWATRVRCEEELEAAIATATGDKADSLCFIEVVAHKDDTSKELLDWGSRVSAANSRPPNPQ

SEQ ID NO: 22375 - protein, 615 aa, Litchi chinensis
MGHSSQTWFNKSKSFAPSWALSCRIPGPMFQPLYSSRIFLNPVRRAGLFRALLLLNTVIAQGADPVESTSESILIKNFNSLYDYNNSTTFDPTSKSLILTQSSSSTLSYEPDSDSEPDFATVVASQRFFFTSPGSSNSIIESSPSIATLESSDTSVSMISHGVNQSLNNFSDRSLLKSWKSPSVKDSVAVPTYSPDPYLDFRQSMQEMVEARDLVDVRSNLDYLHELLLCYLALNPKTTLVELGGTLGLEECALWMPSRSGSSLQLSHTLRHQITVGSTVSINLPVVNQVFSSNRAIIIPHTSPLARIRPLAGRYVPPEVAAVRVPLLHLSNFQINDWPELSAKSYAIMVLMLPSDSARKWHVHELELVEVVADQVAVALSHAAILEESMRARDLVKEQNVALDLARREAEMAIRARNDFLAVMNHEMRTPMNAIIALSSLLLETGLTPEQRLMVETVLKSSNLLATLINDVLDLSKLEDGSLELEIKAFNLHAVFKEVMSFIKPIAAIKRLSVSVMLAPDLPLCAIGDEKRLMQTILNISGNAVRFIVHYTCGGCLQSPYFCGRERICFRSIHLCCFQHQCSGGCQVPQQTIPSVQNSNRFWRLSHQGQVVPFV

SEQ ID NO: 22376 - protein, 817 aa, Xanthomonas campestris
MKQPRLVVIGNGMAGIRTVEELLKLMPGMYHITVFGAEPHPNYNRILLSPVLAGEQEFDDIVLNPLQWYQDNGIHLHLNKEVTRIDRVRRRVIAADGTQAEYDRLLIATGSVPFVLPIPGNDLKGVIGYRDIQDTRTMIDTARTKQHAVVIGGGLLGLEAANGLKLRGMEVTVVHLAGWLLERQLDPVAGNLLQQALRARGLHFKLSTATSALLGNAQGEVIGVKFADGSEIPADLVVMAAGIRPNTRLAEEAGIHCSRGIVVNDSLQSFDPRVYAVGECANHRGIAYGLVAPLFEQAKVCANHLAQFGIGIYRGSVASTKLKVTGIDLFSAGDFMGGDGCEEIVLSDPAGGVYKKLVIRDDVLVGACLYGDTSDGGWYFKLLKDGTPIQAQRDQLIFGESALGDAGTGGQDRASAMADSDEVCGCNGVCKGTIVKAISEQGLFTVDEVKKHTKAASSCGSCTGLVEQILMNCLGSNFQETPKTKAVCSCTDLSHGEVRRAIREHKLLTHAQAYAFMEWRTPNGCATCRPAINYYMLSTWPHEAIDDPQSRFINERAHANIQKDGTFSVIPQMKGGVTNASELRRIADVADKYAVPMVKVTGGQRIDLLGVKKEDLVDVWRDLGMPSGHAYGKSIRTVKTCVGSEFCRFGTQNSTQMGIDLETMLANMWSPHKVKLAVSGCPRNCAESGIKDVGIIAVDSGWEIHIGGNGGIKTEVARFLVKVATADEVREYTGAFLQLYREQAYYLDRTVHYIARVGLDYIRAQVVDDAANRRALYERLLYSLEGLVDPWKARIAGERRQEYQPLRVAAPAATVEQ

SEQ ID NO: 22377 - protein, 537 aa, Oryza sativa
MDGGLREVSLSVVFSVWCLLFLLRSQFLHSQTDPSDFYDDVEDGMRENYCKVMPLEAYIFPTEYNASAAAPTCQPSLHPPDQPQQETDHRSLEPFNNTTGGKSSAEAAALDELDEFRSRILQGKAENGRVPDGATPAAHRLEPSGAEYNYAAASKGAKVLAHNREAKGAANILGGDKDRYLRNPCSADDKFVDVELSEETLVRTIGLANLEHYSSNFRDFELYGSPSYPAPAEEWELLGRFTADNAKHAQRFVLPDPRWTRYLRLRLATHYGSGFYCILSYLEVYGIDAVEQMLQEIISGSGADTDASAAAKAEEGGDGGTLRNDTAQVNARLDGVGGGGGSAAGRNDSAGDGAGAKNNGSRMTVAGDGKPAAAGRFHGDAVLKIMMQKMRSLELGLSTLEDYTKALNHRYGAKLPDLHTGLSQTTMALDRMKADVRDLVEWKGNVAKDLGELKEWRSNVEEMRSIQETMQNKELAVLSISLFFACLALFKLACDRVLFLFTRKGAAAAERMCGASKGWILVLASSSFTTFLVLLYN

SEQ ID NO: 22378 - protein, 602 aa, Oryza sativa
MELALVGNPSNGVAKPSCNSVGSLPVVSSNAVIHPPVTSAARATLGRHLARRLVQIGATDVFAVPGDFNLTLLDYLIAEPGLKLIACCNELNAGYAADGYARALVGAFVTFTVGGLSVLNAIAGAYSENLPVICIVGGPNSNDYGTNRILHHTIGLPDFSQELRCFQTITCYQAVINNLDDAHEQIDTAIATALRESKPVYISVGCNLAGLSHPTFSREPVPLFISPRLSNKANLEYAVEAAADFLNKAVKPVMVGGPKIRVAKAKKAFAIAESSGYPFAVMPSAKGLVPEHHPRFIGTYWGAVSTTFCAEIVESADAYLFAGPIFNDYSSVGYSLLLKREKAVIVQPDRVVVGNGPAFGCILMTEFLDALAKRLDRNTTAYDNYRRIFIPDREPPNGQPDEPLRVNILFKHIKEMLSGDTAVIAETGDSWFNCQKLRLPEGCGYEFQMQYGSIGWSVGATLGYAQAAKDKRVISCIGDGSFQMTAQDVSTMLRCGQKSIIFLINNGGYTIEVEIHDGPYNVIKNWDYTGLIDAIHNSDGNCWTKKVRTEEELIEAIATATGAKKDCLCFIEIIVHKDDTSKELLEWGSRVSAANSRPPNPQ

SEQ ID NO: 22379 - protein, 739 aa, Mycobacterium smegmatis
MPEDRPIEDSPPIGEAQTDAPAGGCPAGFGRIKPPVAGGSNRDWWPNQLNLKILQKNPDVINPLDEDFDYRSAVQNLDVDALRADIVEVMHTSQDWWPADFGHYGPLFIRMAWHAAGTYRVSDGRGGAGAGMQRFAPLNSWPDNASLDKARRLLWPVKKKYGKNLSWADLIVYAGNVALEDMGFRTAGFAFGREDRWEPEEDVYWGPEQEWLDDKRYTGERDLENPLAAVQMGLIYVNPEGPNGNPDPQASAIDIRETFGRMAMNDVETAALIVGGHTFGKTHGNGDASLVGPEPEAAPLEEVGLGWRNPQGTGVGKDAITSGLEVTWTHTPTKWDNSFLEILYGNEWELTKSPAGANQWKPKDNGWANSVPLPTRTAKTHPSMLTSDLALRVDPIYEQITRRWLDHPEELAEEFAKAWFKLLHRDMGPVTRYLGPEVPKDTWLWQDNIPAGNDLSDDEVAKLKELIADSGLTVSQLVSTAWKAASTFRSSDLRGGANGGRIRLQPQLGWEANEPDELAQVVRKYEEIQKASGINVSFADLVVLGGNVGVEKAAKAAGFDVTVPFTPGRGDATQEETDVDSFAYLEPKADGFRNYLGKGSDLPAEFKLIDRANLLGLSAPEMTTLVGGLRVLDVNHGGTKHGVLTDKPGALTTDFFVNLLDMSTAWKPSPADDGTYIGTDRATGSPKWTGTRVDLVFASNSQLRALAEVYAEDDSKEKFVKDFVAAWTKVMDADRFDVA

SEQ ID NO: 22380 - protein, 484 aa, Haemophilus somnus
MSQKGDIGVIGLAVMGQNLILNMNDNGFKVVAYNRTTSKVDEFLAGAAKGTNIIGAYSLEELAGKLEKPRKVMLMVRAGEVVDQFIEALLPHLEQGDIIIDGGNSNYPDTNRRVKALAEKGIRFIGSGVSGGEEGARHGPSIMPGGNEEAWQYVKPILQAISAKTDKGEPCCDWVGKEGSGHFVKMVHNGIEYGDMQLICEAYQFLKDGLGLSYDEMQQIFAEWKKTELDSYLIDITTDILGYKDADGEPLVEKILDTAGQKGTGKWTGINALDFGIPLTLITESVFARCVSSFKDQRVAASKLFNKTIGKVEGDKNVWIEAVRKALLASKIISYAQGFMLIREASENFGWNINYGATALLWREGCIIRSRFLGNIRDAYEANPDLIFLGSDPYFKGILENALSDWRKVVAKSIEVGIPMPCMASAVTFLDGYTSERVPANLLQAQRDYFGAHTYERTDKPRGEFFHTNWTGRGGNTASTTYDV

SEQ ID NO: 22381 - protein, 325 aa, Glycine max
MAVERSGIAKDVTELIGKTPLVYLNKLADGCVARVAAKLELMEPCSSVKDRIGYSMIADAEEKGLITPGKSVLIEPTSGNTGIGLAFMAAARGYKLIITMPASMSLERRIILLAFGAELVLTDPAKGMKGAVQKAEEILAKTPNAYILQQFENPANPKVHYETTGPEIWKGSDGKIDAFVSGIGTGGTITGAGKYLKEQNPNIKLIGVEPVESPVLSGGKPGPHKIQGIGAGFIPGVLEVNLLDEVIQISSDEAIETAKLLALKEGLFVGISSGAAAAAAFQIAKRPENAGKLIVAVFPSFGERYLSSVLFESVRREAESMTFEP

SEQ ID NO: 22382 - protein, 597 aa, Coprinopsis cinerea
MTDPITPKILQEIRAAVKDCSDRGLFVAAKWATDILLGIPAEKKQPLHGPVDPAPGGSANPFETSTPARPAAPSTFTSVTPEPAQPLAPSLVPVYNQHPQAPKPIVLSPEQQQLEYRALENEQDLLVGAKSYFDAREFRRVAFMLQGCSSSKALFLSTYSFFLVSLLSQLYKAYGVFISSTRKATERQALIDWHKLDSNRHQPPLPVNDSINAMLERVKDSQDPWCQFLKALFLSRLSRRDEAIATALQSIATYPWNWSAWSLLGSCINDVEELNSLLALVPLPATHPLVQFFIIKTSVELQNPSETELAMCDRLLSENYFSHSMWLMSLRAAILYHLHDYEQAEQQFDRILGIDPYRVDDIDIFSNILYVQDNKLKLSRLAQDFLAIDKDRPEICCLVGNHYSLRQEHEKAVKYFRRATQLDRTYLTAWTLMGHEYVEMKNSHAAIEAYRRAVDINRKDYRAWYGLGQAYELLSMHHYALYYYQHATALRPYDVRLWQAQGSCYEEIGRLHRLLEEHAEAVGYHRRVVELCQSNNRPITEYAKSSIEVAEYQMTIPNGNLNLAKEYLEAIAASNAEDVGRATEMLKVVKGRLAQAS

SEQ ID NO: 22383 - protein, 427 aa, Thermotoga maritima
  misc_feature (1)..(1): Xaa can be any naturally occurring amino acid
  misc_feature (13)..(13): Xaa can be any naturally occurring amino acid
  misc_feature (90)..(90): Xaa can be any naturally occurring amino acid
  misc_feature (201)..(201): Xaa can be any naturally occurring amino acid
XGSDKIHHHHHHXDELLEKAKKVREAWDVLRNATTREKNKAIKKIAEKLDERRKEILEANRIDVEKARERGVKESLVDRLALNDKRIDEXIKACETVIGLKDPVGEVIDSWVREDGLRIARVRVPIGPIGIIYESRPNVTVETTILALKSGNTILLRGGSDALNSNKAIVSAIREALKETEIPESSVEFIENTDRSLVLEXIRLREYLSLVIPRGGYGLISFVRDNATVPVLETGVGNCHIFVDESADLKKAVPVIINAKTQRPGTCNAAEKLLVHEKIAKEFLPVIVEELRKHGVEVRGCEKTREIVPDVVPATEDDWPTEYLDLIIAIKVVKNVDEAIEHIKKYSTGHSESILTENYSNAKKFVSEIDAAAVYVNASTRFTDGGQFGFGAEIGISTQRFHARGPVGLRELTTYKFVVLGEYHVRE

SEQ ID NO: 22384 - protein, 211 aa, Oryza sativa
MPPLLASTSSTSPLLLASRLRGGGGCGCGGAPLLHRTRRGFLAPSTTTTQTTRTSFAAMSWLGKLGLGGLGGSPRASAASAALAQGPDEDRPAAGNEFAQFGAGCFWGVELAFQRVPGVTRTEVGYSQGNLHDPTYEDVCTGATYHNEVVRVHYDVSACKFDDLLDVFWARHDPTTPNRQVSQPQINSIHKPNRMISFTVPCSMLNFGFFD

SEQ ID NO: 22385 - protein, 230 aa, Coprinopsis cinerea
MASHLANIFGTEQDRVNCSFYYKIGACRHGDRCSRKHIKPPFSQTILLPNVYHNPAHDPVCKLTEKELQEGFDAVYEDLYCELAKFGHLLELHVCDNVGDHLIGNVYARYEWETEAQAAVDSCNERWYAGRPLYAELSPVTDFREACCRQNENGECNRGGFCNFMHLRLPSPELLRQLRHGQRLERKLNPPKNENGAGGWEPSKREGGRGRSASPGRRTTHSGEDRWTRK

SEQ ID NO: 22386 - protein, 214 aa, Triticum aestivum
RCYRQIKNKPYPKSRYCRGVPDPKIRIYDVGMKKKGVDEFPYCVHLVSWEKENVSSEALEAARIACNKYMTKSAGKDAFHLRVRVHPFHVLRINKMLSCAGADRLQTGMRGAFGKPQGTCARVDIGQVLLSVRCKDNNAAHASEALRRAKFKFPGRQKIIESRKWGFTKFSRADYLKYKSEGRIVPDGVNAKLLGNHGRLEKRAPGQAFLKAVA

SEQ ID NO: 22387 - protein, 550 aa, Salmonella typhimurium
MQNPYTVADYLLDRLAGCGIGHLFGVPGDYNLQFLDHVIDHPTLRWVGCANELNAAYAADGYARMSGAGALLTTFGVGELSAINGIAGSYAEYVPVLHIVGAPCSAAQQRGELMHHTLGDGDFRHFYRMSQAISAASAILDEQNACFEIDRVLGEMLAARRPGYIMLPADVAKKTAIPPTQALALPVHEAQSGVETAFRYHARQCLMNSRRIALLADFLAGRFGLRPLLQRWMAETPIAHATLLMGKGLFDEQHPNFVGTYSAGASSKEVRQAIEDADRVICVGTRFVDTLTAGFTQQLPAERTLEIQPYASRIGETWFNLPMAQAVSTLRELCLECAFAPPPTRSAGQPVRIDKGELTQESFWQTLQQYLKPGDIILVDQGTAAFGAAALSLPDGAEVVLQPLWGSIGYSLPAAFGAQTACPDRRVILIIGDGAAQLTIQEMGSMLRDGQAPVILLLNNDGYTVERAIHGAAQRYNDIASWNWTQIPPALNAAQQAECWRVTQAIQLAEVLERLARPQRLSFIEVMLPKADLPELLRTVTRALEARNGG

SEQ ID NO: 22388 - protein, 190 aa, Oryza sativa
VNQGLTVYGNKGSTDQHAYIQQLREGVHNFFVTFIEVLRDRPPGHDWELEPGVTCGDYLFGMLQGTRSALYSNDRESISVTVQEVTPRAVGALVALYERAVGIYASLVNINAYHQPGVEAGKKAAGEVLALQKRVLTVLNEARHIEMIYKIIQHMAANDRALIAEGSCGSPRSIKVYLGECNVDEDMLAA

SEQ ID NO: 22389 - protein, 489 aa, Haemophilus somnus
MNDTVIQNQEHQSARKEWLKKIGIPLALTILLVLMFMPTPEGLTIQGQKAIAIFCGALTLWVCGSIPIYLTSLLVIILLPLTQTVAKDKVVFATLGYDVIWLMVSAFVLTSAMIKSNIARRFALWMITHFGQTPRKAMFVLVLINFILVFFVPSTTARASLMVPICLILLEIYRAVPGESNFGKLMMLQGVQADAIATSGVMTGTAGNIIAVGFINNQAGGDIGYLDWLLASFPIAFVTMIISFLIGFKLFSMKKETHFFEALSRLQAEYKKLGSLTLDEKKAMAIFLLTVLLWATESYQKAWFGFKISVYMTAVIAAVLCLMPRIGLLTWSEAKIKWDLMLFAAGAYAAGNTLESTKGAQWIMDKVVHGLGLETMSHTAVYVVVIFVCMYSHLIFTSKTVKTTILIPSIIALAQSLGMNPVTLALAASFTLTYTITLPPHSKVNTIYFATGYFSVLDQMKYGLVTCFIGASIICLSIFTWFQLLGYTL

SEQ ID NO: 22390 - protein, 419 aa, Unknown
  marine gamma proteobacterium HTCC2207
MFDKNQTIENFDAEVWHAMQQEDQRQEQHIELIASENYTSPAVMAAQGGQMTNKYAEGYPGKRYYGGCEYVDITEQLAIDRLKSLYGAKFANVQPHSGSQANSAVFLALIKGGDTILGMSLADGGHLTHGAKPNFSGKLYNPIQYGLNAETGLIDYDQVEALAIEHKPAMIIAGFSAYSGIMDWARFREIADKVGAYLMVDMAHVSGLIAAGVYPNPVPHAHVVTSTTHKTLRGPRGGIIITNDEDVAKKCNSAVFPGGQGGPLCHVIAAKAIAFKEAASQEFVDYQKQVVANAKAMAASFIKRGFNIVSNGTENHLMLVSLIGKEYTGTDADRAMGEAFITVNKNAVPNDPRSPFVTSGLRVGTPAITTRGFGIEETVQLTEWMCDILDSLENGTSEQVIADVKAKVLEICARFPVYG

SEQ ID NO: 22391 - protein, 545 aa, Populus euphratica
MEAHMSSIGLKLQMLSTSDHASVVSMNLFVALLCACIVIGHLLEETRWMNESITALIIGVGTGIVILLISGGKSSRLLVFSEDLFFIYLLPPIIFNAGFQVKKKQFFRNFMTIILFGAAGTLICCAIISIGAMQIFEKMDIGPLDIGDYLAIGAIFAATDSVCTLQVLSQDDTPLLYSLVFGEGVVNDATSVVLFNAIQSFDLTNINAVIAWEFVRNFLYLFLTSTMLGVLTGLVSAYIIKKLYFGRHSTDREVALMILMAYLSYMLAELFYLSGILTVFFCGIVMSHYTWHNVTESSRVTTKHAFATLSFVAEIFIFLYVGMDALDIEKWRFVSDSPGTSVAVSSILLGLVMVGRAAFVFPLSFVSNLSKKSPHEKIGFRQQFIIWWAGLMRGAVSMALAYNKFTSAGHTNLRANAIMITSTITVVLFSTVVFGMLTKPLISILLPHPKYQSRSLSFSSDPATPKSFTVPLLGEGQDSLDDLGGRDIPRPSSLRALLTTPTHTVHYYWRKFDNAFMRPMFGGRGFVPFVPGSPTERNPPQNQWH

SEQ ID NO: 22392 - protein, 709 aa, Lactobacillus plantarum
MPIIELVILLACLVLLSNVLSHYLVAIPVSLIQVGLGLGVALLLNVQVKLQTDWFMLVFIAPMLYNDGREFPKQELWELRGAIFANAIVLVFITTILGGFLIHVLIPTIPLAVGIALAAILSPTDPIAVQSISEGVKLPKEILHLVSGESLINDASGLIGFKYALAAAVTGTFVLGEAVGDFFYISLVGLAVGLALITIIQLIRDVLRREGINDIVFNVVLQILTPFAIYFIAEEWFHASGVVAVVAAGVLSHLQNSHESEDAPELRLVTERVWNVVVYLLNGIVFLILGIELPAATQATIKGAHTNTFHAVFDVLIVWGILLLIRVAWTYAYMLFNWLRHHKKAKPSLRIAALSGLSGVRGAITMAGVFTIPTVVASGKAFPERALVLFIAAGVIIVSLVAAAAILPLMAAKSLPFVTRGSSPDEDDAVLAEGTDDGDDSSGQLPQLTYKQARIYILQLAIQNIEEHRRPANQRAAYDLILDQQFQIRRLEVASQTADELAPMLTDELELRLVALNGERAAVREMIANKQTSKLAGQVYLRRVDRREQRFLQATHRQGLPTLRSLRLLLTRAMQGIRLWLAPGDSEELRVALLDIQREASKAAIKALSQYLKQANVDEQQFDRQALYHLIVHYRNRIENAKNDHTLSRDDYEQQLHGLRIKSLGAERAGVQHLLESGQISLRTAAKLRQFINYSENLLMLNDIEADED

SEQ ID NO: 22393 - protein, 169 aa, Streptomyces avermitilis
MTTDNAATSVLDTEIDALQGGSADLSQYAGKAVLIVNVASKCGLTPQYAGLERLQERYAAQGFTVLGVPCNQFLGQEPGTSEEIAEFCSATYGVTFPLTEKVEVNGDARHALYESLVGFADGEGHTGDIRWNFEKFLIGRDGKVVARFSPQTEPESAEVVTAVERQLAG

SEQ ID NO: 22394 - protein, 915 aa, Xanthomonas campestris
MHRITRSTCCYCGVGCGVLIHSEHAADSERIVGIEGDPLHPANFGRLCSKGLALPQTVASTQGRVLQPQLRRHRQAPRTAVGWEQALDHVAHKLAAIIQEHGPDAVGFYLSGQLLTEDYYVFNKLAKGLLGTNNIDTNSRLCMSSAVTGYKLALGADGPPTCYDDLELAHTVLFAGSNMAYAHPVLFRRLEEARARNPDIRWIVIDPRRTDTAAMADLHLAIEPGTDVALFNGMLHHLIWEGLVDARFVAAHTEEFDALKRMLREYTPRMSAEICGIAHEDLVQAAEWFGRSPAALSLYCMGLNQSVHGTDKNLALINLHLATGQIGKPGAGPFSLTGQPNAMGGREVGGMATMLAAHREIANADDRAELERLWGVPAGRISPTAGAPAVQLFERLRAGTLKAVWIVCTNPVHSMPEVAGIRAALENAELVIVQEAFSGTDTVPYADVLLPAASWGEKDGTVTNSERRITRVRKAVEAPGQARADWWIANEVARRLEARLAPARGPGLFAFKHPAQIFDEHRALTIGRDLDIGGLDYALLDHGPQQWPFPAGSTQGQARRYTGGVFAHANGRARFHATPYRKVAEATSARFPMRLLTGRLRDQWHGMSRTGRVAAAFAHSPEPALRMHPGDAQRRGLVAGELVQIASKRGALVLPLELSDELRSGTVFAPMHWSGQSLSSGGINEVSTPAVDARSQQPELKHTAVRVERITFGWHLLAARRGDALALQQALQPLLRDCGYASLRLHAEPSSGTRRRAAGDWVVLHAACERAPDASWMDRLVVALQLPAGADVLEYRDLRRGLMRRVGWRMQDGHHHIDGVLLTAAQPSDADRSLLATALAGEPWRGARLSVFAHTHSAPSDPIVCTCMHVSAAAIHAAIDDGADVAQLKQRLGCGTVCGSCVPQLTRLCRQTRLA

SEQ ID NO: 22395 - protein, 258 aa, Xanthomonas campestris
MSVTPSCARDVVLLSAGPGDLELLTIKAVKALASAQVLLLDDLANPEIVELAPQARVIRVGKRGGCRSTPQEFICRLMRRYALQGLRVVRVKGGDALLFGRAGEEIAFLRRAGVGVQVINGVSAAFAAAAALEVSLTHRSHCHGITFVTAHTHDHGEPNWGALAASGTTLGIYMGLRRADALAAALLAHLPASTPAAIVQAATRPEQQRRLTTLGELGMTAAALPPGMPTLLLVGGALSEAAAACDDRDGPMVVQAVG

SEQ ID NO: 22396 - protein, 372 aa, Oryza sativa
MDDPMLNAVKEEESHGDGGGLEVVAGEDGAAAVAAGVAPRPMEGLHDAGPPPFLTKTYDMVDDAGTDAAVSWSATSNSFVVWDPHAFATVLLPRFFKHNNFSSFVRQLNTYGFRKVDPDRWEFANENFLRGQRHLLKNIKRRKPPSHTASNQQSLGPYLEVGHFGYDAEIDRLKRDKQLLMAEVVKLRQEQQNTKANLKAMEDRLQGTEQRQQQMMAFLARVMKNPEFLKQLMSQNEMRKELQDAISKKRRRRIDQGPEVDDVGTSSSIEQESPALFDPQESVEFLIDGIPSDLENSAMDAGGLVEPQDFDVGTSEQQQIGPQGELNDNFWEELLNEGLVGEENDNPVVEDDMNVLSEKMGYLNSNGPTAGE

SEQ ID NO: 22397 - protein, 704 aa, Prochlorococcus marinus
MPNAFCLAADTAVSKMHLGTPWPLGSTITTRGVNFSVAAPTAKRVELLLFADANATQPEHILELQPCHRSGDYWHVEVEGLRTGCCYGYRIFGPHNTGSDSFHPSKVLLDPCTRAITGWDIYQREQAKGSSPNIQACLKGVVCEREHFDFASHPRPRTPWNRSVIYELHVGGFSSGPKSEVTPQRQGTFLGLIDKLPYLRQLGITAIELLPIFAFDPSDAPTGRDNYWGYSPLNWFTPHPKYVHGDDPLQARQQVRELVAACHDEGIEVILDVVYNHTTEGSLDGPTLSWRGFSDALYYHQNDSGEYLDVSGCGNSIAANRPIVRQLILESMRCWAIELGVDGFRFDLGIALSRGEGLKPLEHPPLFEEIEADPELSDLKLFSEPWDCGGLYRLSDFPAQRIGTWNGHYRDDLRAFWKGDEDSAWRMGQRLSGSADLYKGEPAPLGRSLNFITAHDGFTLNDLVSFNRKHNLANGESNRDGENHNNSWNNGIEGPCSDHAVQALRHRQMRNLIATLLLSRGVPMLLMGDEVGRSQGGNNNSWCQDNPLGWMLWNPEQCDMDLHLFVSRLLMIRQQLSELFCPINPPPEEMPVSLQQSPDDLWLQWHGVEIDKPDWGSWSHTICYSLNRGSSGAVMWMGFNAYSKAMHFDLPKPTSAWHLLLDTACPSPDDLPARPNAWTSVDIDLQNRSMLILMAEEYASKLKL

SEQ ID NO: 22398 - protein, 144 aa, Camelina sativa
YARTSRLTEKSDVYSYGIVLLELLTRRKAVDDESNLHHLIMSKTGNNEVMEMADPDITSTCKDLGVVKKVFQLALLCTKRQPSDRPTMHQVTRVLGSFMLSEQPPAVTDTSAALAGSCYVDEYANLKTPHSVNCSSMSASDAQL

SEQ ID NO: 22399 - protein, 635 aa, Geobacillus kaustophilus
MCGFIGCIHDRPRAIEQTWKTTLVEMNRLITHRGPDDEGYFFDDYVSFGFRRLSIIDLEAGHQPLSYENDRYWIIFNGEIYNYLELREELAAKGYSFATHSDTEVIVALYSAEKEKAVEKLRGMFAFVIWDKQEKTVFAARDPFGIKPFFYAEQGDRTFFASEKKSILLALRQESPNGDSLQHYLTFQYVPEPLTMSAGIYKLEPGHYLKKKVGKPLTIHRYWKASFEPIRQSEEELVKKIRDALFDSVNVHMRSDVPVGAFLSGGIDSSFIVAIAKQFHPHLKTFSVGFEREGFSEIDVAKETAEKLGVDNISYVISPQEYMEELPKIMWHMDDPLADPAAVPLYFVAREARKHVTVVLSGEGADELFGGYNIYREPESLRLFARMPNIVKAVLRVIAKMLPDGMKGKSFLERGTTPLEERYVGNAKIYSEKEKAALLKTYQEGREYTAVTAPFYRETLHYPPVNRMQYIDLHTWLRGDILVKADKMTMAHSLELRVPFLDKKVFEVARQIAPDMKTANGTTKYILRKAAEGIVPDHVLNRKKLGFPVPIRHWLKNEMYDWARQLINESETDHLFHKDVLYRLLDEHARHKADHSRKLWTVLAFMVWHQVYVEKKYDFAQSVQNEKRPASVLEA

SEQ ID NO: 22400 - protein, 428 aa, Brassica napus
MAQILAASPTCQMRLTKPSSIASSKLWNSVVLKQKKQSSSKVRSFKVMAIQSDNSTINRVESLLNLDTKPFTDRIIAEYIWYGGSGIDLRSKSRTLEKPVEDPSELPKWNYDGSSTGQAPGEDSEVILYPQAIFRDPFRGGNNILVICDTYTPAGEPIPTNKRARAAEIFSNKKVNEEIPWFGIEQEYTLLQPNVNWPLGWPVGAYPGPQGPYYCGVGAEKSWGRDISDAHYKACLYAGINISGTNGEVMPGQWEFQVGPSVRIEAGDHVWCARYLLERITEQAGVVLTLDPKPIEGDWNGAGCHTNYSTKSMREDGGFEVIKKAILNLSLRHMEHIIAYGEGNERRLTGKHETASIDQFSWGVANRGCSIRVGRDTEKKGKGYLEDRRPASNMDPYIVTSLLAETTLLWEPTLEAEALAAQKLSLKV

SEQ ID NO: 22401 - protein, 292 aa, Arabidopsis thaliana
MSNNQAFMELGWRNDVGSLAVKDQGMMSERARSDEDRLINGLKWGYGYFDHDQTDNYLQIVPEIHKEVENAKEDLLVVVPDEHSETDDHHHIKDFSERSDHRFYLRNKHENPKKRRIQVLSSDDESEEFTREVPSVTRKGSKRRRRDEKMSNKMRKLQQLVPNCHKTDKVSVLDKTIEYMKNLQLQLQMMSTVGVNPYFLPATLGFGMHNHMLTAMASAHGLNPANHMMPSPLIPALNWPLPPFTNISFPHSSSQSLFLTTSSPASSPQSLHGLVPYFPSFLDFSSHAMRRL

SEQ ID NO: 22402 - protein, 310 aa, Lactobacillus acidophilus
MKKYDVAIIGAGPGGMAAALYAARANLTVAMIDRGVYGGQMNNTAEVENYPGFPSILGPELGEKMYQNTVKQGVNFVYGDVQGIEVKDDKRIVKLGSEDSDIETKAVIIGTGSSNRKLGVPGEDEYSGKGVSYCAVCDGAFFKNENVVVVGGGDSAVSEGLYLANVTDNVNVIHRRDQLRAEQVLQKRAFKNPKMDFTWDSEVKEIIGDENKMTGVKVHNKKTGKDETIDANGAFIYIGNIPNSEPFRDLNITDKDGWILTNDQMETEVPGIFAIGDVRKKKLRQIITAVNDGGIAGQNAYEYIQKLTEN

SEQ ID NO: 22403 - protein, 526 aa, Oryza sativa
MVTLLIETTQGVGRYGGIKVYAVLGDDGADYAKNNAWEALFHVDDPGPRVPIAKGKFLDVNQALEVVRFDIQYCDWRARQDLLTIMVLHNKVVEVLNPLAREFKSIGTLRKELAELQEELAKAHNQVHLSETRVSSALDKLAQMETLVNDRLLQDGGSSASTAECTSLAPSTSSASRVVNKKPPRRSLNVSGPVQPYNPSLKNFWYPVAFSSDLKDDTMVPIDCFEEQWVIFRGKDGRPGCVMNTCAHRACPLHLGSVNEGRIQCPYHGWEYSTDGKCEKMPSTKMLNVRIRSLPCFEQEGMVWIWPGNDPPKSTIPSLLPPSGFTIHAEIVMELPVEHGLLLDNLLDLAHAPFTHTSTFAKGWSVPSLVKFLTPSSGLQGYWDPYPIDMEFRPPCMVLSTIGISKPGKLEGKSTKQCSTHLHQLHICLPSSRNKTRLLYRMSLDFAPWIKHVPFMHILWSHFAEKVLNEDLRLVLGQQERMINGANVWNWPVSYDKLGIRYRLWRDAIERGVDRLPFSNQSESGS

SEQ ID NO: 22404 - protein, 390 aa, Oryza sativa
AESANGVPGAARRGAGEPAALVCGTYALTKEERERERMCQLFDEASERCRTAPMEGVSFSPEDLDSAVESTDIDTDIGSLIKGTVFMTTSNGAYVDIQSKSTAFLPLDEACLLDVNHIEEAGIRAGLVEEFMIIDENPGDETLILSLQAIQQDLAWERCRQLQAEDVVVTGKVIGGNKGGVVALVEGLKGFVPFSQVSSKSTAEELLDKELPLKFVEVDEEQGRLVLSNRKAMADSQAQLGIGSVVLGTVESLKPYGAFIDIGGINGLLHVSQISHDRVADISTVLQPGDTLKVMILSHDRERGRVSLSTKKLEPTPGDMIRNPKLVFEKADEMAQIFRQRIAQAEAMARADMLRFQPESGLTLSSEGILGPLSSDTPSEGSGEGQTTDE

SEQ ID NO: 22405 - protein, 527 aa, Oryza sativa
MTTVASLSLLPHLLIKPSFRCCSRKGVGRYGGIKVYAVLGDDGADYAKNNAWEALFHVDDPGPRVPIAKGKFLDVNQALEVVRFDIQYCDWRARQDLLTIMVLHNKVVEVLNPLAREFKSIGTLRKELAELQEELAKAHNQVHLSETRVSSALDKLAQMETLVNDRLLQDGGSSASTAECTSLAPSTSSASRVVNKKPPRRSLNVSGPVQPYNPSLKNFWYPVAFSSDLKDDTMVPIDCFEEQWVIFRGKDGRPGCVMNTCAHRACPLHLGSVNEGRIQCPYHGWEYSTDGKCEKMPSTKMLNVRIRSLPCFEQEGMVWIWPGNDPPKSTIPSLLPPSGFTIHAEIVMELPVEHGLLLDNLLDLAHAPFTHTSTFAKGWSVPSLVKFLTPSSGLQGYWDPYPIDMEFRPPCMVLSTIGISKPGKLEGKSTKQCSTHLHQLHICLPSSRNKTRLLYRMSLDFAPWIKHVPFMHILWSHFAEKVSPKNSEQLHTKLLSISCHYSLHLTIVCGYLCFAYCPLYNIYNNLV

SEQ ID NO: 22406 - protein, 581 aa, Chlamydophila abortus
MPKQSEYTWGSKKILDTIDCLSEDVVEFKDLLCSTHGITSSDEEPTSEIQPGAILKGTVVDINKDFVVVDVGLKSEGVIPMSEFIESSEGLVLGAEVEVYLDQTEDEEGKVVLSREKATRQRQWEHILAHCEEGSIVKGQIIRKVKGGLIVDIGMEAFLPGSQIDNKKIKNLDDYVGKVCEFKILKINIDRRNVVVSRRELLEAERISKKAELIEQITIGERRKGIVKNITDFGVFLDLDGIDGLLHITDMTWKRIRHPSEMVELNQELEVVILSVDKEKGRVALGLKQKEHNPWEDIEKKYPPGKRITGKIVKLLPYGAFIEIEEGIEGLIHVSEMSWVKNVVDPSEVVNKGDEVEAIVLSIQKDEGKISLGLKQTEHNPWDNIEEKYPIGLHVRAEIKNLTNYGAFVELEPGIEGLIHISDMSWIKKVSHPSELFKKGSIVEAVILSVDKESKKITLGVKQLSSNPWNEIEEMFPTGSVISGVVTKITAFGAFVELQNGIEGLIHVSELSEKPFSKIEDIISIGDSVSAKVIKLDPDHKKVSLSVKEYLADKQHDQTDTDIDDLDLEDLVSSDKKKKGK

SEQ ID NO: 22407 - protein, 210 aa, Bordetella parapertussis
MAKNKFSKDWIHQHINDPYVKLAQQKGYRARAAFKLLEILDAEKLMRRGDIVVDLGSAPGSWSQVARERLAGPGGAVDGRIIALDLLPMEPVAGVEFIQGDFREEAVLEQLARMVEGQPVDLVISDMAPNLSGVGVADSARIQHVCELALEFACAHLKPNGALIVKAFHGSGFSQIVQSYKQRFKRVVERKPKASRDKSSETFLVARDLK

SEQ ID NO: 22408 - protein, 311 aa, Chlamydophila abortus
MTYAKVIIIGSGPAGYTAAIYASRALLSPILFEGFFSGVAGGQLMTTTEVENFPGFPEGILGPKLMENMKSQSSRFGTQILPKDVTSVDFTIRPFVVMSNEEKYTCDACIIATGASAKRLEIPGAADNEFWQKGVTACAVCDGASPIFKNKDLYVIGGGDSALEEAIFLTRYGKRVFVVHRRDTLRASKAMIKKAESNEKISFLWNSSIVKISGDTFVRSVDILNNVSKEVSTRDAGGVFFAIGHRPNTDFLGGQLALDEHGYIITEPGTCRTSIPGVFAAGDVQDKHYRQAIIAAGSGCMAALEAERFLN

SEQ ID NO: 22409 - protein, 286 aa, Pseudomonas syringae
MSDYQETLYEGYGQRFRMEKMLHEVRTEHQHLVIFQNPRMGRVMALDGVIQTTEADEFIYHEMLTHVPILAHGAAKRVLIIGGGDGGMLREVAKHLTVEHITMVEIDATVVEMCKEFLPNHSSGAFDDSRLNLVIDDGMRFVATTEEKFDVIISDSTDPIGPGEVLFSENFYQACHRCLNEGGILVTQNGTPFMQLSGVQTTAGRMNGLFADWHFYQAAIPTYIGGAMTFAWGATDKSYRKLPLETLRQRFSGSGIVTRYYNPEVHIGAFALPQYVLHAVNKASND

SEQ ID NO: 22410 - protein, 366 aa, Candida albicans
MATFAPHISKITKSSTKFNYGRIAKTFLGVAGSAAIATYFYNNGNPFNNNNNNNNNNEGSKNAAKALFGASAGANVKIAKVPEGKSASDYQKVYNDIATKISENLEFDENAGYYGQLLRLAWHTSGTYDKSDNSGGSYGGTMIFAPEEFDPENAGLQVGREFLMEFLVKYPWISRGDLWTLGGVAAVQESGGPKIEWRPGRVDDNTASKVPPNGRLPDASKDGKYVKDLFARMGFNERETVALLGAHVLGRCHKHNSGYDGPWGPSFNQFTNVFYTTLLGDWHVKKWDGKKQYEDDETGEFMMLPTDMALKEESYFLKYVKMYADDQDLFFKDFAKAFSKLISNGIKYPADSKPILFKTLDEQDEE

SEQ ID NO: 22411 - protein, 291 aa, Vibrio vulnificus
MSMADKDTATVFPFKRPSVVASNPTAGRYGHSQLKHGEVALVGAGPGDPELLTLKALNYLQQAEVVLYDYLVSDEIMALVPNDAILVCVGKRAGHHSVPQEKTNQLLVDFAKQGYKVVRIKGGDPFVFGRGGEELEVLADAGITFQVVPGITAAAGATAYAGIPLTHRDYAQSAMFITGHLKAESDQLDWSTLARGQQTLVIYMGLMKSNYIQEQLIKHGRRAQTPIAIIERGTQLSQKVFKGQLSELADLAKKAEAPALIVIGEVVQLSQKLDWFLSGTRINNSAIANSI

SEQ ID NO: 22412 - protein, 528 aa, Trichodesmium erythraeum
MESKALWQRYIDWLYYHEGLGFYVDISRIKFDDSFVEIMKPKFEKAFQEMKKLEEGKIANPDENRMVGHYWLRDLDIAPTKEIKNEISTTLEAIETFAKKVHSGEIKPSSAPKFTDILSIGIGGSALGPQFVAEALGLDDPPMEIHFIDNTDPAGIDRVLHKLSDRLKSTLVIVISKSGGTPEPRNGMIEVKAAFASQNLNFATQAVATTTPSSKLGQIAKSEGWIDIIPMADWVGGRTSELSSVGLLPAALQGIDIRAMLAGAKEMDKVTRTHEIKGNPSALLALSWYAAGKGHGEKDMVVIPYKDSLLLLSRYLQQLVMESLGKEKDLDGKVVNQGIAVYGNKGSTDQHAYVQQLRDGVLNFFVTLIEVLEDREGTSPEVEPGVTSGDYLSGFIQGTRQALYENDRDSITVTIPKVNPYNLGALIALYERAVGFYGSLVNINAYHQPGVEAGKKAAAAVLELQHKVINILKQEKSPLSLEELSEKAGAGDQIETIYKILRHLAANKRGIVFHGNVGQPDKLGVSYN

SEQ ID NO: 22413 - protein, 650 aa, Listeria monocytogenes
MEIFELILLMLSAVFLSNVLSRFLPGIAVPLIQVILGIILAIPLGDHTMDLNPELFLLLFMAPILFNDGASTDKKSLWKNRKAILSLSIGLVFVTVGVLGAFIHYLIPAIPFAAAFALAAALAPTDAVAVGALAEKVRVPHKIMHILEGESLINDASGLVSFQFAVLALVTGTFSFMSAGTSFLLLSLGGIALGAALSLLKIMLMRGLRQLGIENMTSFMLMEILLPFLIFMVAEKVGVNGILAVVSGGMVHSFSYKGLNPEIAQLNLLSKNTWSVIIFSLNGLVFILLGTQLPQILMTIWQDANIQKGMLFVYILGITFLLLGLRFLWILFFRNYEENPKVDLVSRLKNTFLYTVAGVRGTITLVSALSLPFVLGNGNAFPERDLLIFIAAGVIITTLLLANFTLPLFADKKDKIAADHTTDIVLLRDIVQQLQAYKTDENAVEMNKVLNMYNNRIFSLMEHKEVNATEKELRRLTQEWQLENTRRLVFERKIDTGVGLSHMMRLGKRLYVQTRAEKYRARMRYRQLLSHRFRDFRFVPLTFEERRKEIAKLQNENNLFVIQKLQELDSNEYNPEIISLYLMNFERALGRGKNKKESNDEALQTTIDLASQIERETIQHYFEKGTITRKEMKVYRDNLLAIEANMQLEF

SEQ ID NO: 22414 - protein, 531 aa, Escherichia coli
MMMFKAQEINMLDTNMKTQLKAYLEKLTKPVELIATLDDSAKSAEIKELLAEIAELSDKVTFKEDNSLPVRKPSFLITNPGSNQGPRFAGSPLGHEFTSLVLALLWTGGHPSKEAQSLLEQIRHIDGDFEFETYYSLSCHNCPDVVQALNLMSVLNPRIKHTAIDGGTFQNEITDRNVMGVPAVFVNGKEFGQGRMTLTEIVAKIDTGAEKRAAEELNKRDAYDVLIVGSGPAGAAAAIYSARKGIRTGLMGERFGGQILDTVDIENYISVPKTEGQKLAGALKVHVDEYDVDVIDSQSASKLIPAAVEGGLHQIETASGAVLKARSIIVATGAKWRNMNVPGEDQYRTKGVTYCPHCDGPLFKGKRVTVIGGGNSGVEAAIDLAGIVEHVTLLEFAPEMKADQVLQDKLRSLKNVDIILNAQTTEVKGDGSKVVGLEYRDRVSGNIHNIELAGIFVQIGLLPNTNWLEGAVERNRMGEIIIDAKCETNVKGVFAAGDCTTVPYKQIIIATGEGAKASLSAFDYLIRTKTA

SEQ ID NO: 22415 - protein, 242 aa, Oryza sativa
MCRGGLQVGAPPEVAARLTAVAQDLELRQRTALGVLGAATEPELDQFMEAYHEMLVKYREELTRPLQEAMEFLRRVETQLNTLSISGRSLRNILSSGSSEEDQEGSGGETELPEIDAHGVDQELKHHLLKKYSGYLSSLKQELSKKKKKGKLPKDARQQLLNWWELHYKWPYPSESQKVALAESTGLDLKQINNWFINQRKRHWKPSDEMQFVMMDGYHPTNAAAFYMDGHFINDGGLYRLG

SEQ ID NO: 22416 - protein, 470 aa, Burkholderia vietnamiensis
MGKQAIGVIGLAVMGRNLALNIESRGYAVSVYNRSREKTDELIAEFPGRNLVPTYTLEEFVASLETPRRILMMVKAGEATDATIASLKPLLEKGDVLIDGGNTHFTDTIRRNQELAQSGLHFIGTGVSGGEEGALRGPSIMPGGQRDAYDLVEPILKQIAAKAPSDGEPCVAYMGPDGAGHYVKMVHNGIEYGDMQLIAESYAVLKDVAGLTNDELGAVYTEWNQGELDSYLIEITSKIFGKKDDETGKQLVDVILDRAAQKGTGKWTSQNALDLGVPLPLITESVFARVLSSLKTERVAASKILSGPAAAPFDGDRAAFVEAVRRALYLSKVISYAQGFAQLRTASEEYGWNLDLGTIAKIFRAGCIIRARFLQKITDAYAKDPALANLLLDPYFKDIAANYQTALRDVVVAAVKAGVPVPAFASAVAYFDSYRSERLPANLVQAQRDFFGAHTFERTDRPGSFHANWS

SEQ ID NO: 22417 - protein, 197 aa, Thermoplasma volcanium
MTGDRRDEYYWKAKKEQLRSRAAFKLEFLLDRYRVVRKGDAVIEIGSSPGGWTQVLNSLARKIISIDLQEMEEIAGVRFIRCDIFKETIFDDIDRALREEGIEKVDDVVSDAMAKVSGIPSRDHAVSYQIGQRVMEIAVRYLRNGGNVLLKQFQGDMTNDFIAIWRKNFSSYKISKPPASRGSSSEIYIMFFGFKAP

SEQ ID NO: 22418 - protein, 324 aa, Candida glabrata
MSATATTTTTSQLQLNSTSIEHALSDVVKTDDWSDFQFRPIRESTVSRAMTSRYFKDLDKFAVSDVVIIGCGSSGLSAAYVIAKNRPDLKIAILEANVAPGGGAWLGGQLFSAMIMRKPADLFLKELEIPYEDEGDYVVVKHAALFTSTVLSKVLQFPNVKLFNATAVEDLVTRPAGPNGEVSVAGVVTNWTLVTMAHDLQSCMDPNVIELSGYKEDGTRDPSKKHGVVLSTTGHDGPFGAFSAKRIVSIDKNKKLAGMKGLDMNNAEAGVVKNSGSYNGVGSMYFAGMEVAELEGCNRMGPTFGAMAVSGIKAGEEILKHFAE

SEQ ID NO: 22419 - protein, 362 aa, Arabidopsis thaliana
MDNFLPFPSSNANSVQELSMDPNNNRSHFTTVPTYDHHQAQPHHFLPPFSYPVEQMAAVMNPQPVYLSECYPQIPVTQTGSEFGSLVGNPCLWQERGGFLDPRMTKMARINRKNAMMRSRNNSSPNSSPSELVDSKRQLMMLNLKNNVQISDKKDSYQQSTFDNKKLRVLCEKELKNSDVGSLGRIVLPKRDAEANLPKLSDKEGIVVQMRDVFSMQSWSFKYKFWSNNKSRMYVLENTGEFVKQNGAEIGDFLTIYEDESKNLYFAMNGNSGKQNEGRENESRERNHYEEAMLDYIPRDEEEASIAMLIGNLNDHYPIPNDLMDLTTDLQHHQATSSMTPEDHAYVGSSDDQVSFNDFEWW

SEQ ID NO: 22420 - protein, 307 aa, Bacillus cereus
MEIKNSITELIGKTPVVKLNHIVKGNVADIYLKLEFMNPGSSVKDRIALAMIEDAEKKGVLKKGDTIIEATSGNTGISLAMIAAAKNYKSILVMPDTMSVERRNLLSAYGAKLILTPGHEGMSGAIQKANELAKINGYFIPQQFKNQTNPEIHRLTTGPEIVEQMGNQLDVFIAGVGTGGTITGAGSFLKEVYKDIKICAVEPADSPVLSGGKPKKHQLQGIGAGFVPETLDVRVYDEVIQVRADQAFEYARKVACKEGILLGISAGAAIYASVKIAKKIGRGKKILTIIPSNGERYLSTMLYRFEQ

SEQ ID NO: 22421 - protein, 871 aa, Salinibacter ruber
MAEQEQVASKDDTQDTADAQPAPAEAEEAAEAEAPPADAADSGDDVEAADPEAPSTPDAGGEDVDEPAAEEPAPAEDAPADAADESGDGAPADPPPEPGFVSRILEEAVEEASQDLPMPSGDEASVDVSEFDEPTETVSPDELERTEEAQGFTGETYGETVSLDELETEEQAPADTSVYDQFRDVVDETSIDVREQDIVEGRVLRVNEDYVVIDIGYKSDGIVSRDEFGEEEIHPGDTVEVYLERKEDRDGQLVLSKEQADKVRRWQRVEEIYENEEVIEGTIIRRIKGGMIVELFDGMEAFLPGSQIDVRPVRDFESYLETRMEFKIVKLNPENENIVVSHRELIEHELEEQRQEILEQLEVGQVLEGTVKNIVDFGVFIDLGGVDGLLHITDLSWGRVSHPSEVVELDQELEVVVLDYEEERQRISLGLKQLRDHPWDQIGNKYDEGDVVEGKVVSITNYGAFVEIEKGIEGLVHISEMSWTRHIEHPSQMVSLGQVVDVKILNIDQEERKISLGMKQLEPDPWEGISDRYPAGTVLTGTVRNITNFGVFVEIEPGIDGLVHVSDLSWTKKIRHPGDMVDEEQELDVVILNIDEERRRISLGHKQVKTNPWDQFADAYEEGNDTTGEVVRVEDKGLVVQLPLDVEAFVPGSELKNGPKAFKNHYHEGDELELQVIRFDKDQKDIVLSETAKEEAERQEEQDEQERESRREEREREEAVRDFKDEPEPEPDEPTTGPTTLGELSGLADLRREMEEEEAEEETAAEDDDAEADDAQAETPDEEEAASEGEAGDEPDAEAPSEDDDASTFDETAGFPENFPRVSRLENAGVTSLADAREVDDLTDLDGIGSAYAEEISDALDEFDETGSVSS

SEQ ID NO: 22422 - protein, 397 aa, Pseudomonas putida
MEGLQPVRSLFTRFFQLEAASGLLLIAAAVLALIINNSPLSYLYGGLLEVPVAVQVGALNIAKPLLLWINDGLMALFFLLIGLEVKREVVDGHLSKPSQVILPATAAVGGMVVPALIYWFINRDNPAAVAGWAIPTATDIAFALGVLALLGKRVPVSLKLFLMTLAIIDDLGAIIVIALFYSGTLSSVSLLLAAACLLVLVAMNRLGVIKLGPYMIVGLILWVCVLKSGVHATLAGVALAFCIPLRTRNAESSPLLALEHALHPWVAYAILPIFAFANAGVSLAGMTVDSFTHPVPMGITIGLLLGKTVGVFGLTWVAVKLRLAALPAGAGWGQILGVAILCGIGFTMSLFVGSLAFAPGSSEYAGMDRMGILTGSFFAAVIGYAVTAMASRKTSIA

SEQ ID NO: 22423 - protein, 102 aa, Arabidopsis thaliana
MASGSLKSLISSAVGRGVTEARARIFGHMLNPTGQRSPHKILRKKLIGDKVAEWYPYDIKNEDPNVLAREEKERISKLEMLKRRDKGPPKKGHGKRAAKRNK

SEQ ID NO: 22424 - protein, 434 aa, Thermoplasma volcanium
MDEISSMLDYLGIKSTEELFSDIPLSVRKKEIGIGSPLDEHLVLERARKYASLNSTEMLNFLGNGIYDRVIPEAVNYIISKSEFLDSYTPYQPEVSQGMLQSIFEYQSLISDLFKMDFTNASMYDGYSALGEAARMAYRINGKNKILIPESTYDSKLSVLKNYVWGLSMKIEKYKMNEEGKIDIDDLQSRIDGDTSAVVVENPNGYGVIDENVFRISEIKKESLLISYVDPISLGVLKPPGEYGSDIAIAEGQQLGIPMNFGGPLLGIMSFKADYVRKSPGRLIGESVDADGKRAFVMTLQTREQHIRRAKATSNICSNQALLTLAAGSYLSILGSSGLKKVALLTIKHSKNLAESLGNIGIEKVFDSISFSDTLFRIDKNVMLDLAKKGILGGIKLTSLIKDSKYSSGTFFTATEKTDNEKIKALVNALEVIM

SEQ ID NO: 22425 - protein, 101 aa, Brassica napus
  misc_feature (6)..(6): Xaa can be any naturally occurring amino acid
  misc_feature (11)..(11): Xaa can be any naturally occurring amino acid
  misc_feature (21)..(21): Xaa can be any naturally occurring amino acid
  misc_feature (51)..(51): Xaa can be any naturally occurring amino acid
  misc_feature (58)..(58): Xaa can be any naturally occurring amino acid
  misc_feature (62)..(62): Xaa can be any naturally occurring amino acid
  misc_feature (75)..(75): Xaa can be any naturally occurring amino acid
  misc_feature (88)..(89): Xaa can be any naturally occurring amino acid
  misc_feature (92)..(92): Xaa can be any naturally occurring amino acid
  misc_feature (94)..(94): Xaa can be any naturally occurring amino acid
  misc_feature (96)..(96): Xaa can be any naturally occurring amino acid
  misc_feature (98)..(99): Xaa can be any naturally occurring amino acid
EKEEVXAYSMXSSATVVTSPXQATMVVPFTGLKSSSAFPVTRKANNDITSXVSNGGRXNCMXAWPPIGKKKFETXSYLPDLTEAELPXXVDXLXRXKXXPC

SEQ ID NO: 22426 - protein, 472 aa, Thermoplasma volcanium
MNFKQAYYEEPIIKDIKSSNTFSLSEQVDESILPENLKRKDLELPEVSEYDVVRHYTRLSQMNYTVDVGIYPLGSCTMKYNPKFADRVSAIDGFRNIHPFQPENTVQGALHVMYDLQEYLKKISDMDAVSLQPMAGADGEFTGILIVKKYFEDKGEDRTEIIIPDSAHGTNPASATMGGFDVVEVPSDDKGMVDLEALRAAVSKKTAAFMITNPNTLGIFEQNIEEIAKIIHNAGALLYYDGANLNAIFGITSPGLMGFDIVHFNLHKSFATPHGGGGPGAGPVAVKSFLKDFLPVPIVDFDGNSYRLNYELKKTIGKVSSFYGSFSILLRAWSYIIRNGDDGLKNVSARAVLNSNYLKKKLEKYYDIPYYPLKKHEFVLSTENTGKRALDIGKYILDNGIHSPTVYFPLIVKEAMMIEPTETVSKADLDNYADVLIEALKLSDEELKSRPKNTAVRRIDEVKAARDLKLKW

SEQ ID NO: 22427 - protein, 303 aa, Arabidopsis thaliana
  misc_feature (219)..(219): Xaa can be any naturally occurring amino acid
  misc_feature (292)..(292): Xaa can be any naturally occurring amino acid
MWFFGSKGASGFSSRSTAEEVTHGVDGTGLTAIVTGASSGIGVETARVLALRGVHVVMAVRNTGAGAKVKEDIVKQVPGAKVDVMELELSSMESVRKFASEYKSAGLPLNLLINNAGIMACPFMLSKDNIELQFATNHLGHFLLTKLLLDTMKNTSRESKREGRIVNVSSEAHRYSYPEGVRFDKINDESSYSSIRAYGQSKLCNVLHANELAKQLKEXIMTNLWGYFNSYLAGAVGAVAKYMVKSVPQGAATTCYVALNPQVAGVTGEYFSDSNIAKPIELVKDTELAKKXWDFSTKLTDSQ

SEQ ID NO: 22428 - protein, 563 aa, Saccharomyces cerevisiae
MSEITLGKYLFERLKQVNVNTVFGLPGDFNLSLLDKIYEVEGMRWAGNANELNARYAADGYARIKGMSCIITTFGVGELSALNGIAGSYAEHVGVLHVVGVPSISSQAKQLLLHHTLGNGDFTVFHRMSANISETTAMITDICTAPAEIDRCIRTTYVTQRPVYLGLPANLVDLNVPAKLLQTPIDMSLKPNDAESEKEVIDTILVLAKDAKNPVILADACCSRHDVKAETKKLIDLTQFPAFVTPMGKGSISEQHPRYGGVYVGTLSKPEVKEAVESADLILSVGALLSDFNTGSFSYSYKTKNIVEFHSDHMKIRNATFPGVQMKFVLQKLLTNIADAAKGYKPVAVPARTPANAAVPASTPLKQEWMWNQLGNFLQEGDVVIAETGTSAFGINQTTFPNNTYGISQVLWGSIGFTTGATLGAAFAAEEIDPKKRVILFIGDGSLQLTVQEISTMIRWGLKPYLFVLNNDGYTIEKLIHGPKAQYNEIQGWDHLSLLPTFGAKDYETHRVATTGEWDKLTQDKSFNDNSKIRMIEVMLPVFDAPQNLVEQAKLTAATNAKQ

SEQ ID NO: 22429 - protein, 322 aa, Alteromonadales bacterium
MSTIFEDNSLSIGNTPLVKLKRVTGGNVFAKVEARNPSFSIKCRIGASMIWEAEKAGQLTEGKELIEPTSGNTGIALAFVAAARGYKLTLTMPNTMSLERRKLLKALGANLVLTDGAKGMNGAIQKAKEIQATDPEKYILLQQFENPANPKIHFETTGPEIFDALDGKVDYFVAGVGTGGTITGVSRYLKTEKGLNVKSIAVEPTNSPVISQTLAGEEVKPGPHKIQGIGAGFIPGNLDMSLIDAAEQVSNEDAIAMAHELMKKEGILVGISSGAAVVAAKRIAEKPENADKNIVVILPSATERYLSSPLFDEEFSDQELVQ

SEQ ID NO: 22430 - protein, 442 aa, Thermotoga neapolitana
MIGYQIYVRSFRDGNFDGVGDFKGLKGAISYLKELGVDFVWLMPVFSSISFHGYDVVDFYSFKAEYGDEKDFREMIEAFHDNGIKVVLDLPIHHTGFLHTWFQKALKGDPHYRDYYVWASEKTDLDERREWDNERIWHPLEDGRFYRGLFGPLSPDLNYDNPQVFEEMKKVVYHLLEMGVDGFRFDAAKHMRDTLEQNVRFWRYFLSDIEGIFLAEIWAESKVVDEHGRIFGYMLNFDTSHCIKEAVWKENFKVLIESIERALVGKDYLPVNFTSNHDMSRLASFEGGLSEEKVKLSLSILFTLPGVPLIFYGDELGMKGIYRKPNTEVVLDPFPWSENISLEGQTFWKWPAYNSPFSGVSVEYQKKKRDSILLHIMKWTGFRKENHWLDRANIEFLCKEEKLLHVYRLVDEGRSLKVIHNLSNGEMVFEGVRVQPYSTEVI

SEQ ID NO: 22431 - protein, 369 aa, Zea mays
APPPRPPPARSTPAASTPLRPPPDNRQQHPYRPPRPPTAPASRRQQPIAPSPTAPASRRQQPVAPPPRQRHIAPAAHRASSTSRQQPIALQTRCWYPLPLHPEVLGLIREAHKKGAKIVLVQAALPLMVHRMQQLAKELEVVIPVSFFEEANNAHYNSVAIIDADGADLGLYRKSHIPDGPGYQEKFYFNPGDTGFKAFKTKYATIGVGICWDQWFPECARAMALLGAEILFYPTAIGSEPQDCNLDSREHWKRVMQGHAGANLVPLVASNRIGRETVDTEHGKSSITFYGNSFIADRRLNVRNTTSIEFSAGPTGEIVKLANDKDEEVLVAEFDLDEIKSIRHGWGIFRDRRPELYKVLLTLDGEKQS

SEQ ID NO: 22432 - protein, 350 aa, Lithachne humilis
FGLGASSHGHGHHHHHHHHPWGSSLSAVVAPPPQPPSAGAGAGMPNTPLTLNTAPTPGGNGGGGCGNPVLQLANGSLLDACAKAKEPSAPSSSYAADVEAIKAKIISHPHYSSLLAAYLDCQKVGAPPEVAARLTALAQDLELRQRTSLSGLGAATEPELDQFMEAYHEMLMKYREELTRPLQEAMEFLRRVESQLNSLSISGRPLRNILSSGSSEEDQEGSGGETELPEVDAHGVDQELKHQLLRKYSGYLSSLKQELSKKKKKGKLPKDARQQLLNWWDMHYKWPYPSETQKVALAESTGLDLKQINNWFINQRKRHWKPSDEMQFVMMDGYHPTNATWTAASSTTAG

SEQ ID NO: 22433 - protein, 552 aa, Helicobacter pylori
MSKIADDQYFNDEEEDFAKLLEKEETLEKGTIKEGLIVSINENDGYAMVSVGGKTEGRLALNEITDEKGQLMYQKNDPIVVHVSEKGEHPSVSYKKAISQQKIQAKIEELGENYENAIIEGKIVGKNKGGYIVESQGVEYFLSRSHSSLKNDANHIGKRIKACIIRVDKENHSINISRKRFFEVNDKRQLEISKELLEATEPVLGVVRQITPFGIFVKFKGIDGLVHYSEISHKGPVNPEKYYKEGDEVYVKAIAYDEEKRRLSLSIKATIEDPWEEIQDKLKPGYAIKVVVSNIEHYGVFVDIGNDIEGFLHVSEISWDKNVSHPSHYLSVGQEIDVKIIDIDPKNRRLRVSLKQLTNRPFDVFESKHQVGDIVEGKVATLTDFGAFLNLGGVDGLLHNHDAFWDKDKKCKDHYKIGDVIKVKILKINKKDKKISLSAKHLVTSPTEEFAQKHKTDSVIQGKVVSIKDFGVFIHADGIDVLIKNEDLNPLKKDEIKIGQEITCVVVAIEKSNNKVRASVHRLERKKEKEELQAFNTSDDKMTLGDILKEKL

SEQ ID NO: 22434 - protein, 231 aa, Gracilaria tenuistipitata
MSIVSLSELLEAGAHFGHQARRWNPRMFPYIYTERNGIHIIDLVQTAQLLTEACQFIRDASQEGKKFLFLGTKRQAAGVIAEQAIRSNSYYVNQRWLGGMLTNWMTIKSRVERLQRLEMDEQAGLIDMLPKKEAAINRRELDKLRKNLNGIKNMSRLPDFIVVVDQKRETTAIQECIKLGIPIICILDTNCNPEIIDIPIPANDDAIRSIKLIISRIADSIIEGSTYALNK

SEQ ID NO: 22435 - protein, 360 aa, Leersia virginica
FGLGTSGHGGHHHHHQGHQQQQQQHHPWASSHSAVVAPPPPQTQQQSQAVTMAHSPLTLSTAAAAAAAAGVPVLQLANGNLMDACGGSGKAKEASASASASFAAVNVEAIKAKIISHPHYSSLLAAYLDCQKVGAPPEVAARLAAVAQDLELRQRTALGGLGAATEPELDQFMEAYQEMLVKYREELTRPLQEAMEFLRRVETQLNTLSISGRSLRNILSSGSSEEDQEGSGGETELPEIDAHGVDQELKHHLLNKYSGYLSSLKQELSKKKKKGELPKDARQQLLSWWELHCKWPYPSESQKVALAESTGLDLKQINNWFINQRKRHWKPSDEMQFVMMDGYHPTNAFYMDGHFINVSG

SEQ ID NO: 22436 - protein, 356 aa, Zea mays
MACLTDLVNLNLSDNTEKIIAEYIWIGGSGMDLRSKARTLSGPVTDPSKLPKWNYDGSSTGQAPGEDSEVILYPQAIFKDPFRRGNNILVMCDCYTPAGEPIPTNKRYNAAKIFSSPEVAAEEPWYGIEQEYTLLQKDTNWPLGWPIGGFPGPQGPYYCGIGAEKSFGRDIVDAHYKACLYAGINISGINGEVMPGQWEFQVGPSVGISSGDQVWVARYILERITEIAGVVVTFDPKPIPGDWNGAGAHTNYSTESMRKEGGYEVIKAAIEKLKLRHREHIAAYGEGNERRLTGRHETADINTFSWGVANRGASVRVGRETEQNGKGYFEDRRPASNMDPYVVTSMIAETTIIWKP

SEQ ID NO: 22437 - protein, 313 aa, Geobacillus kaustophilus
MNLYFIINPAAKNGRSVSIWKQLQPLLDREGIAYQAYWTSRKGEGKEIARRIGEESVEPTVIAAVGGDGTVHEVVNGAGSFPHVAIGCIPAGTGNDFVRGFRLARKPKQALQRLLSDVRSGKDLAFDLGRFASSAVPDGVFANSIGCGFDAHIARMANRSAWKGRFNRVGIGSLIYVLYLVIELFRYRPVDLDICIDGRNYSFQQAWMATVSNHPYYGGGMRIAPSARGDDGLLHVTVVGPMQRWKILALFLTVFWGGHVRMKEVSVFAGRNVHIRPAAPVPVHADGEEARVGEVSAWIEAKRMRVIGAELGE

SEQ ID NO: 22438 - protein, 341 aa, Coprinopsis cinerea
MAELRKISLDDAQHLIQAGDVPVLRIKLEEDVEKWKTTQSYQDYGIFLRRLSDSVVNYQLPWSPTEPTERSQSLLEDLLGPEYSSLTDLVRPYFLTSFGSFTRMDYGTGHETSFALFLLCLTLVRYFQPIPEVEREIVLVIFLRYLRLCWRLQDTYRLEPAGSHGVWGLDDSHFLPYIFGSAQLRDQTDIPVNAVLQKPLPETNLYFLSISRIHEVKHGPFHEHSSSLHSIAVGVPNWGKVHSGLFKMYEAEVLGKRVVVQHIPLGGLLKWDPKASSTDEASSRHPQAPAHYSTATAAPTTWTPLPTIAPRTSHPSRRPDATTFPAPTGMPPPTSFPRGPT

SEQ ID NO: 22439 - protein, 320 aa, Aspergillus oryzae
MTFHPDTLPNLKGKVFIVTGGNSGIGYYTVTHLAEHGAHVYLCARSLEKGTAAIANIKEMHPSANINLLQMDFMDLTSVVAAAKHFLTLETALHGLVNNAGIMATPFEITKDGHEAQWQTNYLAHWVLTEHFLPLMLLTAKGLYPGSVRIVNLTSSGHLGAPKGGINFKDLSLKDSGPWARYGQSKLANILHAKALHKAYGPGSPSARNGEGEIWVSSVHPGLVETNLATSVEDSGSGMTCVFSVLRMFGLMWSADKGSWTSLFCVASQDMKAEQSGTYLEIFRRFGEPRWQSDMANDWKLVKRLEEWTREVVRKEGWVL

SEQ ID NO: 22440 - protein, 336 aa, Pharus lappulaceus
YGVLGAGASTTTHHHHPWASSLSAVVAPPPPLPPTPLTLTTTPTATTTTNNPVLQLANGNLLDACGGKAKDPSSSSSYAADVEAIKAKIISHPHYSSLLAAYLDCQKVGAPPEVATRLTAVAHELEARQRTALGGLGAAMEPELDQFMEAYHEMLVKYREELARPLQEAMEFLRKVELQLNSLSISGRSLRNILSSGSSEEDQEGSGGETELPEIDAHGVDQELKHQLLKKYSGYLSTLKQELSKKKKKGKLPKDARQQLLNWWELHYKWPYPSESQKMALAESTGLDLKQINNWFINQRKRHWKPSDEMQFVMMDGYHPTNAAFYMDGHFINDSG

SEQ ID NO: 22441 - protein, 452 aa, Arabidopsis thaliana
MDKHIIDGRTVEAKKAVPRDDQQVLKRHASPMHLISPSHGGNGGGARTKKIFVGGLPSSITEAEFKNYFDQFGTIADVVVMYDHNTQRPRGFGFITFDSEESVDMVLHKTFHELNGKMVEVKRAVPKELSSTTPNRSPLIGYGNNYGVVPNRSSANSYFNSFPPGYNNNNLGSAGRFSPIGSGRNAFSSFGLGLNQELNLNSNFDGNTLGYSRIPGNQYFNSASPNRYNSPIGYNRGDSAYNPSNRDLWGNRSDSSGPGWNLGVSVGNNRGNWGLSSVVSDNNGYGRSYGAGSGLSGLSFAGNTNGFDGSIGELYRGSSVYSDSTWQQSMPHHQSSNELDGLSRSYGFGIDNVGQTHQQCLRRYSGTTMSEIDKHIEVLKHRKKSTKRSENCRSRRTAISVAEFEELLFRYQVEKETNFLHHSEFLVLFFSSLASQTQKREVYFYFKNSYIR

SEQ ID NO: 22442 - protein, 83 aa, Panicum miliaceum
EPLVVGRVIGEVLDSFNPCVKMIVTYNSNKLVFNGHEIYPSTVVSKPRVEVQGGDLRSFFTLVMTDPDVPGPSDPYLREHLHW

SEQ ID NO: 22443 - protein, 483 aa, Methylobacillus flagellatus
MSEEILINVTPQETRVAIVEQGVLQELHVERATSLGLVGNIYRGKVCRVLPGMQSAFVEIGLQRAAFLHVADILECCSPEKEKAIQEVLHEGQPIMVQVIKEPIGTKGARLTTQISIAGRFLVYLPQQQHIGVSQRIEDEAERELLRERLLRLLPEKREGGYIIRTMSEAATDEELLADIDYLQKVWSNIQAASHGAADRSLVFQDLDLPMRVLRDVVNDDTERILVDSRETYQKLLDFASHYAVGAVKRIELYQGARPLFDMYNVEHEINKAMSRKVELKSGGYLIFDQTEALTTVDVNTGGFVTGRSLSDTIFKTNLEAAQCIARQLRVRNLGGIIIIDFIDMDEEEQQSAVLAELKKNVAKDRARTGVNGFSTLGLVEMTRKRTRESLAHLLCEPCPSCKGRGEVKTAQTICYEIFRELLRNAKQFTAREFRILAAPKVIELLLDEESQSLANLSDFIGKPISLQAETHYAQETYDIVLM

SEQ ID NO: 22444 - protein, 381 aa, Musa acuminata
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLKVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGH

SEQ ID NO: 22445 - protein, 83 aa, Sorghum halepense
EPLVVGRVIGEVLDSFNPCVKMIVTYNSNKLVFNGHEIYPSAVLSKPRVEVQGGDLRSFFTLVMTDPDVPGPSDPYLREHLHW

SEQ ID NO: 22446 - protein, 266 aa, Oryza sativa
  misc_feature (222)..(222): Xaa can be any naturally occurring amino acid
  misc_feature (236)..(236): Xaa can be any naturally occurring amino acid
  misc_feature (260)..(260): Xaa can be any naturally occurring amino acid
MAKRSSPDPASSSPSASSSPSSPSSSSSEDSSSPMSMPCKRRARPRTDKSTGKAKRPKKESKEVVDPSSNGGGGGGGGKRSSIYRGVTRHRWTGRFEAHLWDKNCSTSLQNKKKGRQVYLGAYDSEEAAARAYDLAALKYWGPETVLNFPLEEYEKERSEMEGVSREEYLASLRRRSSGFSRGVSKYRGVARHHHNGRWEARIGRVLGNKYLYLGTFDTQEXAAKAYDLAAIEYRXANAVTNFDISCYLDQPQLLAQLQXEPQLLA

SEQ ID NO: 22447 - protein, 537 aa, Oryza sativa
MDGGLREVSLSVVFSVWCLLFLLRSQFLHSQTDPSDFYDDVEDGMRENYCKVMPLEAYIFPTEYNASAAAPTCQPSLHPPDQPQQETDHRSLEPFNNTTGGKSSAEAAALDELDEFRSRILQGKAENGRVPDGATPAAHRLEPSGAEYNYAAASKGAKVLAHNREAKGAANILGGDKDRYLRNPCSADDKFVDVELSEETLVRTIGLANLEHYSSNFRDFELYGSPSYPAPAEEWELLGRFTADNAKHAQRFVLPDPRWTRYLRLRLATHYGSGFYCILSYLEVYGIDAVEQMLQEIISGSGADTDASAAAKAEEGGDGGTLRNDIAQVNARLDGVGGGGGSAAGRNDSAGDGAGAKNNGSRMTVAGDGKPAAAGRFHGDAVLKIMMQKMRSLELGLSTLEDYTKALNHRYGAKLPDLHTGLSQTTMALDRMKADVRDLVEWKGNVAKDLGELKEWRSNVEEMRSIQETMQNKELAVLSISLFFACLALFKLACDRVLFLFTRKGAAAAERMCGASKGWILVLASSSFTTFLVLLYN

SEQ ID NO: 22448 - protein, 487 aa, Escherichia coli
MSLAKDNIWKLLAPLVVMGVMFLIPVPDGMPPQAWHYFAVFVAMIVGMILEPIPATAISFIAVTICVIGSNYLLFDAKELADPAFNAQKQALKWGLAGFSSTTVWLVFGAFIFALGYEVSGLGRRIALFLVKFMGKRTLTLGYAIVIIDILLAPFTPSNTARTGGTVFPVIKNLPPLFKSFPNDPSARRIGGYLMWMMVISTSLSSSMFVTGAAPNVLGLEFVSKIAGIQISWLQWFLCFLPVGVILLIIAPWLSYVLYKPEITHSEEVATWAGDELKTMGALTRREWTLIGLVLLSLGLWVFGSEVINATAVGLLAVSLMLALHVVPWKDITRYNSAWNTLVNLATLVVMANGLTRSGFIDWFANTMSTHLEGFSPNATVIVLVLVFYFAHYLFASLSAHTATMLPVILAVGKGIPGVPMEQLCILLVLSIGIMGCLTPYATGPGVIIYGCGYVKSKDYWRLGAIFGVIYISMLLLVGWPILAMWN

SEQ ID NO: 22449 - protein, 387 aa, Ustilago maydis
MQIFVKTLTGKTITLEVESSDTIDNVKAKIQDKEGIPPDQQRLIFAGKQLEDGRTLSDYNIQKESTLHLVLRLRGGMQIFVKTLTGKTITLEVESSDTIDNVKAKIQDKEGIPPDQQRLIFAGKQLEDGRTLSDYNIQKESTLHLVLRLRGGMQIFVKTLTGKTITLEVESSDTIDNVKAKIQDKEGIPPDQQRLIFAGKQLEDGRTLSDYNIQKESTHSPCSTLHLVLRLRGGMQIFVKTLTGKTITLEVESSDTIDNVKAKIQDKEGIPPDQQRLIFAGKQLEDGRTLSDYNIQKESTLHLVLRLRGGMQIFVKTLTGKTITLEVESSDTIDNVKAKIQDKEGIPPDQQRLIFAGKQLEDGRTLSDYNIQKESTLHLVLRLRGGK

SEQ ID NO: 22450 - protein, 435 aa, Nostoc punctiforme
MTTFDIGSPLIAIAQKTRKAASKLAILSTEAKNQAIIAIAQALESAKDEILQANIADCEAANAEGIPKPLYKRLQLDEHKLRDAIVGVQDVGKLDDPVGKVQIHRELDTGLILKRITCPLGVLGIIFEARPEAAIQIASLAIKSGNGVILKCGKEAVRSCEAIVKAIKQGLSHTAVNPDTVQLLTTREETLELLKLDKYVDLIIPRGSNSFVRFVQENTRIPVLGHADGICHLYIDKAADISKAVPITVDAKAQYPAVCNAIETLLVHQSIATEFLPKVADALQERHVELRGDKRTLKILPNIVSATEIDWETEYSDYILSIKIVDSIEDAIAHINEYGSRHTDAIITEDSTSVETFFGLVNSANIFHNCSTRFADGFRYGFGAEVGISTQQMPPRGPVGLEGLVTYKYQMTGDGHIVATYTGANAKAFTHRDLV

SEQ ID NO: 22451 - protein, 641 aa, Bacillus clausii
MCSISPTAGLHIPLEPELFFVLFIAPLLFNDGKVTPRDELWKLRLPILLLALGLVFATVVVIGLFIHWLIPSIPLPAAFALAAILSPTDVVAVSSIAKRVHMPKGLMRLLEGEGLMNDASGLVAFKFAVAATVTGVFSISEASVSFLLIALGGLGLGVLFSFMLIGLKMALRRFGMEDITTHMIIQIITPFVIYIGAEEFGVSGILAVVAAGIVHAIEKEKVESRTLELQRVSDTTWSVILFILNGLVFVLLGLQIPDTTRLIFEDPQITNMEVIGYILAITASLLLLRYIWLALFWKKIKPLLFFQAEPEEKHRAIALLTFSGVRGAVTLAGAFTIPYIVADGSPFPERDLLLFLAAGTILVTVLLASILLPLLAKKPELQEADQQLSFTRALEQLTQEARVILADKSHSHNKQTLRRLQREYDRIVIPLLHDANTNHTLIAPNRKKELFLLFKALQHEYDLLEATLEDPTLTEAMEKRLRARAQNIGQILSVRSPLAFLRFGSKHFIDRMLNKANKNRLSIEEKNRLYLIYTRLFADIIKKLDEQMTAENESVTKRVIHFYRIQLNRLDHVHLNYDEKLYKEMLGLHYEIMEEMRRSLQTLFQNNDLSRETTQKLRRYLNYIEANVTEALQLPDEKNGH

SEQ ID NO: 22452 - protein, 130 aa, Ginkgo biloba
SQIFSEGGLDYLGNPNLVHAQSILAIWACQVVLMGFVEGYRIAGDPSGGLDPLYPGGAFDPLGLADDPDAFAELKVKELKNGRLAMFSMFGFFVQAIVTGKGPIENLYDHLADPVNNNAWAFATNFVPGK

SEQ ID NO: 22453 - protein, 323 aa, Desulfitobacterium hafniense
MTNTVRKIAVLTSGGDAPGMNAAIRAVVRKGIYHGLEVFGIRKGYEGLIHGEFITMHLGAVADIIHRGGTMLMTARSQEMLTPEGQKNAAAQLRYRGIDALIVIGGDGSFRGAQTLSAQGIAIVGIPGTIDNDITGTDLTIGFDTAVNNVVQAVSKIRDTATSHDRTFLVEVMGRDCGNIALQSGVACGAESILVPEIEPDLDDIVAKLERGHQRGKHHSIIMVAEGAMSAWNLGEELRQRTGFETRVTILGHIQRGGNPSALDVVLASQMGGKAVEILCAGETDRMTACVNQEIQSLPLEVAYGERKPFNKVLYDLANQLAI

SEQ ID NO: 22454 - protein, 808 aa, Magnaporthe grisea
MSPPNPRKRAAPGAIPAVQIPTTVQQYQSPYATPLDQVSRWNGAEVYATDPITPGPKNIPQFNMTEPHSSYPNATTHQSYQHQAIATPGPTNAIARRPAGSSRALVTRQQYDGLSTEPWPSFSDETALMPASGVVNPLDENDNIALLEERAARAKRDAQANRKQIPPFVQKLGSFLNEEKNTDLIRWSQKGDSFIVLDEDEFAKTLIPELFKHNNYASFVRQLNMYGFHKRVGLSDNSMKASERKNKSPSEYYNPYFQRGHPNLLWLINKPKSGNSKKRSAKNNDGAEVESDEDATPTVEDINGAGYVGAAQNSSRSGGPAQGDPGSQALQKKDFQVVKDQLNQLQTQQRAISNMIQRLRSDHTALYNQALAFQNMHERHENSINAILNFLANVFRKSLEEQGGNSNHTMQDLLASIIPNGGSGSQMHKGSVVDLGDFVQQQSVDHSNVADNTPKRGQRLLLPSRGGRASATSTAAKSPSASYATSPRGQMGSVTELFDNSPNEVTSPPDYLSNDLRQSPQQMMRIIDATNAAGATADIDLPDIAAKTPVTLSSDQRNQMLNLMASQATAPQSTSSIPATASPLPATTTATSPQPIPAMQQRQQQHRATPPPVPAQAASGMVSSPVNSALGASPPRSLSPLMSSMPPPPSLHDITMTQEELDSLQRLQDEQKHKIDEISHFLAPLSPSGRVPGVDEAGNPTTVSPEASGSYFPDMTDNMDIEQFLDSSAFGAFDASGTGGSADDFNFSLDANYDGSTPVAAYSLAAPITESHSNTPSSAATEEYVIRKDFAENDGSAVGPDAKRRRMG

SEQ ID NO: 22455 - protein, 182 aa, Mesembryanthemum crystallinum
MASSMVSSAAVATVNRTPAQASMVAPFNGLKSVAAFPVTKKNNDITSVATNGGRVQCMQVWPPLGKKKFETLSYLPPLSEESLMKEVQYLLNNGWVPCLEFEPTHGFVYREHGNTPGYYDGRYWTMWKLPMFGCTDPSQVVAELEEAKKAYPEAFIRIIGFDNVRQVQCISFIAYKPASYDA

SEQ ID NO: 22456 - protein, 372 aa, Burkholderia vietnamiensis
MRSIIADSKRLVVKVGSSLVTNDGKGLDHAAIGRWAAQIAALRAQGKEVVLVSSGAIAEGMQRLGWNKRPREIDELQAAAAVGQMGLAQVYESRFTEHHIRTAQILLTHADLADRERYLNARSTLLTLLRLGVVPIINENDTVVTDEIKFGDNDTLGALVANLIEGDALIILTDQTGLFTADPRKDPNATLVAEASAGAPELESMAGGAGSSLGRGGMLTKILAAKRAAHSGANTVIASGREADVLVRLAAGEAIGTQLIARTARMAARKQWMADHLQVRGHVVIDAGAVEKLRDGGKSLLPIGVIDVQGAFARGEVIACVGPDGREVARGLTNYSSAETKLIHRKPSGEIETVLGYMLEPELIHRDNLVLV
